United States Patent 8,216,786 (GENETIC POLYMORPHISMS ASSOCIATED WITH CARDIOVASCULAR DISEASES, METHODS OF DETECTION AND USES THEREOF) - sequence listing, part 7

SEQ ID NO: 1204 - DNA, 160500 bp, Homo sapiens
agttatcatatggaatgtttccgtaatggaatttatgtgcacagaaacttttgaaattagcaaaatacacatgcatatgcacttgaaaatacacttcagttacccttaaatggagtctctgataaacaaataggcactaaaagagaggtctagggagaaacatgtcactcttttttaagcctcttcactggcagtggcggggcactgcatagctgaggactggggtgcttaaatacatgcttctctgcattccagcctgggcgatagagtgagactgcatctcaaaaaaaaaaaaaagtaataataaataaataaataaaataaatgcttctaagacaaaacccttgtgtgctgcttcttctcttttccaatcaccatcctttgacgtttcttaaggctaaaaaaaacccccaaaccattagatgtttaatctttgcataccctagtagttacaagtcctctaaaacagaaccatacagttcacaggtcagtatcctttctgatggtctttgtcagacatcattatttctagcataggatattggacaggatcaacaaaaaggaatcgaagacagtagggaccactaccatgacagctgcagtattatttggcaatgtgatctatggttattttaggaaaaatggcatttcaggaagtgatattaatctgtaaaattcctttgccatgcagaatataaaaaatgattacagaatatgcagaaaaaagcaatgctccttccaaataatgagatatttgatataataaggagatgggaaataatcaatatttaaaaatattccttttaaaaaattaaagtttaggatagttacgtagttagtatacaacaacttggtcttaataaggactagaaacaaaattttattttgtgtggctaaagaaatacatacatattataaaactgacatttttttgcattgttccgttgggtatcatcacaggttgctgcatcattatagttgtttttaatgtaaacagataaactctcacactttccaactctggtattatccatctatttttcctttcacagtccactgatacagaattttaaacatttagagtaggagggaaccttagcttccagcacaatactgttcatctttcacatgaggaaatcatccaacagaagttgaatgatttactcagggtcaggccgcaccttggcagaattacgtcttattattctttctcaaatgctcttttaaaggttaaacagaggttgagttttgagaatgacttatttctcttagatgaatttcgttacagacaagcaaaataatcagccactgtctttctcttttctattttttcttttctgtttgccacctctaggcaacaacctcattgaatccacaacaaaatcctgaagatttctgtattatccaagagaaccattttctttaagaaaaataaaatactaaatatgttttgaatataaaagtttctgataaaagtaatcctgactttaatcagatcaagtaagataatcagatttataccattattttgataaagacaaaaaaaacaacataagctttttttccccagtcttacactttgagcaactcttttaaatactataaacacttttcatcagggacaatttttccctttccctaggaaaatgaaaaccgaatagaaaaattttttgcaaaaattaagtttaagagggtaaaatgtgaagacagagaactgctacttaatcagaaataagtaaacaatattaaacaggaaagtatatattccatttaaatgagtttttttcttcatattcatatcacaaagtaacttcactatagcagcactaattcattatgtttttatttactggtggatgtcactggcctcaataaaaatatgtaatttttcataagaaatattcaaaagaacataaagtttgaaaaatataatttaccagaaagcaccaacatgggaagctcttcaattaaggatgggaaattattaatatgctttagcctaaatttaagcaaaattcattcctaaagatgaatttttaatgaattttataatgaattattcagcatgaaaataaagggagcaaacttttatgcttttaaaatatgtttaagaggatcttatcttttaacaacacctctttcattttgtaaacaggacattatgctaccaaatatagagttattattctaaagtttaaagcaatgctttaaatttttaaaccttatgacatgttcataaaattcacggataccaatccatgaaaaaattcttcttcctcaacccacatttttaaagatatttacaattgtattggatcttttactctggttgctttaattcataattagatagcatctttcaggactcaagtatgggatctttcatttttcagataattttttcttggtggtcaatagaaaagtcatatcaaaatgcactcttgatgggaatgaaaagagaattatgatttttggggacgggtgctcacaaaactattaaggcagctttgtttatgtttataggactagtaataatgctaacttcattaaaaaattatattgaccattttatattcttccaccagagagacagtttagctgtacttgtaacctcacagcactccagtttttactcattccccaaatcatcccactgcctttggtcccaagactactgacagactcttggtccttcagtgaaaaatcaatgctttaaacaatcgggtctagagttacctatttgcttaaacttggatttgatgaggttgctaaatgaacattatacctttctcataaagataaaggcttcatgctaataaagtatttcaacagaaatatacctttttactatagttctaatactcatttgctcttataagggcaaggtctttggataaagataatagtaacagaattagtaaaaattgactgaacgtgatactttattaaagcttttaaatatgggtgtttttcattagggaatacggtttaagataacacttggttaaattatttaatatcctggcactcctgaagtgcactacttcaggaaaaagaccaatatatttgtgaggggaatacaggaaggcaagatggctaggaagagagaaaggaaactagtaggatgaactgaatatttgtatatttaaaatacacatatatttgcactttaagtaaataccaatgggattcattcaaaatttccttgatatttccttggtatagttaatatatttcaaattaagtgatatgttaactagctcaagtatgatatctaagttaaaaaaaagtcacttaaaatgacagatctgaaattgaatctactaggtacaagatagtatatataatatgttttcatctgtatgttttaaaaagaatatatatatatatatatatatatacatacacatatacttgtatatgcagagtaactctagaaggatacacaagaaattgctaacattggttgctacttttcaccctctacccatctgtactgtttccattttgtactatatgtatgtttttccctattcaaaaatattgattaaaatctcattaccaaaataaatttaaatgatttaaaatagcatgtcaaattaataacaagtacggattttttccattatacatgaaaatatatacttatattatttttctaagctctacctactaaatttgggtatattttctttacgacagagttactgtgatctgaaaacccaattttcacatgatattaagttgggaaaaacacattttccctgaacttcattgctacagtatggtggactatgagttgtttcaacagcatgttaacatacttattctttttctctgatgggctagccattagccaccatttctctttgaaattcaagaaatatttaaggaaatttcagaaggatttaagatccttttcaggccgtgataaatattacacctgtattattctgtaggcatagaatcaatgttaactcctctttgtatgttgtcaaagatgtttggtgttttagtaaagacagacttcaaactaagtggtgactaagcaaaccccttacataaagctttgaataggatttcataaatagttccaatgaaaaacatttggagataagaaggaaaaaaagctcacacttatgaaaaaattattttcagaaaaccacttaaaattcaaattaagtcctattcatttaaatattaaaatataccataaacccaaatttaaaggaatgataatacatacatcagctttcaatggtagctgcttatttaaaatgagcatctgagggtatattccagtttcatcctcttcaaattgtgcagctcagataaatgtttattttatggaaaatatttgcaaaattacaatataaatacatgattatattaaggtaggatgactatataatttattcttatctatagatataaaatgaactcagtaaatatagcacactcttgatgaattgttagtacacagtgtttctcagtaaagtattattaagcaacagttatctagttttcaaatgtacatcttaagaagcttttaagatggaaggatacactaaatcccccaataccctttttagttggggaaggttagtacttctgtgaattctgagatatcatatttgtgttagtgactgttcataggttccttgcatttccttaacttgaaaccttacttctttagtctgaatgttctttaaataatgccacatcagctaaccacacttttaatttgagtataatattatgtactgcatatttattcattacttaaacacatatcaacaatgaaacaatgattgaaaaaaattttgtctagacaaattccccaaattaactgtcagggcactgtggggaatctcaactaaatatagtctcaactgtaataagaatttgggttagaaatagtattttatttattctagttcttaagacatcaaatgtgaactctactttaaaattctttgttaaatatactgggatttgtttcaaaagcatcttctacccttctccattacactgatttaatggaaacctgttacaacaacagttccaacacaaacatatgcatgcacgggatcaccttatagattctagctacatagttattgaaacacatcccacctgtcaagtggcataaatgtacatcttctatatacaaaaggtaaagtgcattattaaattagtgaactgacagattgtctgcctggaccatacagctttcaaatagacaaatgtgaaattctcatattagaaccaattatttcaagaggttccaactagcttttccaccctgtcatttatttttttggccatgctctttagtgcaaataagcttgtgtttgactcaagtttcagggacatggcagtctggggctttaacaaggaaaattataaaatgtagaggaactttaatatctttataatacattgcatcttttgcataaagcaacagattagtgctgctttcgattgctaggagcacactgccaactatcaagaggaacccgtttccaaatttcatactattagcttatattactacagtttgagcctgtaccacattatgcttggattattaggtgcaaacatcatcagtgttttagaattatacagtgaactagtacttttggttactaactttcatgctcattttttaacttctaacttccagttgccttaagagtttaatgtcttcaaggcagggattctgttattttgaaggataccatgaacacttgcagctccatgtatgttacaaatgacaataaataaaatgcatattgcacagataagaatagtagcttattttataagatacatggcaatacatgtcctaagaccagagttttgaactggatcatatttaattacggctaatgaattcttgggaattttaagtatcaaaaagtcatagcatcatctcatttttgaatgattaactatgaaaaaaatgaaacaaaaggactggcagaaggcttaataattttagagtatactcaattgccagtatatatgcatctatttaatctgcagctttgagatggtaaaaactttgaagtatacatacaaagtagaaaatctggctgcttaactaattctttacttaaataattaatggaaaactaaatttaataatgtttatatacaatgagttaaagatatttatctttaagtctgacatggtattgtatgtatgtatacacacatatatatgtatacatgtatatacatatgtctgtgtgtatatatatagatatagacacatacccaaatcttatcagacccaaaaggtaaaaggaaatcatttagacctaatggatataaatattttagaaaggaagactttaagagagtgtatacactcatagcaatagcgataggaacaatcaaatactagaatattcacagctccagtttgccaaaatctgacaggttgattattattaataggcactatgatgggcagcaataacaatcagtagtacagtaattcaagtgcacatcattccttcatagaccaaaaactacttttttagcaagcctacatagttattttacagttaggactgtttaaaaatccttgctacttttagagtctcaacacccaccatgtgctattagctctagtactaacattatctcctaaccttcagttgttccatagtgatccagatggtccacaattataatgaactaatgagattccttcacgctactagaggaaatgtgaaatacaatctgcaaaccaacactagtatatatgtcggggttactgattgcttgttcttaagtaacataaaccaatgaaattaatttttttaattcataccatcaagttttcttagtgacctcacgtaaaggtattgggggacaaaactctggaagaaaaaaatcgctgatataattttaaattacttttagcatataaaagaagagctacattctgatttgaatccatgcagccagctctcatcaatgagagtgatatttgggggttgaaatcagtgttctggctcttaaatatgattagatggacttattgtgtgggaggtgaataaagccaagataaaagacaataatttcattcagaagaaaatatagctgaatagatgtaatttcagtcaattaatacaggatgggttggtacacatataacactatatccacttgtttaaaaaattgcttaggtgttgaaaaattgctgtggcacttcctggaaagtaatttttaatacaggtaaatgggtgagtcttgtgtaaagtcagaaagagcaccttggaaaatgcctgaattttcctttcaaatatatttataaccaatcttcaaataatatttttctcagactggaaatttgtattctaaattatttttagaaaaaaaaaatccccaccccctccagaattaaaacacctgtaaaattcaggattatattggaagtgttgacatggttttaagggtagcaattgcaaaagtgctactaaaatatattattacaggtatatttttatatcagttaattggtacaccaacccttctgaaagagtgttaaagaagaagcataaagtataacaccttgagtccatgatatattttggggaagaaacctcttgcaatctttaaattagcatgaaaagctacaccaccaagatttccatagcaaagccattggatgaagcctcccactcaatgtgacataaaagtaattcctgaaactttggaaagtcaataaaaatatatggaacattaagtagaggtaaagaagggattgtaactaaacttagaataacgaattaaaactctcccatggctttgatatggcaactataaaatgtagggttaccacaaagtttgaaattatagaatactatagtattcttaagaaatattatgacattatatttttaaggtttaattaggtaataagatttgatcctttgatggtatattcagttattcaacggacaatatacgtctacttgtacttttataagtaaatatttatatataccggaggtcaatttctgtttctgtggtaactgccctacaggtaagcttagcagcttttaatgaagtagaattgaaatacttttgggggaaagtcacacttctatttaagtatatgtatcttttttcgggattatgtcatagtgcaatgtaaatcttagttatggtatttagaatgtcagaatgtcacattttgtgctgatttgcatacttcaatagtctggagcagttgaagcagctaaactatttagctctgggaaggttggaattcccgtaagaattatagtgatctatgtgtaacataacatgagaatcagacttcctgaagtatcaactactagaggtattactaataacaacgggccaaaaaagaggaaaaacttcttcaaaggataatggatcagtacttttagccaatttgtgattttaaattttgcctgatggagttcaatttcactctagtcgaggcattcttgttcttcaccactggcctttctgccatccattctcttttctttatggctgttgcaaattttcctcatctcttcttcatacttgataaaattctccccaaaccttgtccaagctttgaatggaacagtaatagtattacggtaaggtggtctcacctcacttaccttcaggaaaattccatatttattagagcccacatcaaagtagaaccttttattgtccactctgaaagaagtcccctctgggagttcaagcgggtcatcgtctccacctcttcgttcttctatgtctccttcgccatagtcttcaatcagctgaaccaaggcatcacgaaactcaatcattccttgtgctgggaggacaatagtctgttcttggcccaaactgtggccaaaataacctatcatgccagtcccccgcatcatggtttgtctaatccgtaggaagcgaccccgctgattttcctttaggtctaggtaatatttcctattgtccctctcgatatagtctgttttcaggacactgtgaggatgctcttcggaccccaccgagactggtggggagggtgccgagtgcttctgcctccttctggagccttgctctttgctgtggccatgctcttgccggtggcctttcaggcccaggtgggcatagtgctcgatgaagtcccctagacagtccttcagctccgctgccacagacagggagagggtcagtttactctttctgatgttgtcctgccggcctctccctatccagacttcggctatctttaggaagcggccccgggagctttgcttcacgtctaggtaaaacctctttttctggatgtccactcgtttggaggccagctcctggatttcggctgcgcccccggcctgattaggggtggctgaggccgcgtagtgggggtagtgggagtgctgggcctggggatagagtctactcttgcttaggccagagccccctacattcttgcctccgcggccgcggccgccgccgcctccccttcgcctggctctttccatcttcagctgcaagtaacaaacagacacacgggatggggtgggggaggggtgttgagaacaatcgcagacgcccctcggcctgaccgccccgccgccgcccgcgacccccacgccgggcccggctcccccggcgccgcagcgcggggctccagccactgccggccggttggcggccgccgctccggctctgcccgcgctccccgcatccctccgccgcccccggggccgctcccgcacgccgccgccgcccgtcccgcgctccgcggccccaggtctccagccggcgggcactcacatcatctctgccatcaccgccgccgccgatgcccttcacgaccaccgccgccgccaccgccagctctcggcccctctgctgcagccgccgcagccgccgccccccgcctcctcccccgccgccgccgctcgcactgccccccgccggagcagccgggcaggggcatcgcccgcggcgcccaccgcagccgcccctcctgcggccgctgcgggggccgccgcctgacttcggacaccggccccgcacccgccaggaggggagggaaggggaggcggggagagcgacggcggggggcgggcggtggaccccgcctcccccggcacagcctgctgaggggaagagggggtctccgctcttcctcagtgcactctctgactgaagcccggcgcgtggggtgcagcgggagtgcgaggggactggacaggtgggaagatgggaatgaggaccgggcggcgggaatgttctcacttctccggattccaccgggatgcaggactctagctgcccagccgcacctgcgaagagactacacttcccgaggtgctcagcggcagcgagggcctccacgcatgcgcaccgcggcgcgctgggcggggctggatgggctgtggtgggagggttgcagcgccgcgagaaaggcgagccgggccgggggcggggaaaggggtggggcaggaacgggggcggggacggcgctggaggggcgggtcgggtaggtctcccggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcggggtaaagtgtcttcctattcccgttttcccagctccgtgccccggggtatctatagtgctaggcttctgagacacgtggaggcgcttaggcccgcggagcaggcccctgggctgtgtttgggagattctggaaaaacagactttctcccttttcctttcccctctggagcagctgggaaaggcgtctctcggagcttccgccattcagaaagtgtttccccgcccctgacggccccagcttgatgtttaccttgcgcgcttagttaggattgctctttctagtacggcctttattatggcagaaattgagccactacaggtctgcacagcaaagtcgagggaaataacctgctgtctatgatttagcaagtgatgatggatatttttgagttcaaatcactcagtctttaatggattttcttttctttttttcctagttgaatctcagttgttctcaggctaggtttgatatgaaaaatactactccctattgaagagggtaatataattcttaggatgctaatacaggagtctgtaagtcggagtacttcaggctttttatggttcggtacatttctttttaggggtgggatattgggataagtaggacagttcagatcttgatgtcattgaatagtggtgtctacctaaaaggaagaggctggggcacaaaattataatttaaagtgtttacttcagccaaaatgaggacagctgcccaggactcatttcccagttgccttggggagtgctccttcagccttggttacaagcaggtttttaaaggcgaaggggaagagtgggctgagacaaagttggtcaggaattgttattggtttacagagataccattgcttagtgattggctgtacactgtaactcatagggtatgagttatcgtgtccagcatatggcattttatggcttcttggttccagtctagagcccatatagcaggtgggctttaagagataattatccagctcagaccgggagtgagacgggactgttttttcattctaatgcctctctgggcctgataatttaaaggggcttgcattcttcagctaaaattttattttcttttattttttttcccccacagtggtctccctttattaatccaacaaatgtttattaaggactgctctaggcactagagataccaacaatgaacaaaacagacaaacatctctctccttttggagcttacattttagtggaaagagacaggcaaaaagtaaaattataggatgacagaaggtgaaaatagagattaaaaaggaaagggggatgaagagtgtgtgtgtgtgttgtgggtggggggctgtagggagctgcagttttacaataagtggtcagggacgtcctcgctgagaagggaatttttgagtccagagctcaaggaagtgagagaacttaccttgacgttctctggaggagaagaaagtacaaaggccctgggggaacctgcctctttatgttcagagagcaacttaagaggcctagtgagctggagcagagcggagaggaggtcagaggtcaggccagaaagggaaaggggccagaatgtgtaggactttatgggctatattgaaaattggggctttcattctgagggagatgggaagctgttggagagttgttagggaaacgtgatctgaattatgtttctaaaaaattggagtaagatatcataaaatttgccatcttagtcttttttgtatctggccaattccactcagaattcttttttaaacagctttattgagatataattaatatatcatatgattcactcatttaaagtgtgcaatacaatggtttttagtttgtcttcagagttgtacaacctttatcacaattacctttaggactttttcattacccaaaagagaatctccataaccattagtactcaatcccacccgctttcctagcaatcacttacctatttttttgtctctatatagctctcaaaccctatgatattccttctatctaactgtatttttgtactcattaacagcctctcttcattcccaccacccatccatcccagcctctggtaatcaccattctacttactacctcaatgacatcaaattttttagctcccacatataagtgagaacatgcgatatttgtctttccctgcctggtttatttcacttaacagaatgtcttccagttccattcatgttgctgcaaatgacaggatttcattctttattatggcttaatactattccattgtatatgtatatcacattttctttatccactcatctgttgatggacagttagcttgattccatattctggctattgttgaatagtgctgcaggaaacatggaagtgcagatagctctttgacatactgatttcatttcccttgaatatataccctgtagtggatttgctggacccgcttgtagttctacatttaatattttgagttatttccataatgttagtaataatttacattcccaccaacagcgaggaaggagttcccttttctccacatcctcgccaacacttatcttttgtctttttggtaatagccattctaacaggtgtgaggtgatatctcattgtgattttgatttacatttccctgatggttattgatgagcaatgtttcatatacttgttggttatttgtatatctccttttgagaaatgtctattcaggtcttttgctcattttttaaatatggttttttaatttttttatttttttgctattgagttgtttgacatccttaaacattttggaaattaacctcttattagatgtatagtttgcaaatattttatccgattctgtagattctgtcttcagtctgttgaatttgctgtgcagagaagcattttattttgatgtaatccctttgtctatttttgcttttgttacctttgcttttgaagtcatatccaaaaaatcattgcccagatcagcagtccccaacctttttggtaccaaggactggtttcatcgaagacaatttttccatccacaggagggaggggatggtttcaggatatttcaagcgcattacatttattgtgcactttgtttctattattattacattgtaatatatagtgaaataattatacaattcaccataatgtagaatcactgggagccctgagcttgttttcctgaaacttgagggtcctatctgggagtgatgggagacagtgacagttcataaggcattaggttcttctaaggagcatacaacctagatcccttgcatgcgcaattcacagtaggttttgcgctgctatgagaatctaatgccaccgttgatgtgtcaggaggtggagctcaggtggtaacgtgaggaatggggagcagctgtaaagaaaaatgaagcttcgcttgcttgcctgctgctcacctactgctttgtggcctggttcctaacaggccatggactggtactaatctgtggccctggggttgggaacctctagccctgaccaatgttagggagcttttttcctgtgttttcttcaagtggtttcatggtttggggtcttacatttaagtctttagtccattttgagttgatgctgtatgtggtgagagataattgactactttcattcttttgcatatggttatcagttttcccaacaccgtttattgaagagcctgacctttccccattgtgggttcttggctcttttgtcaaaaatcagttggctataaatatgtggttttatttcttgggtctctgttctgttctattatctgtgtgtctctttatgccagtaccgtgctgttttaattactagagtttagtatattttgaagtcaggtagtgtgatgcccctagctttgttcttttagctcaacattgctttggctattcagagtcttttgtgaggataatgttttcaaggttcacccatgttgtggcatgtatcagaactcgatttctttttatggctgaataatattccatttgtttatattatatatatgccatatttatttattcatatgttgatggacacttaggttgtttccaccttttggctattgtgaataatgctgttattaacattggtgtacaagaatctgtttgagttcctattttcaattcttttgggaatatacctacgtgtggacttactagatcacatggtaagcttttagtttagctttttaaggaactgctaaaactgtttttccatgggagcagtgtacaagtgttccagttctccatatgctcaccaaaacttaatttccttttttaaaaattatagctatcctagtaggtggtgggaagtggtatcttactgtggttttattttgtatttctttaatgactaatgatgttgagcatcttttaatgtgcttattggccattatatgtcttctttgggaactgtctattaagtcctttgcccattttttaattgagtttttttttctgttgaattgtgggagatctttatatattctgaatattaaacccttattgggtgtatgatttgcaaataatttctcccattttgtgggttttcttcactttttgatattgttctttgattcacttttaaatttttatagagtccagtttatctgttttttcttttattacctatgcttttggcatcatacctaattcccaaatccaatgccatgaagattttctgttatgttttcttttaatagttttatagttttactttttctattggagttttaagtaaattcttgtatattagtgtgatacattttaagttatttttgtatatggtgtgaggtaggggtccaacttcactcttttccatatggagatccagttgtcccagcaccacatgtttaagagtctattctttccccactgaatggacttggcacccttgtcaaaaatcaattggtggtaaatgtatggatttactcctggaatctcaattctattctattgtatttatatttctgtccttatgcctgtaccacactgttttgattacagtagctttgtagtaagtttagaaattgggaaacatgagtcctccaactttgttcttcttttcaagattattttggctatttggggtcccttgcaattctgatgagtttgaggatcaccttttccatttctgcagaaaagccttttgatagggattgcattgaatctgtagataactttgggtagtattgacatcttaacaatattaagtctttctatgcataaacatgggatatctttccatttatttgtgttttctttaatttctttcagcagcattctgtagttttcagagtacacgtttttcacctccttggttaaatttattccttggtattttattcttttagctgctattgtaaatgcagttactttcttagtttcctttcagattgttcatttctggtgtataacaacagctgatatttcaacgttgatgttgtactctgaaactttgttgaatttacttattagatctagtagctttctttgagatttttatatgggattatgtcatctgtatatagagatagttttacttcttcctttccattatggatgccttttatttcttttccatgtctaatttctctggctagaactttcaatatgatgttgaaaagcagtggtgaaagtgggtatctttgtcttgcttcctatcttaggtggaaagctttcagtctttcaccattaagtatggtgttagctgtgggttttcataaatgccctttatcatgttgaggaaatacccttttattcctagttttctgagtttttatcatgaaagggtgttggattttgtcaaatgccttttctgtgtcaattgaaatgatcatgtatttttcctcccttatcttaatgtaatgtgttatattgattaattttcttatgttgaaccacccttgcctttctggggtaaatttcagtcacttatgttatatagtcctttaaattgtgttatcttataacagaatcactctgctactgttttgagcataggccatagggaaaagcaggtaaaaggtaatatggcttgaaccaacattgtagcagcggaagtggtgagaggaggtcgaattttggctttgttttgaagatagaaccaacagtatttgctgacagattagatgcagaatgtgaaaggaggagatgagtcaggatgaatccaaggcttttggcatgagcaaccagaaagatgaaggtgacttactaagatgggaaatatacaaaaggagcagtttggggaaactttatatctattgagtggaatatgccaattagagattcaaatatccagtaaataattggctatcaaagtttgaagttaagaggaatggtctaggctgtttatataactttggaagtcattagtgtataacagctaatttaaaagccagcagactctaagggagtgagtgtagagggagaagagtagaggtctgtgacttgaatcctggaatgctgtgatgtttagagattggggaggtaagaaggagcagcagagtatactgaaaagggattgttatactgaaaagggattgatatagatggagactcaagaattatcacagaaacctgataaaatgtttcaagaagatgggtgtgattaattgtgtcacttactgccggtacattgactcagatgagcgttgagaattggctataggatttgacaacataaaagtcattggaaaccttgacatgagcccttttcgtggagtggagtggttacagtgggtttaagagaggattaaaggagtggaaacagagatgctattatagatgactcgtttgagtagttttcctacaaaggggagaataataatggagcagttagccaaaagttgagtttttttttcttcttcttttttttagttggaaaaaattgcgtatatgttgatgggtcttttctggcagaccagtagagaggaaaaagttgatgatgtaggagatgggaaaatgtctttgagtagatgtcttcgagaaaatgtctttgagtagatgagaggtttgcacacatggagaggttggatgtaggagtactgatagttcatccatagttacataagaaaaggtagatgtattagagttctcctgagaaacagaaccaatgggagatctttatatctctgtgtccatctctatctgtatttctgtctctgtatctatgaagagattataaaagttttaagatctgccaggagacatacccacgggagctaatggtatagttccaggccagttgtgaaggcctgagaaccaggagagcctatggtgtaagttccagtctgagtccaagtctgaaggcaggagaagaccaatgtcccagctcaaagacaggcagagggagcagatcttcccttacttagcctttttatttattcaggccttcaacaaattgaaggcccacccacattagggagggcaatctgctttactcagtctactgaatcaaatgttagtctcacccagaaacatcctcacagacacacccagaataatggttagccaaatatctgggcaccccatggcccactcaaattgacacataaaattaaccaccacagtagagtatatgggtacaaatataattatgtgatatagatttcagggtaagagcctgtggaaattcatttttgattgcttctagtgaaatcggaagcaagatcatcagctaagagtgacgatcggtggaggagatatgaagtttaagtggagaggagaaggtataaaatagtcttaggaggggaggatagtaaatagattagggaaaagttgtaggattgccaggaagtagtaagggcccacttgaggctggtggtcacaaatttaaggtgagaccagtcaaaatggttgtgcttttcacctgctgcattcattcagctgcataggtacaggcacagagtaggtcaagagttcttttttattcggggttagagttttgccaggagatagtaataaagccagaagggcaatgaatttgagggagtatgcaaggaagtggctgttaacttggagtttaaactagtcaagaagagaattaaggactgcccaaggggtgaggacaatgatatggtagcagggcccttaaaagccccagttagatgaaaagattgttggaattgagtttctagagggaatgaacttgaaaaacaggaggtgttggttggagagtgggatatatggaattgagattatggaaggattcagtcgttggtaataacatagtatctttgtaggaataaataggtggagcaggatgcagacaagatcactggaggagggctggtcagaagactgggaggcactatctcccttggatattatacatcaaagcttgtgatctactagacaagtagtggggaaagggtaggatatagatattaatggctatagttttgatggtgatggtcatggtgatgatgatggtccattaacactcaactcaaataccatcaatttgatttatatctaacaccacaaagttaggtgttgagttacatgtggttatattgtaactaatagtcagcccttcatggacttctattctttgatgagactcttcttgtaggagtagtaggtgccttaaagcaccttttcatagttgtcagattgaaatccttcaccagtgttttaggttaaccctgttactgtggaagtttctcttggctttctgtgtgggctgcttctttgtctagttttaccttttggggttagcatactattgtgaataatttattggtgagaaggtaagcagagaagtagagtactctatgacctagtaatttcatatctaggaatctatcctatagaaatgataggaatgccttacaatacccacatatccacaagggtattcattgaacgttatttttggtgaaattcgcaagcaacctaattatcatcaatagggaattgttaaattatgatagataaaatggaattctattcagtcttcaaaaagtcagatcaagaagtggtcttacattttaattatcccatcctgtcaacaagagtgtcttcagttgcaagtaatggaaaaaccattcaaactgacttcagcaataaaaggttatttattggtctgtttcatggagacatctgaggtagagtggccttcaggcaagttcactcagggatccgactatttttctggccttattcttggccctcttctatgaaaacaccttcagggtggtttcttgtatgcttgtaagatggctacttgcatcaaccatgaccacatctagcaggagcaaaagcatcctttcccgtaccagaggagagtcccgaaatttgttgcaattggactgccttggaagcaataattatggccaggagatggaggctagagaactgagacctgatcatagctcctatccttgaatcagttgtatagcaaggggaattggattttccttaagacagttggatttcacctgtagtcttggtgatgaggtcagttccatccataaaactttgctgttacacattttgggatggggtgaggagggctgaatggagattaggatgctattgaaatttgctgtacacaatggatcattatcgtcttctttcttagtgttaaggtaatcagcctctttttcctcctcctatgcttgactttactaaaaccatgagacatgtttaacctcaggactccaatttgaaaaaatatagactgttatttactttattacttacagaagcccttcatactactctcagcaagaaagaggtaggcagggagtgagggaggggggatcatgcttactgagaaacaaactatcgagtattgaaactcccccttcatatgcctgacctcagtcccattcagttaccagtaggggcccctattaattggtacctcaccagcttttgctgttcgttcataaaactgagtcattgaagtacagtagaaaaataattggactacaagataacttatttccttccataattgcaaaatatctgatttttcttcttgtttgtattatgtaaacttaccctgtctgagggtcctcctggattgttctttgcatttatatatacatagaatttcattttcttttttcttgttttttttttagacggagtctcactctgtcgcccaggctggagtgcagtggcacaatctcggctcactgcaagctccgcctcccaggttcacgccattctcctgcctcagcctccccagcagctgggactacaggtgcacgccgccacacccggctaattttttgtgtttttagtagagacggggtttcaccatgatagccaggatggtctcaatctcctgaccttgttatctgcccgccttggcttcccaaagtgctaggattacaggcgtgagccgcttgcccgaccttcttttttttttttttttttttttttgagacgttgagatagagtctcactctgttgcccaggctggagtgcaatggcacgttttcagctcactgcaacctccacctcccaggttcaagcgattctcctgcctcagcctcctgagtagctgggattacaggcgcccgccaccatgctctgctaatttttgtatttttattagagatggggttttaccatggtggtcaggctggtctcgaactcttgactacgtgatccgcctgcctcggcctcccaaagttctgggattataggcgtgagccactgtgcccggccaatttcattttctattttgaaatttaaactaccactgacacttcgttttccctctgttttacttagcatttatcttagagaataatcttaatatgtatagttctattttattcttttactggcagcttagtatgccatattttggatgtgtcattgtttatttacctattaatttaccctataactgcttcccatatttttgcttttacaaagggatgtaatgaacatcctttacatacgtctttgtgcatatgtgcaaatatttccataggatagatgtaattactgacttgaaggttatgcagatttaaaattttgatgccttctatgaaacatctttcaaaatggtgatgccagtttcttctctcgtaattactgcatatggtcaatcttttaaatttttgctggtaatgatatttcaaaattataaccagttttttggcctcatttcttgaataacttgttttttctcaaagataagaaatgtctccttcatcgtatgtcaaatttccatatttacatggatctatttctggacatggcaagttttatttatttattgtatgtatttacggtgtacaacatgatgttttgatacacatatacgtagtgaaatgattcctacagtcaaacaaattaacatgttcaccaccttccatagtctctgcagtcttcaaggttttctctatatgggattagacatgctatgtctgatctgtttttgtatttttacaccaattccacactaattttttttttttttttgactgggagtctcgttcttattgcccaggctggagtgcaatggcatgatctctgctcactgcaacctccgcctcccaggttcaagcaattctcctgcctcagcctccctagtagatgggattacagcactcgctgccacacctggctaatttttgtatttttagtagagatggggtttcaccatgttggccaggctggtctcgaactcctgacctcaggtgatctgcccgcctcggcctccgaaagtgctgggattacaggtgtgagccacctcacctggcacacactattttaattactgtagttttaaaagtttcatatttagtagggtgagtttttccttgttggtcttgtttttcaaaaaaaatttgctgctcttgagtattttctcttcccagtgaactttaatgtaaactcacgtggttcaatgaaaaattctgatgactttttttcttggtattgcttcttgagtgtattgatttaattaatatatttacagttttgggtctggctgtgccgaaacgcagtgtgtcttatccagtccttttttaactgtcttaataaaatttgctggttatctttaaaatggatcttgtatattttatgttaggtttattcccaggcaggttgtcatttttgctgttactgattttggatataaattttggatataattgtataatttggacttggatataattgtatttgattctgtcttatatataaaaatgagataggataataatttatcctaggataaaaataatttgagtatccttattttgcatctggtaccttacttgctcctgttaaacaaatagataaaattacttgtcttcaaagagatcctgtggaaaaattatttattttaggagactttggagctttgataaaaattaggcttatcttttgtaaaagctggttagtgatagcaatcagactcttttaaaggtgatttttttttctttcctttgataaaatgcttaatatgagggaggattaagaaagaggatggcttttgaacagtttcttcatggggaaataagaaattagaataatttcatgttctccaaaaaaaggagaaaaatgaccttccctcctgagcctacttcaagcctctgtttctttctgactctattgttctcatctctgcatttttccaatctcttctactgttagtgttttaggctagctcctcagtggagggcagaaattcaccttctctttagctgtctttgaaaccaagaagatagaggtatgagatcttcgtagtctgtagtaagaataatagaagccatcagaaaaaaatatcaaagctttgtagctgctcctggaagttttgatgtgaagcaggagacatcacctattggtacctgacttgcttttgctgttcattcataaaacagagtctctgaaatacagtagaaaaataattagactggaggataacttttttccttccaggaattacacaatcacaaaattgctgatttttcttcttattcatgttacataaacttatcctgtccgaaaagactgtatttgaacttactatgtaagatttgctttaggtaaatttatggctgcttccagaattgtgtattaattttccagtttcttttttaccagtctccacttttacctttccctcttccccctatacttaaattggtcttactgtaaaatttatgcgtttctctttctacctggcaatgctgattttttttttttttttttttttgaggcaaggtctcactctttcacccaggctatagtgcagtggcaagatcgtggctcactgcaacctcgaatccctgggctcaagcgatcctcccacctcagtctcccaagtagctgggactacagatgtgtgccatcgcacctggctcatttttgtattttttgtagagatagtattcgccatgttgcctaggctggactcaagccagcctcctgccttagcctcccaaagtgctgggattgctggcacgtaccactacatccagccagggctgagtttctgaatcatcattgcagcaagagaaattggattacctttagaccactggctctactgtgggctgggagtgggacaccttccttaaagcgcattggacattggctttgtgggtaactgatctttacctgaatgaaatttatcagtactgtattaagggtctagggtggaacggatgctagcaaggcaaccgttaacatccacttactgatgaatcctataaaattttatttcaggccatacgaagtaacagtaataaatataaaaggaaaaatagacaacctaagcaactttttaaattgacttacttgaaaactttccctgcaatttcccggtttataatggttgatttcagctgactggctatagctacttagagaacagaggaaattcattaaaaataatgaattattcagttgggtagtgaaatccagttataaagcacttcgctgtgccatggattcagttcaggtcaagtgatgttcctggtttatgggcagtgtggcttctcactatgacacagcaaagaacgtagcttttatcctttacccttgttactaactaaaattaatggcattttattgtgtttatttgtttgattccatttacagtttatttcacttggttttattagtacaaaattgtgctttatataatatttgacagttaggaaaaattgttagatacctataaagaaacaagtctctcaaaaatcatcctactacttttaaaaattacatcgtcttactacagttaacctagatgtgaatgggtagttttatttagcttttctggtttgtttgcttggtctgtttggagggaagttaagattagcagaaatgtagtaatagattcatgaaagtcttgaaagcttctttaattagagaatttaatgagggctttggcatgcattctttggtttttctctgttttcctctaccccttcttattctttttggttcattgaaaagtagaaagaaattctcaaaaaccgtacaggagaataccttataaatgatatcttctgcaataaactatagattgtatatatgtatatgtatctagatacacaatctgtgtgtgtgtatatatatgcttgtgtgtgtataaatgtataaattagttactagtatatacgtaagtataaaacctcaatgtgcaaggttacattttcagaaaatatgtaatataataaaagaaatcaagcccagaatttttaaaaagtttattgcgctttctgttaaaaatgaaaggctttttgactggaagctgcttctcagtaaaaataacataattgtgttggtgaagcccaaagattctaatgaaaattagggtattgacaaccaaacggaattgctggagtacttaagctgctttggttttgtaatctttctgtgtcagaatatttgaaaaacacttattaatccagtcttgtaacttatccttgaaatctcttttttaatattcttttccacacacatgaaaagttagatgagtgtatgaatttctgttgtcagactagttgtaaacctcctaaatatagtttctgcagtatagttaaagagaaagaacatcctggctaacacggtgaaaccctgtctctactaaaaaaaaaatacagaaaatgagccgggcatggtggtgggtgcctgtagtcccagctactccggaggctgaggcaggagaatggcgtgaactcaggaggcagagcttgcagtgagccgagatcacgccattgcactccagcctgggcgacagtgcgagactctgtctcaaaaaaaaaaaaaaaaaaaaaaaaaaagaaagaaaataggcccagcaaggtagctcacgcctgtaatctcagcacattgggaggctgaggtagggaggattgcttgaggccaggagttcaagaccagcctgggcaacatggtgaaactccatttctacaaaaaatacaaaaattagctgggcatggtggcatgtgcctgtagtcccagctacttgggaggctgagtgggaggattgcttaagcctggggaggttgaggctgcagtgagctgtgactgagcaacagagctagactctgtctcaaaaaaaaaaaaaaaagagatgggttttgaaattcagtactttttttgagtgaggtccaatgggtcagaaagaagcattggataaatgaatccattttctcttctctgtttgaatttgtaatttgaaagaatattctacctataaagtacttcagtgcttaattagctgtcagtgaatttatatatcttatctaattcatatggatttgctatttttatctgtacctacagattcctgacctctctaaggggatcccagtatactatagggaatgaggtataatagaagtaaaagacctatcactagtcctgtcatcattccaactcatgtgtaattatagtttaaaagaagtgacatcatgtgtattgctgtttatctttacattaatcttgtggtcaagaaagcaaatactataatatataataattatataatatcataagacaagtaatataataatgggaatataatcccattttacaaatgaggaaatgaaaatttagagaaataaagtgacttgtccagggtcacatggatactaagtgaccaagtgtcaaagcagaattttccaaataacttaaagataattcttgtacaaatatagaacgaacacatgtcatatgtgttgtgttaatgagggaaccagaaggatgacaacattggttcagagagatgcaaagataaatatagacattggaggaaaaagttggaaataagattgttaggttagatacaaagctgtgttataggccaataaaaaccatagactttgaggttatcttttttactggacaggattcagttacacctttatgagaccaaaatttattatttaacatgtggatattagagtctgagttttaaaattattagtaaatgaccgtcaaataaagatatgtcccctaatgaaatactgataatcgctgggtgagcttgtgctcctatatgacattgaaatgacatactgccctctctttgtcttctaagttttggatacttttttttttttttttttgacacaaagctgcattagaacctaggtttcttgattttcagtccagatttctttccactctacttcctgcttcttcatagtataattttcaacactagagcagtctgcataacttttgcaaaatcagctagtctttcttattagttttcctttgtgcaaagtgatgtagatacagctttcttcttcagagaaacattgtgaaattcaatgaatatttgtaaaatttgcatacgtgcccaatgtgagaaattgaaattattacttaagtattgcaactgttcttttaggatattttgtttgcaaatttcagagtaattataaatattcttgcatttttattgtaatcagtatttataaaacagtgtatttcatcacattaacctttacatattttgaataaaatagtattgaaccattttaaatagtaagtggaaatttttccacattaaacagtataacgggctaacagagttaagcattgcattatttaactaataattttttcctgaacttcagattattatctgtatgtgtcatataacttgacaattttttttttttagtgctttttaaaaagagtgggatactttattcagtttagccctcaagcaattaggcaagtcagttaccatggtaacagtaggtattaatttccttacctagttagaggttttatgaacaaagaaatctctgagttcatccaccaaaacccaactttctcttgagactggcctcttgagactggtgttaaatttgtctattttctagaagatgacactattctaagtggaaaatacggttctcttgaggtgaatttctactctatcaagagtgaagtagagtatggcttaaaagttaagtgattaaaaagctaccctttcttagctaatttggaatgtaattggtcttaatttttctaaattcgttctaaccaaaatcttattggcgtgatttctattgacatgaactagaagtgacttcagcagacaacttgtcccaatatctaaatgctgtcaaatagaatcacttaagatgaatttcttccaaaacagagttcacaattttgacagataatctcttagcatttaattgactagtattaccaaccttatggaataggtccactcgtttagctatcatgaggaccattttgcaactaacttatcaaaaagccttcaccaagaagttgcatatcttattgatattttagaatgcgattatggagattaaaaatcaccacaatgggttgttaataacgccagccttgaactttcagttttagagcattttatctgtgttctgtagtcaaagttggtaaggtgtccagtgggtcatgtttgacttgctgcttgtttttgtactgtgtgctaaatggtttctacatttttcagtggttgaaaagtcaaaagaagaataatattttatgaaatttaaataaatccaggtttcagtgtctataggtaaaatttcattgtaacgttgttatgcttaagtattgtttatgacttctttgctatagtgacaaacttgagtagttttgacaaagatcatctggcctgtaaggcctagaatagttactgtctaaccctttagagaaaaaaattgctggcccttgttctatagtatgaaaaaatatagccttgattattcattaaaaaattattttcccattttattgacatacttttgtcccctgattgttaaaaggaatgcatgttcttatagaaaagttggaatatatagaaaagtataaagaacaatatgaaaaaccatttgcaattgtgagataaccactaatgttttggtatacattgctccagacttacacacaaacacacacgcgtatttattttatacaattagagtctaattttttttttgagacagtcttgctctgttgcccagggtggagtgcagtggcaagatttcagctcactgcaacctctgcctcctgggctcaagtgattcttgtgcctcagcctcttgagtaactgggattacaggcgtgcaccaccatgtccagctaatttttgtatttttagtagagacggggtttcgccatatgcccaggctggtctcgaacccctggcctcaaatcatcggcctgccttggcctcccaaagtactgggattacacacgtgagccactgcgccttaattttttaatttgcttttttcacttgaataattataagaacattatttttaatgactgtgtagtgttctgttttatggatgtaccatacttaattatttagtcataatttattattatgaggttgataaacatgataatcagattgagctcaagaagctagttatagggttgcacaattaatgaatcccaggtacctcgctgggttgctgaggctgctatttttttcctgcctgtttggaacactgtgtttgggaccaatgaggcaaaagaaattgaagagctgccattttcaattattctattagaagatacattgaagatttgtcaaatgacatagacacaacactaatccagaagattatttaatcaaaaaggcattcatttcagatatgaattcataaacatttgtaacgatcctcagtttgaagaccatatagaatccctgaagaactggaagacactatttgcttggcaaagagaagtccccagaccaactggggatgaaatattcaaagagataaatgaatactttgaaacatacaaggtactatggaaaaagagtggaagtttgggacaggtaatgacaggaagatataaaagctttacattaagttcaatctaaaactttattccaagtaacaggttgtcttattcatggagaagcagttgtaaattaaaacttgcctgtggtttggaatttcacattaaatgattacattaaaaattcaaatggtgaacctaactaaatccaagctcctacagtaccttcttttcacctttaggtgaagaaatgcggtgagctattttattactgattatgtggacagtccaaaggaaggttcataagcgaaaaggaaaaatttaaattattccatgtgagcgattcttactttgcagatttgttgaagtgtagttactggcttcaaaaagtggtatccttaactgacattttgaacacttgaattcactcaataaaaaaatgcagtgatcatgtggaaaatacattaaggtatatgacagagtttatggattcagagcaaaaattcagctttggaaaagtgaagttaaaatggttttttaagtgatgtttaattggtgttatttgaatcctaaagaagaattaatagtactagtagaggaaagtcagtgtgtctgtgacaaagctttagtattattttgaaatacttgatataaaaaagttcacgtttactcaaagcttacttaaatcatcagaataaattaacatgtttcttaattaaagaaaaggagaagctattagacttaaaaaatttttgcacccttgaaatacatacaatttgaagagattaagttgttggaatactggttaatggtgaaaaaggagttttcagtctatgaaagcaaagccttctcctttgccatttgcttttttgtagtggttgctatgtagaattcgaagaaaatattgttaaaaagtcttggtcaggagtagagtgtagcatgaacccaatgcattttaacgttaataatgaggaaaaagggaatgcatgataatttcatcaagtcagaaaaaaatggaaaaagaaaaagaggaaactgaagaaagtaactgatgaaagtaaggtgaaagggaaaacaactttttataccacctgtgaatgagattaattttcgtttccatactgaaagacaaatatattccaattaagccattcaaaataaaaaacaatttttttttggtaagagatgggatctcactatgttgaccaagttagtcttgaactcctgccctcaatcagtcctcctgcttcagcctcccaaagtgctaggatttcaggcatgagccactgtgcctggccaaaaccaaaattaagcaacaaaacaacaacaacaaaaattccagacagcctttaaaataatgataaaggttgaaaaattgtagatagtggtaggtagataagatttcaggaaaagtccaaagcaaatcataatacgttattttaaaggggggtttaaaatcctttaaaggtacaatgtgaagcattatgaaatgataaaatacatgttttttaaaaacattaattttattttaagttccaggatacatgtgcaggacgtgcaggtttgctacataggtaaatgtgtgccatggtggtttgctgcacctatcaatctgtcacctacatattaagccccgcatacattagctgtttttcctgatgctgtccctcctccaggacccagtgtgtgttgttccccatgtattctcatcgttcggctcccacttataagtgagaacatgtggtatttggttttctgttcctttgttagtttgctgaggataatggattccagttccatccatgtccctgcaaagtacatgatcgtgttcctttttatggctgcatagtattccattttatatgtaccacattttctttatctagtctatcattgatgggcatttggtttttttccatgtctttgctattgtgaatagtgctgcagtgaacatgaacatgtgtgtgcttgtatctttataataaaatgatttatattcctttgggtatatacccagtaatataattgtataacccagtaataggattgcagtgtcaaatggtatttctggttctaggtctttgaggaatcgccacactgtcttccacaatggttgaactagtttacattcccaccaacagtgtaaaagcattcctatttctccatagccttgccagcacctgttgtttcttgattttttaataaacgccattctgactggcatgagagggtatatcattgtggttttgatttgtatacaaaaaagatttgtatttctctactgatcagtgatgttgagctttttttcatgtttgatggttgcataaatgtctttttttgagaagtgtctgttcatgtcctctgcctactttttaatgggattgtttgttttttttttcttgtaaatttgtttgagttccttgtagattctggatatagacctttgtcagctggatagattgcaaaaattttctcccattctgtaggttgtctgttcactctgatttgctgtgcagaagctaaaagacatgattttagaaaaagacatgtcaaagtcatacatgctcaacgacatagcgagtacatatgtaaataaaaaattattttatgctgtgaatttgaccgaaaataacctttacctcgtcaggaattacaatcctcacgtatggtaaaggatttccctattgcaaattattccacaacattaatgttctgtgtgctttttatctatcccaagatacaagtaaatttgacaaagatattaggtttgtaaacaaatttacgttcaaatctttgcctggaagtatctagatagaattttgcatgcaaaagagtatttacatctaaaaaattacatatttcaaattaaaatgattttagtgttatagatagaaggaaagagttattgaagtttatttctgttttggcagtgtaaatgaattacttacaaaattttagaagtctacaggtgtttttataaagtttgtgttatttgtggaaacctcagttttctggcattttgccaatgaggtctactctaagtatagcagaaatttgttttccagctttataaatatatattttaagattaagaactgattttacttatataatctgggatcaacttttggcttctcctgtcaaggattttgaatttgtgacaaaatatacacttattgataaccagtgacatatataaaatgctttacaattaataaagcatatgtattttacatattttttcactacatatgacgcatgtggcaaccccaagagttgagttgtacccatcggcaaactttgatcatgattctgtgaatataggcaagcaccaattgcaggtagaacattctttttttgagtcccaaaccgtgagaaacaaattacagaaatgtacctttcttttgcattaggacacgttgtagttttgtatgaacactctagttttaagcagtatgtgcaaaaacattgcacaaaggatttgtgtgttgattttgggactcctgtattattaattatgtggtttatttgactaccccacattttcaagcataaattaataaatccataattccaggcttattaacaataaacaatctagatagttgaactctttcttgctaacattttctagatatggactgtttggtatttttctactaataaagacccttagtaagctgccttctggtttgatgtcattgggatgtttactgggaactttggtggagatcttgcagtctctctcccccagtggtgaaagaatgagttacaaaccagctttccttcccagtgtacaatagcgatggagtttgttctatatggaaaatttgtttgataaaagtattctttaaaattttttgttccataaattatcagtattttcagtttctgattcatgcttgggatagttgctgcatattgtttaattttgtcagaatttatattgttaaatatcaaatacgacagactaccctcaaatcataagtagttaatgtaattaacatcctgtttcatcatgagactcttcagtgttacattaaaaactgctacctcctgggccgggcgtggtggctcatgcctgtaatcccagcactttgggaggctgaggtgggcgatcggatcacgaggtcaggagattgagaccatcctggctaacatggtgaaaccccgtcgctactaaaacatgcaaaaaattagccgggcttggtggcgggcgcctgtagtcccagctactcaggaggctgaggcaggagaatggcatgaacccaggaggcagatcttgcagagagctgagatcgtgccactgcactccagcctgggcgacacagcaagactccgtctcaaaacaaaaaacaaaaaacaaaaaaactgctacctccttattacaaataggaactaaagttgaagtttgaggaatttgctaagaactaagccttgaactaaggctattttatttgagtatgagtcatatcagggtacggatccattttactattaacaaaacaaatatgttctgttttttttttttaaatgcacacaccacgtttgagagattcttattcactgtattttctttaattatacttgaattttggtttacattgaggagtgccctcaaagatattaacagatttttaaaaaatcctctaaaaaactcattcttagggaaatttgttcacttactaggtgaggagcaaaataaaaatccttaatatagaagagctattatctgtcttcaaaattaagtctttgagtagatttgtgaataaatctaatagttttgctgaatttacttagatcttaagacagaataatcatgtagaaaatttaaaatgtcaggaattcataatgattcatatacccaaggattttcattgatagtgaggtaaggttattcttgagaaagactcaaagtcataaaataatagaatttcgaaactaccagaattatacaagtcaattaaaatgactgatttgttttaagaggaagaaatactaaatgtataattattagatgcagcatattgtatctgttttgttttgtgattctagctcttataacctatgcttggacctaggtgtcataacttactttaaatatgtatgtttggttttcattcatattgacagtactacctctcagttttctttcagatattgttttgtatttacccatgaagacattgttttttggactctgcaaataggacatttcaaagatgagtgaaaaaaaattggaaacaactgcacagcagcggaaatgtcctgaatggatgaatgtgcagaataaaagatgtgctgtagaagaaagaaaggtatgttgttcattgactattcttttgggtgagaaatttaatttatatttgactgtgcaaagagtcagttgttacttgtaaacttcaagtcattgtttaggtcagagttgctgttgtctaaatgcaccaggacctagttgttgaaagggtaaactggaataaactttaattgggtttacaaaatgagaattcttactgtatattttctctttttcgggttgactttaccagtttgttctagttcagataatttagacaacattaactttgttgaattttttgtttgccagccggtcttcagcattttaaggcaacattattattacagttgtaatacgaatataattaccagagaaaaaactcaggaaaataaatgcttttatgaaaatgggattagaggtttgaaaataaacttgttaggagaaataatttcacaatgggatggttttttctttgttaagttttctttatgacttcattagtttataaaacattaattgataaaacttagaactataaattgaatgcttcagtgaactttattatttcagtgaacatttgttatttgatgtgaactttgtgcctgttttgaaatttactaaactcaaggcatgtgttcggaagagtgtttttgaagatgacctccccttcttagaattcactggatccattgtgtatagttacgatgctagtgattgctctttcctgtcagaagatattaggtaagtgatttgaatttcctgattttatttgaatttggacccttagaaggtactattatggtaatgtttgtgaatatactgagttttacaggtgaggtgtgttcaatagataattatttctatgtatacactatcaccaagttttacatttcaaataaaagtcactgaattaatttgtaatctgtcagtttgttcattcataagcttttctattacttcagacagtttttttttaacttttttaatatatgtgctgctgaagcgagcacgacagttttttaactttcagtacttaagatgttatatatagagctactgaacatactgtgtttattttaccaatttagggaaaaagtgcaaaaattatttaacctttaaatgcacctttatatttcattaaaaatatcaacatagtaatattgaataatggctatgatcggctctgttgtgtgtaattagtaacagttgtagcaaatgatccttaaaaaatgttctaactaaacattagaggccaggcgcggtggctcaggcctgtaatcccagcactttgtgaggccgaggcaggtggatcacaaggtcaggagattgagaccatcccggctaacatggtgaaacaccgtctctactaaaaatacaaaaaattagccaggtgtggtggcgtgcgcctgtagtctcagctactcaggaggctgaagcaggagaatcgcttgaacctgggaggcagaggttgcggtgagccaagattgcatcactgcactccagcctgggcgacagagtgaggctccgtctcaaaaaaaaaaaatccaaaaaaacaaccccacaaacaaacaaaaaacattagaaatgtctgttagtacttttaaaggttgccttgtaaaattaggactgcaatagtgcaatctaaggctctcaaagcataaaacaagtaataaggaattcattcagatattttccgaggtggttatacctgtcttttaaaaaaaaaattttgttatatattgggttaaaaaaagcagaggtgctgggcacagtggctcatgcctataacccctacactttgggaggccaaggcaggaggattgcttgagcccaggagtttgagaccagccatagtaagacccccatctctacaaaaaaatttaaaaattagccaggtgtctgtggtcccagctactcaggaggcctaggttttgggcccgagaggttgaggctgcagtgagccttgatcacaccattgcactccagcctgggcaacagggcaaaaccctgtctcaaacagacaaacaaacaaacaaaaggcagaggtaggttaagctatttattaatggtcttctactggtatagatataagctagaaataacattcaagtgtttttacttttactacagttatctggccactttgggactcattatactgaattagtttcacagaggaggtaaaatctgttgtttatgattacatattaactctaccattttaccttcagcattgctgtagtatgtcatatctgaaggcaattagcacaagtgacttgaagaattgtagttttgatgacttatatgtattttataaaaggcaggcagagtttttgtgtttgctttcccctcctctggacactttaaatttttgctaccacaggtttccaacaatttgattatgatgtgcccttgtgtaatgtggttggtgtttatttggcttggagttcgttgaatttttttgatctgtgtgggcttatacctttaatcaaatttgaaaaatgtcttcagatcctttttcctcccatcctgttattcttttctctttctgggactcttagtacacacaagtttgattgcttgatactgtgtcacaggccactgaggctctttcctttcagtcttttcttctttcttcctttttttctttctgtgcttcattttgaatagcttgaatagttttgtttcctgtcttcaagttcacttatatttttttcttctgtagtgtctggtctgtttataccatcctgtgaatttcttttttagatactacatattttgtttatctctagaagtcccatttggttcttaatttttttttccattttggctctcattattcatgtttctttcaaaattcttgaacatatttagcatatttttaatagctgttttaatgtacttgtctgttaattccattattctagggtttttttctttctattggatgatttttctcctgattatgggttatattttcctgtttattcctacagctgttaatttttttttttttaattaggcattgtgatcttactttgtggaatgttagattttattgttttcctttaaagaaaggaactttgtcagacatctaagttacctgaagatcaactttatgttttgaagcttgttttcaagcttgatcagggaaagtctacgtttgcctttagtctaaaggtaatttagccctataataagatgtgacccttctggagtctttgtagactgcctctggtgatcaacgatctcttctctgacttttcagaacgttaatgcctcttacctttgtgtaagtccgtcctaagaatcattcagcttatggttgtttgcccagccccatagagttttagtctatgcatgcttgtcttcgtattctgcaaagaccaaaggagtcccttagggagatttctggagctcttttcctgcctagcttcctcctctccagaactctgccccgtgagttccaggtccttcagcttccagggctctgaactctgtctccccaactcagtgctctccttgggattcttctccctgttctgttgtctgcaatgggtcccaggaagaatgtggggcaactgtaaggttcacccttcatttcccttcccttagagatcatagtcctgtactgcctgttgtctagtatctgaaacagttgttttatatgttttgtccaagtttagatttgtttgtggtgggagggtgagtctggcctcccttgttatatcatgttggcctgaagcagaagctgagtttcttttattttttaaatatagtttcaatttttaacaactattaaataggcaagtatcaacaacaatagataacaatataatagatatgcatattcctcccactttatcaaatcttaattttcttcaatttttttttttttttttaatagggtctcactctgttgctcgtgctggagtgacagtggtgtgatcttggttcgctgcaacctccgcctcttgggctcaagtgatcctcctgcctcagcctcctgagtagctgggactacaggcatgcaccatcatgcccagataatttatatatatatttttttatagagatggggtttttgccatgttgcccaggcggtctcaaattcctggactcaagcaatctgcctgccttggccccccaaagtgctgggattacaggcgtgaaccactgcgcctggcctgttttcttcagttctttattaagaaatgaaacagtaaaatacagctgaagccccgtgtttgttctttctgattctccctctgtgcccctctgagataacttctatgagttttgtgcatttttttttctttttaataaaaacagggtcttgctctgttatccaggctggagtgcggtggcgagatcatactcaatgcagcctcaaccttatgggctcgagtgatcctttcgcctcagcctctcaagtagctacaactactggtgtgtgctgccatgcctggctaattttttatttatagtttttaaagacagggtctcactatgttgcccaggctagttttgaactcctggcttctagtgatcctcctgccttggtctcttacttaaagcactgggattacaggtgtgagccactggctgctcacatgttttttataatagtacttaataattttatgtctgaaaatattatataatgttattttgcccatttaaaaactttaaaaaatgctaacaaactgtgtactctgtaacttgtcttttttactcaacactacgtttttgagaatttttcttgttgatctgtgtagttccattttaactgttatatcttactatgtttcattatgcaacagttggttcaatccattctcttgttaatggaaatttagtttgtttctaatttttgccagtaggaacagtgttgcaatgcatattcttaaacatgtctgtacacatctgagggtttcatttatttgtgacaaaacttgccaggtcatagtgtttatgcaccttcaactagatattgtcgttgtcaaagtttttttccaaaaggattttaccaatttatacatgaaccaccgatagatatcctcttaacacgtggtattctgaaacttaatttttaccaatcagatagatgtgaaatcacgtagacttagtttgcatttctttgacttctagtgagaagtagtgtcttcacatattttttggatttttaaaatttattttttatttttgtttttcttagagacagggtcttgaacttttacccaggctgaagtgcagtgatgcgatcatagctcacgctaacctcgaactcctggactcaagtgatcctcctgcctcagcttcctgagtagctgggactacaggtgtgtgccaccaagcccagctaatttttaatttttttttttgtagagacatgctgtgttgcacaggttggtcttaaactcctagtctcaagcagtcctcctgccttgactttccaaagtgctgggattacaggggtaaaccaccatacctggccatatcttttggatttattggtcatttggattttcttttgggaattacctgttcatatttttctccatttttctgctgaataatttgtcttttcttacttatttttcaagaaattttacatattttctggctgttcattgtcagttgtatgtgctccagataacttgaacagtctgtggttgccttttaatttttgaattatgtctttagttatgcagaagtttaaaattttaacataaattaatttacactatttttctcactttagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcaggttggtatctctacatttcatttttatatggctgataattgtaatatgtcaactttatccctataaaattaagttcttttattagctggccgttctctcattatctcaaatttatttaagtatttatgttctacctgattcactcacattccttgttttatttaattttcacaacatacctgtgaggcattgacattttttctgttttagagaagagaaaactgaaattttaagaggctaaatgaccaggatatgtactgctattgctagcaggagtggcattcaaactgattattttttcttgtcatttatcaatcaggactgtttgctttagttaagaaatactcaaggtcaatgtgtttctgaatttaaaattactgttaaatacaaatttacacataaacatggtatgtataagaagtaggacataaatccatcatacttgacagaacttatggaaataacaagaaaatgttacagtttttccccagggattaaaaatgttgcttgaaaataaagcagttaaaaaggcaggtgtaggaattgaaggagatcagtggaaacttctacgtgactttgatatcaaattgaagaattttgtggagttgacagatgttgccaataaaaaggtaaaagcaatatatatataattttcatgatgaagattattttgtgttacacagaatgtactttctatctgaatgttagatttttttttgaaaaagcttgttatataatgtttttgtagcaataaaaaagttccaagtgaatgttctttaatgaaaacctttatttatttatttatttttaacttttgtttcaagatcggggtacatgtgcatgtttgttacacaggtaaacttgtgtcatgggggtttatcatacagattattttatcacccgggtattaagcctggtacccattagttatttttcctgattttcttcctccctcctcccaccctccacctcccacagtgtgtgttgttcccctctgtgtgtccatgttttcttatcatttagctcccacttataagtgagaacatatggtatttggttttctgttcctgcgttagtttgctaaggataatggcctccagtgccatccatgtccctgcaaaggacatgatcttatttattttttttatggctgcatagtattccatggtgtatatgtaccacattttttttaatgcagtctatcattgatgggcatttaggctgattccatgtctttgctattgttaaatagtgctgcagtgaacatatgcgtgcatgtgtctttgtaacagaatgatttatattccttttggtatatacccagtaatgggattgctggggcaaatggtatttctttctttaggtctttgaggaattgctacacagttttccacaatggaaagcctttagttctaatccatgtcttggcatagagtttcttttctttttttttttttttttgaggtggagtttcgctcttgttgcccaggctggagtggaatggtgtgatctcagctcactgcaacctccacctcctgggtttaagtggttctcctgcctcaggctcctgagtagctggggttacaggcatgcaccaccatgcctagctaattttgtatttttagtagagacggggtttctccatcttggtcaggctgatctcgaactcctgacctcagataatctgcctgcctcggcctcccaaagtgctgagattgcaggcgtgagccaccgcacctggccggcagacagtttctttttttctttttgagacagagtcttgctctgtcgcccaggctggagtgcagtggtgcaatcttggctcactgaaacctctgcctcctgggttcaagcgattctcctgcctcagcctcccgagtagctggcactacaggcgtgccaccacacccagctaattttttgtattttttttagtagagacgaggtttcaccgtgttagccaggatggtcttgatctcctgacctcatgatccacctgcctcggtctcccaaagtgctgggattacatacagtttctttaagcaagccttctcttttccttcctcccagttcttggtactctttcactttcatatatttgcaaatgtaaaattgtgttttaggtgtatatttttaatccatgtataccagtaacttaaaaaaaaatttttttttttttaagggagagcataatggagctcttgtgatacggtgctcttagtggaagtttggctatcaattccatcacctgtatttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtatgtagtgaaatctgggcttatctttatatatagcactattgtgtgttttttaagaaatgtattttattccacagtgaatttgttttctcctaactcatgctttcatttgtagatgaatattttattgtttctcctttgcatctatcaaaggaatggaaactcctttgaattgtaaccagcaaacaattcacttttgttagggaaattggatgataattttcctttaaaagataccgccaaacttgagactaacattctcagctgatttaagtaggatttctcttactagattgcattttgttagattccattttaagttattttatttggatattgtgtgtaatattgagtgtgaaaaagtgaaaacaaacttttaaggctcaggcacctttctcaattttcacaattggtatgattattaaatgaggacatattgatatttgtgtcacataataggttgaattccatgtttgggtgctttgtgaatcattctcttcgatttttctgaagatgggacttactgttttatttcggtgatctttagcatactttttaaatttttctgtttttttataggctggttttattatttaccgaaatttagagattttggatgatactgtgcaaaggtttgctataaataaaggtatgttaagatccataaataaaatgtgaattcactcttttgtgaggtttatctccaaaaaaggcaatattcacatatttgcaaagcatttagtactataacttcttgaatgtctgagcagtcctgacattagggtgggatccatcagggcccaagatgagtgtttcatctttgttacttgtggcaaagcagcccttacttcttttactttgtagcattgctatgtatttggcttctagagttggggctttgtggctttcttattgcagtgacacaaccagctttctcctagtctggagattatacatccttgctataagtatttaaaatgctttctatataatgctttaaaacatgtaagatggcttatccccaagatggtagctaataaacactaagtgataaagtaggtaaagatctatttattcatttattaaatattgttggtcattttacagtgctttctaacatactgatttacatttctaattttcttctgtcatttttctccaaaaataatggtcatgtcatccaacctcagtgctgtttttagaggtcttgataagccagtgagagcagaaggagccacgtagtagagtgggtgagcccaggctttttgttgcacagaccaatgtgaatcccagccatgtgacctgggatgtacctgtttctccaaacatggaatgtagatactagcataatgtccgttttaccgttttatagaataattgtgaagacttaaagggacaaactattcgaagcatctgtattgatataaagttatcactattctcgtagcttccttttggagattttaaatgattgtgtttgttaagatgttaattaaattaggccattttgctaaatgctcttaaaaatatggcatgactgcctcatataaaatgatatgatattctttataattgtcgttgagcctctgtgggtggcaggccctcctttatatgttaaggtagaagagtctttattcttacttctcctccctggagagccacttcctatgaatgcctgctggttctctgtagtcagaggtcttgtggctgtaacttagagtcagtctccatatccctgggttctgcatctgtggattcaaccaaccacagattgagaacattcaagccaaaaaaaaaaattcacagttttaaaaaaggaaaagttgaatttcttgcatggagtaccacattgaatctatatgaatgaagtgatgcgtaggcattttataaggtattataagaaatccggagatgatttaaagtatacaggacaatgtgtatagattatatgcaaatattgcagcattttatataagagacttgatcatctatggatttgatatcagtgggagggaggttcctggaaccaatccctcaaggatacagaggaatgactgtatgttaattaactgaggcaggtgatcggttttttaagctgattagggaaacagtatataagaacttacttaactcataataaaactaaaattcaacaggggagagttatgattttttggctttatggttgtggaattgcatgtaggttacatgtacaattttgttacatgtgcaattttgatgaaaatgcttccaaggaatgtttatgatatttttcactaaagtaacatatattaataacacagtactggaagtcctggtatctgtgtacttgtcattgtaatgctacattatttgaccttcactttttttcccctttattacattatatgtgtgagtatattgtgacatcttgactcagattccagtgaattgtattaggttggtgcaaaaataattgtggttttggtaatttttaatggcaaaaaccacaattacttttgcaccaacctaataactaagattaccatctttttttccttccttcctcccttccttcctttctgttattcagccagaagtatcagcatcactgttctcttattttcttcatgtacatatggatgatattttcgaatgaccacttttctcttttgctttttattattagactgtttttttcttcttgttaaaggataaaaagattagaacataaaaggatatttacacattgtttccccattgacttattcccaagatggtagctaaaaacaccaaatgatatagtagttaaagatacattgactcatttattaaatattgttgagcattttacgatatgggaataccgtagtgaacaagccaggcatactctgtttcctgaggggcctacagttttattggggatatagatgagtgaagaaagcaattgcagtgtagggagatgagtcttatgtcatgggaaaacaaggtgctgtagttgacacaccgagaggcatctgacacattgggggaaatattctagaatatttcctggagaaagtgcaggtaaaagccagacctgaaacctgagcaagagttagctaaggccaggtgcagtggctcacgcctgtaatcctagcactttgggaggccgaggtgggtggatcacctgaggtcaggagtttgagaccagcctggccaaaatggtgaaacaccatctctactaaaaatacaaaaaattagctgagtgtggtgacgggcacctgtaatcccagcttcttgggaggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagatgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcagcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagtgcagtggcgcgatctctgctcactgcaagctccgcctcccaggttcacactattctcctgcctcagcctccggagtagctgggactacgggtgcccgccaccatgcccggctaatttttttttttttttgtatttttagtagagacggggtttcaccatgttagccaggttggtctcgatctcctgacctcgtgatccacccgcctcggcctcccaaagtgctgggattacaggtgtgagccaccgcgcccggcccaagagtaaccttttcaaaagcagctttgctctactgatttgggtaaaagcttagttgcagttggtttgggaggaaatgggagcagaaaatttgagagagtgagtgtagacaactctttcaaggaatttcgctataaatgggagtagagatctgaagactgaataattagcaaactgaaaagtgggaagacgtaattctcttattatttcatttttcttagtgaaataagaggtgaagttctctgagtaataggagggtcaaacaggtgttagaagttcacaaagaaaggaagaggtttgaaatagtcattttgagagtgggaaatgtagaagaattaacagtcattgctgagggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaaggctcagtgggcagtgggagtagggatgttgataggtaaggaaaaggtgataggatcaatgcatttggttctgcaagtgtcaaagtattgttggggaaagcatgctggaaggaaagatagggatgctggtgttctcagggtggaaggcttacagttgtagtctggaagtggtgattttattggcaattataaggtcaacggtatgactatggaattgagtggctaaggtctgttgaagaaaagattgtcggaaatgcaggggtcaaggaactggcctgtggatgttgaactcactggcagtgatcaaggaatagtagtggagtgaaagtagttaatgaatcaggcactaagatctccaagggatgaaaggatgcagtttggagatgacaagataactgtagtaatcaggaatagcaggttttgtagctctgtctcataggcctcagaggagatgggcttttgaaggacaagagaaatgatgatgaataaattctaagcaggggaagtgtttgggaaagcagggcaggctttgtgctgttgatggcaaatgatgtaccagacaggatgaagttgagaatttggaagttgatcactgattagaaaggcttacattttattttggccgggggtggcagctcatgcctgtaatcccagcactttgggaggccaaggtgggcggatcccttaggccagaagttggagaccagcctggccaccattgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggtgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttctgcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatcacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgaccaaaagcaatgtcatatttagtagcctcatttctgttactatctgattattacttaagaattctacttaattaatagattattagaacaaaaggcattccaattttagagattcttttatggttaaagcactaggtaacttaaaaaatttggatcaaatgttatacagattaatagaccttggaatacaggggctatgtctttttggaatcagaccttgtcctggccttaattgcaggatgacttccttattaaatctctaaaagcaggaatgctctggaacaatgaacaattagaatgtggtaatgtaattttgggccaaaaaatactttgtagaaatgtgattctcttacttggaatagaaagaattctgactcgaaaaagtgcagttaatgtatgcttttctgggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagtgcagtgacatgatctcaggtcactgcaagctccgcctcccgggttcacaccattatcctgcctcagcctcccgagtagctgggactaccggcgcccgccaccccacctggctaattttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacatttttccctccatgaaattagagcagccaccttttacatgacttttacatgcatttcagatttttgtactagcaattaaaatatctactggatgtaaatcacatgtgcttaatgctttgcttcataatatctgttgaagtcaattaaaatatagagacagatctttaaattgaacatgttttatttgggaagcaagaattaaatttgaggcatatacacagactgggtgtccttggtatctctgaagaacaaagagaagtttggaggttatagaaaaaggaaaatgtgacattgtttttccagaaagttctttggcactagtaaattttggggagttggaagctctgatgggttagtgactgtggtgggtaaaactagtcttagagtcacaacaggttgtttcagtatctattagataaaacaggttttaggttacaataggcagtttcagcagctaggcttgcagaaaattacattcttagagtaatgttatgtgccttgagtgcttttttccccttggcccttgactctgatttagttgggtatgacaagaattatcaatttatataattactttttacatattgaagctgaataggttttcttaaaacttggaaatgggaaatactgggtcttgtgaagttttagtgtgaaaacgataactagtctcttatttcatgctctttgtaacaagtctacagtaatacctaatgtatctagatgacacctcagaaccaggagggaacaaaaaagacctctgagcagtcaaaataatgctataagcatgtattccagcttactttcggcatttctgtggagtgcaggaggccacattttgttcatagatccagtttgacaagcttgggtactgagttaaagtgaaaatggtgtaaataagtaatcatattcacatgacagtaggtggaagtgacagctgacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagccgttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagataacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaaaacatgtccctgcctatcatactcccttcactttcactgatttctgcttttatgaagtactttaataagctctacaacaaataaacaagacattgtgcctcattttacactctagcagtggttttccattccaactaactagattgggtttataatatagtcatttaaacttacttagttaaaatgttatacattagcaactgcaattaaggagctaagaaattcagctcgtatttatttatatgcatcttatccatagtttctcacttgttatatttgcctactgatggcaaattgattttttctgttccaaaaatgtagtgttttgagatttttggagatgcaaaacagcatcattttcaaattagatcacaaacaatcttacttgttgcagttgagactagtaattgatcagtgaggtgaaaaaattaggcaaaacggtatcatcaaaattttctttctttttttttttgaaacagagtattgctcttgtcgcccaggctggagtgcaatggcacgatctcagctcagctcactggggcccctacctacgggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctctttggagttctgcatagtgtttcttgtttaaaccacacctataatgtaccatctacaatttccaattctttaagacagagtgaaaaattaagacacctgaagcaatctgagtgcggagtcctaggcattatgattttccttgacacttttagggttcttttatcacagtttatcaaacacctttttttttttaacaaaaaacaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcagcttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaacaaatgtgcctgtctttcaataaaactttatctacaaatacagatagtgggccacatttggcttgcgagctgtagtttgctgttcctgacttagtatgatatgcagcattgtgtagtggaaagattttatagtatcaacagacatttgtaggagtttgctattttataatttcgtatgcttttttcataatagatgtctctgctttttgtggattctcttcatatctactagtgtttactcttctgactttgatttttgggggtgtattttatttctttatacagaatttttttcttttttctttctttttttgagacaaggttttgctgtgtcaccccagctggagtgcagtggtgggatcttggccccctgcggtcttcaactcctgggcttaagcgatcctgtcacctcagcctccctagtagctgggaccacaggcctgcaccactacactcagctaatttttgtattttttgtagagatggggtttcgctctgttgcccagactggtctccaactcctggactcaagtgatccacctgccttggcctcccaaagtgttggaattataggtgtgagtcactgtgcctggcccagaatttctttacttgctcatgtgagagagtttctaataaactcctgatgcttttgcttgacactatagttttactgtcatctcagagtcagattttttccttaatttcttcattaaattgatttcttaatttctcatttgttttgcattagtttacaaaattacttaagatgcctatattctctgaaattttatattttatttcacgataaataagtttaaaaaattagatttgaccatttaattagagttatttccccatcatttttctaatggcaacaataattttagcatttgagcaattctctgtattttggtaactattagtaatcacttttatcagtataaacatgcatttcattttaaaatggttttcaaaatattctcataccaaccattcataaaagatgttccccttctgggaaatatcagtttttgctaacatctgcatttccctttgattttctaggaatttcttattaggtatacactttaagtgatatgtttcatataatattataggattatcaggatttcatgattttttttttttgagatggaatctatctctgtcgcccaagctggagtgccgtggcgcagtcttggctcactacaacctctgcctccccggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccatttttttattgggtactaattattagtattgctttctttattcgttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcaatagactgaataaataacatctctgacattatttttcaattatatagagaatgctttttgtaaaatactgatttatttaaagatattacaatcatagtagttttttgcaatcttttttaaatcagtggatgtcaaggaacaactattgttctttgtacggcatttttcaacattgtgaagagttcttatactcaaaaagtttgggagacacagtgtgacattgtttaacctgagttgaacttgtcattttgtattcttgtttagagcagggattttattttgtctctttatctaactttgtattcctaactatttctttctttctctttggttctttgtttctttgttcattcttctctctctcccttttttatctatcatataaatatgtaaatatatattatatatccattagggaagaggaagttgtctaaagatatctagtatataggagctttgttctgcagaaaagaggatatgaagtcaattatattggaaattaatgcttaatactttttttaaagcatttatctcccaatgataatgaaaacgatacgtcctatgtaattgagagtgatgaagatttagaaatggagatgcttaaggtatgtttacaattataaaaatattacttcaagttctttccaaaggacatttaattaagtaaaatattaactaattctaaactaggttctaccacaatgaaattgctactaattatgtaacattagatttcacattttccaattcatgtttctttcatgtagtctataaataatgggttagaggtaatttactaattttaaatgtgctttccttgttccttcttattttttattttgaagacagggtctcactctatcacccaggctggagtgcagttgctccatctcggctcactgcaaccttcacctcctgggctcaagtgatcctcctgcataagcctcccgagtagctgggattatgggcgtgcaccaccatgcccggctaatttttatagttttagtagagacagggtctcaccatgttgtccttgctggtctcgaactctttacctcaagtaatccacccgccttggcctcccaaagtgctgggattacaggtgtgagccaccacacctggccttggatttcatgatttgactgacatcttttacacaaattattgccatttttttattgggtaccaattattagtattgttttctttattcgttaaataagaagtaaaataacttttttttaaaaaaagaacttttttcctagtaaaaagcttattttcaatttttttattgcttaaattttgcaggttaattaaggctgtgcttccttttcctactttctgtttaaatgtttggcattttttgagggttttctttctatggatttttgtgggggatcccatcttgttggacacttggttcctggagattgccaaattattgaaaagtttcctcatacccaaacattggcagtagactgaataaataacatctctgacactatttttcaattatatagagaatgctatttgtaaaatactgatttatttaaagatattacagtcagtagttttttgcaatctttttaaaatcagtggatgtcaaaaacagctattgttctttgtacagcatttttcaacattgtgaagagttcttatactcaaaaagtttgggagacacagtttgatattgtttaacctgagttgaacttgtcattttgtattcttgtttagagcagggattttattttgtctctttatctaactttgtattcctatttctttctttctctttggttctttgtttctttgttcattcttctctctctcccttttttatctatcatataaatatgtaaatatatattatatatccattagggaagaggaagctgtctaaagatatctagtatataggagctttgttctgcagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaacattacttcaagttctttccaaaggacatttaattaagtaaaatattaactaattctaaaccaggttccaccacaatgaaattgctactaattatgtaacattagatttcacattttccaattcatgtttcttttatgtagtctatgaataatgggttagaggtaatatactaattttaattgtgctttctttgttccttcttttttttttttttattttgagacagggtctcactctgtcacccaggctggggtgtagtggtgccatcttggctcactgcaaccttcacctccagggctgaagtgattctcctgcatgagcctcctgagtagctgggattacaggcgtgtgccaccatacccggcttatttttgtattttttgtagagatggggtttcaccatgttgcccaggatggtcttaaactcctgggctcaagtgatctactggcctcagcctcccagcgtgctggggattgcaggtgtgagccgccgcatccagccctgtgttccttcttgtgttactttcttgtaattttttcctggaatatgggtagtgatttggctctccagtattgaaattgagtttcctttcttccaattcatgtgtatccatttttatttggaagttttgtttttatacattcaataatcatctttactttctttggtattatttactatggatattttatattatataattttcaaatggattaaatggttcagttttactcttattattgagattgaaaatactagtttataatttatatattttctattcctttacctctaatttctttgtcaggtgttactaaccaaagatgtataataagaaaagccaatgtagctaaattaagtaaaaaatgaagaaaaacacagaagttccccattatgcatttttttattcctaatctttaggttgatgagatttttttatttttatgaaatgagattaatttattgacttttttagttttgaggccaagtaatgagtagtgagtaagaatgtatattctagggccaggcatggtggctcactcatgtaatctcagcactttgggaggccgaggcaggaggatcacttcattccaggagtttgagaccaacctgggcaacatggcaaaaccctctctctccagaaaaatacaagaattggctgggtgtggtggcatgtgcctttagtcccagctacttgggaggctgaggtgggaggatcacctggggagcctggggaggttgaggctgcagttagccatgaccatgccactgcactctagcctgggtgacagagtgagaccctgtctcaattaaaaaattaaaaaaaaaaaagtagattgtgaattcagatgtaggtttgtatcccagcttttccagttagtatctgtgtgactttggggaagtttcttagcatctttgatactcggttaacagttgtaattattatttaaggtattgcttgagaagagcttagtatagagcctgacatttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctgtgcagttagaattttgaccaaagatgtgggtaactaacttttcctaactaaatgacatttaggtaactaaactaaacgagattttcgtaactaaattttggtgtaactacatttagctttaggtaactaaaacgaagattttattttatctgtggatttttttagtgcgggactaatgtaatttctgattaccattaattgaaggttggttatattataacatttggattggtatattgcttgccatggtttgttctaaatgttagcctttagaagtattcctgattctaaaacatcagttttttttaatagtcctggcaaagtgtgaatcacaacaaaattctaatacttaaaagtaatccaagtgtcacagatggtacccagaagaccagtttgtattggaattaaaaaatagaaaacattaacccatggtagctgtcactgtattctttcaaagaagccaatgaaataaactgttttctccctctatgtggtgtttttctacttgaacataaatgcacattttattttatttccagactttttgtggccagcacccaatgaagagcaagttacttgcctcaagatgtactttggccattccagttttaaaccgtgagtataatctcatttaatcaaatcacatatttagtattctctttaaaacaagggaaaaggcaaataacctgtctgcttaacagcaacagcacaacttcactatagttatacatgccacactgtattttctgtgtgactacaaaattatttcaaagtgatatttatataaaattcatttctgcaaattgtttttataagtgaggaaaaatggttttcctttaactgagcagttctgagtagaaactagtttaaagatacttataaataaatgttaatttaatactgacttgtttttcattaaacgagtgtctatgtgcctgttttgtgtatattacccagaacatgcagatgtactagaagttcttaatacaacaatttgaggaatagtgataatcttatctattttaatgtactcaaaatttgtttacatctaacaggcacatttttgtgaggattaaatgagatgaataagaatgagatgaacaagtaaatgtgaataaaactaataagcctgtgaaaatctagactggatttttcctattctgagaatttaaaatataatccactgaagtatttctttccttttttcttttgatcttaaacattttttatttatgtcttacatacagaaaagtgcacatgttgtagagatcaatgaattgtcataaactgggcaccctgtggccagcacttagttaagaataggtcagtaacagcatgccagaagaccacctctccaattgatttttcccatgatattttattaagaaaattttctaagatgtagtaaagttgaaagaacttttttctgtgcatgtctgtattcccaccacctaaattcaactatcattactatacttgctttatcacatatccatccattcatatgtctctatccatccattcattcattccagttttaaaatgcatctcagggtcaatcgaggacaccattacacttccacctaagtatttcagcatgtaaattattaacgagttaaatatttacttaacagttttttctttggtgtaaaatttgcacgtaaggaaatataaaactttaagtgtacatttgcaaattttaaatatacatgtgcatacccatgtaacccaaattcttatcaagagatattattatcatcaccacacagagttcccttatttcccttttcagtcagtccttgtccctgagcatttctcttattattttaaagtattgattcttttggatatctagtatgaagcttagaatctgttttttactttagatgtatgtagtgaaatttaatatatataccaaatggtagttgttagttagcttgaatgggacattggtcaaatggcattgtttgttttaaagttccaggtttgtgcatttatgtatgaagtttgaaaataaattctatgagaggaaatgaaaaattgaatggattttaatttgtaccttgggtttcttattaataaaacaaaatagctttttgcttttcaccttcaagagttcagtggaaagtgattcattcagtattagaagaaagaagagataatgttgctgtcatggcaactggtaagttgtacttaagcaaaacctaatcctttaaaaaaataaaacataaagagtttgaaatgcttaatctttcattaaactctcaaaatacaaatgcaactacaaatgatgtaaactatagaagagagtgaacaaagaacagatgctcagatttatgtatcaattagcttttaggaagatagcatactagtattgaccattcatctgtataagtacattgtaaaaagaaatgaaagcatcaaaggtttatttttatttctatatttttttcattttatttttatatttttttcatttcaaggatatggaaagagtttgtgcttccagtatccacctgtttatgtaggcaagattggccttgttatctctccccttatttctctgatggaagaccaagtgctacagcttaagtaagtcatgttatcattgccacaatatcaccctctttttttcttctgtgggtgaaacatctgatccatcatgcatgttaaaatctagttcacaataacacatttctgcaggtattgctttatctttattggtaataaatgaccctttagtggaagagcttaccttctttcttgtgttctctgtaattcaaagctaccaggtggccctgataaaatttttttaaaaaacattattactttatgctggtttacattgaatatctcaaaattcttttctctttttgttacccttgctttttagcttgataagaagtgtatacatggaagtatattttttatctatgaaacacttttcagcttcttcaacctgagcttgcaatctgttttaaattgatacataatatctttacatattcatggggtactgtagtattttgatacactcatatcaaatacacttgatcaaatcagggcatttgttcatcaacttgaacatttatcatttctttgtgctgggaacatttctaatcttttctttgagttattttgaaatacacagtgttgttgttaactatagttaccctactgttggttaatgagtacaaacatacagttagaaggaataggttctagcaacctattcctttaccccctgtcatcccctgctgccctgagcttgcagtctctttcaaagacccaccttaaaaacttgcattctgataaggcccttgaaggaatttgcttatcaagttagtaagtgacaaaaaagaaaattgcaaagaacaggaatataaattattatatttctttattctttctcacttaagagtgaaattgatatgtgtaatgtgtacatggtgccagaatatttgtttttcttcttatagaatgtccaacatcccagcttgcttccttggatcagcacagtcagaaaatgttctaacagatattaaattgtgagtaatttttttccctcaacttttattttggatttatgggggtgcatatgcaagtttgttacgtgggtgaattacatgttgctgaggaagttgtgagtaatttatgtcatttctaatcatgtggtcagatgtctgtggtatatgagagaattttgtatacaaacaaattttactaaatgcatgaaaaaaaaagtccatgattttaaaatgcactttcttttgtacctttgcaggactgttactttttaaatccttcaaacttgaagaaatctgttattctcggttcttgggctataagattagcattgtactcatagaattataaaaattttggttttggaagagaagttggagaatataaagatttgtctcattttatagatgagaaaactgaggctcagagacaagtaatttgcccaaaatcacacaatgactggctgagcagggactggattctaggtctcttgcccaaccaattctatcatgatgtaattcctaaggagaatgtcatctcagatacacatacacacacccattttgtgtgtgtgtgtgtgtgtgtatatgtacacacacacacaaacatatgtacacttatatatacatacacacacatatattaatatatatgcatatatatgcatgttctaattcagaacattttcatcactcccaaaagaacacccctgcccattaagcagttgctttctttacgtatatattagtatatacatacacacgagatacacatatatttactgagttttgataaatgcatacaaagatgtaaaccaaacctctaacaagatacagaatatcactgacactctagaaagtttcttcatgtccctccccagtctgtccttccatcctccatcctaggcaagccactgctccgattttctctaccatagtttggtagaatgccatataaatgcagtcacacaatattaactcttttgtgtaagacttctttcatttgctgtaatgtttctgagattctttcatgctgttgcatgtatcagtagttttttgttttgttttgttttgtttttgttttttcagagtcagggtctccttctgtcacccaggctagagtacagtggcgcaatcatagcttactgcagcctctaactactgggctcaagctatcctcctgcctctcaagtaggctaggctgcaggtatgttccaccatgcctggctaattattaaattttttgtagagacaggatcttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgattattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattcatcacccacaaagtttacctttttgttttaaccccagtcaccgggtaactgctgagctccttcctgttactgtagactagtttgcattttctaaacttatatacatggagtcattcatattttatgtgctcttttttgtctgatttaaataatgcagtataattattttgagattcattcatgttattacagtgattaatagttcattcctcttattgttaagtggattacattttatggatatccaacaagttgtttatccattcacctgatagacatttggatcgtttccagttttgggttattacaaataaaactgctatgaacattcgtatgtaagtctttgtatggacatatgttttcattttattatatatgacggagcggaatgactggaacatgtgatgcatatatgtttaactttcttttttctaattgagataaaattcacagaacataacttttaccattttaatcattactaaagtccagtgggttttggtatagtaataatatataaccatcataattaattccagaacattttcctaactcccaaaagaaattccatacccattaaggagtcattccctattttcccttttcttttctttctttttttttttttttgagtcagggtctccctctgtctcccgggctggagtgcacttgcatgatcttggttcactgcatccttgatttcctgggctcaattgatcctcccacctcagtctcctgagtagctgggactgtaggcatatgttaccatacctggctaatttgttttattttgagtggagatgagattttgctatgttgcccaggttgctctcaaactcctgggctcaagtaattgtcccacctcagccttccaaaatgctgggattacaggcgtgagccactctgcccggcctattatctctgttctgcccacttccaaccactaatctactttctgtctctatgatttgcctattctggatgtttctataaattaacttatacattatatggccttttgtgtctggcatcttccacttagcatagtgatatcagtacttcattcggtctttttttatgactgaataatattccatagtatgggcatacacattttaaaaattcattcatcagtgatggacatttgggttgtttcctttttggctgttatgaataatgatgctgtgaacatttgtgtaccaatttttttatgaacatacattttcaacgcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctggctgatctttaacttaagccattctaatagtatctcattgtatttttagtttgcttttccctaatgactaattatattgagcatttttcatacacttattggccatctgtatatcttctttgagggagtatctgttcaaatcttttgcctattttttcttagtgagttttgatagtcatttctatattctgaatataaattatttatttgatatatgctttgcaaacattttctcctagtttatggcttttcatactttccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcagcatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatttgattccttgtgaaagcacaatgcctagcgcacaatagacacttaaacttatctgttgaatggacaggtgaatgcttttaaagtctttccatatagaaaattaagtttcattacatttgacttgatctaggttttcatttcatagaatggagagcagactctgtaaatattttgccccagacctagctttattacaaacattgtcttaattaggattctgtctacccagaatagaaattaactcaagctagcatgagtgtatattgaaatttatattaaggataaaggaatgtctcatagatcccactcaaaagaaattagccagcccttaggaagagactggaattgggtttggaaaatacaataggtctttctttttatctgtagtctttagtgagtcttcctcatttttctctctgaagagataagcattctctgcatatatatagcattcttttagattttcgtgacataaagtattatttaaactttcataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggcctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgctgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtaggtaaccaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacagtttatttcctagaacgtgtaaatatagaattagtcaaaagctgatagcactttttttgtacttaaaaatattttaagcctcagtatagtgagacctcatctctacaaataattttttaaaaaattggccgagcctggtggtgcatgcccatagtccaagctacttgggaggctgaggtaggaggattgtttgagcctgggagatgaaggctgcggtgagccaagatcatgctactgcactccatcctgggcaacagagcgagaccatgcctcaaaaaaaatttttttttcttcttggtggttaggcttaactatccaagaattgcaatcatggcttctattgcaaatgcccctatttcccaccttcagttggcctaaccaaatttaatttttcaatatcatatgatctttttgtataattatgtattcaaataattccagataggttaggttttcgaattgcaacgtctcatttaatggttactttcatataactgtaggaaagcatttgataatttttccaacaatgtaatgaaaacaaacttgtatcttttttattatgtgttaaaaccaacaaaagaatgagggcagcaattaacatttcattaaatatattagcaatgagtacatttatgagctcttaaactcccttattgacatactgtattttttgcctttaatggacaatgaatttgatatgtttcctaataggttgtatgaagttattgtgaatatttcactttggattaagaataactaccctatatataaatttcatggttgtattgcaaaagctggggtctatgtccatagtggtttgggtacgtttttactatttgctttgtttctgtgatagtgttaaatgaataataagcttaagtatttaagcaaatacttaatacttctgacaagtagttagaactctctatttttgtttttttgtaatggatgagttatggacactgcaattattagagcagcgtactttgcttatgatggatgaaaatgttctctggttgactcagtgttgaataaaaagggatacatgaaataaaaattatttttgaaatattttcctttgccttttgttgcgggaaattgtacaatgcttgcaaaaatgaatatacgcaggatattatttgtacagcagtctgacatttagctaatcagattcctcatttttaggtaaatgttaaattacttaagtagtctggatttttaacagaaacagcaaacatagttttatagggaggctccttaccaaccagacttttaacttaagtgaatgttggcaaaagcttgtctaaactgatttccagggataaggtttagctccattaaaagctagtttgtcaaacctgtaactaaagctttttaaaaaatgaaagttttaaaagagaccatcattctgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacacctgtaatcccagcactttgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaaaatcagtcactcactcaggtttagtttcaaaagccaaaacagtgataatattgaattttttccagccactcagtagtacccagagaattttgatacaaataactgactttgaccccatgtttagtaggttttttttttgtttgtttgtttgttttttttttttgtctttcttctccacactctcttaggactgttgtagcttgtaatgttagtgaattgtaattgtttatttgcatgtctgtctcctcttttagaattgtgaactcctcaggtcatggattgtattttattagtctttttattcctagaaaagtgtttggataataatagatatttattaaccataataggagtagtagcatttttgtgtgtgtgtgccaggccctattttagcattttatgtgaatgatataatttaatttttagagcatctagaaaatgttaggtaccattattatccacattttacttgtgagaggactgagacttggaaagcttaagtaacttgcttaaggtaatacacatggcagatggtggagccaggttctgcatctgggcagtctgactttagagctttttaatcatcctcctcctagtgtccgaacattattaatgctcagagaagtatcaaagaatgatgatactcattgagggaaaaaattattcttaagtatcaatttgttaattgaggacaaaagcactactgttactactgtgaaaaatctgaaaacattgtcacggatgattttacaataacatccttttctgacatgcattacaacacactattgattccgtttcaatgtttgtgtctggtatgggggcggagtagagaggctactacaggaagaaagaacaaataacatttcttcttactactttgtgcatcatgtgatttagctcctcccataccattttacattagaaaatgtggctgtcctcctgtgctctagtactggcatttcagaggactctttgcaatatgatatgtgatcaatcatggatggcgatgcagttaatttcagtagaaatttgctgactctttttatctcttttaatagctaatgcatgagataaaattgaaggtattaccaaggagaaatgcaggtggatagttttggaggcaaagtcacagtaagcaattcatctctccaaggaatagtgatgaaagctgagatccaataaatgtcttgtttggattaatacataaatatttccttttaaaattcttaaggcttttattcatatatctcccctctccctatttccaataatgatttttggtgttaatatgatgatatttatgcttctgtttttataggaaccaaatactttgatttggttatttattctcctttggagatgtagatgagtttattttttcctttcgagctttatcttttcctttatgtgtttttctttttttacaggtatcacgctcattgctgtggatgaggctcactgtatttctgagtgggggcatgattttagggattcattcaggaagttgggctccctaaagacagcactgccaatggtaagctttgccaagtctgatgtcccgaaattacattcttaataaggagagcattcaggattggggagtggtaaagaagctgaagacttcactataaaagagcaaatggataatgtaaaaagagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccgtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgtggtggcaggtgcctgtaatcccagctacttgggaggctgaggcaggggaattgcttgaactcgggaggtggaggttgcagtgagccgagattgtgccattccactccagcctgggcaacaagagcgaaactctgtctcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctctatctctaaaatattatttcaagaatgttatatacatggaatcatgcaatttgtcaccttttggaattagtttttttcactcaacataactaccttgagatctatccaagttgtttgtggtcatgtgttgcctaacaacagggatatgttctgagaaatgtgttcttaggacattttgtggttgtctgaacatggacttacacaaacctacatgataaagcttactgcacacctaggctatatgatagagcctattgctcctaggctgtaaacctgtacagatgttactgtaatgaatattgcaggcaattgtaatacaatggtaagtatttgtgtatctaaacttatctaatgtagaaaagacacagtaaaaatacagtataaaagataaaagatggtatacctgtatagggtgcttcctgtgaatggagcttgtaggactggaagttgctctgagtgagtgagggagtggcgagtgaatgtaaaggcctaggacattactgtacactactgtagactttatacatattgtacacttaggcgacactaaatttttaaaattttctttaaaaattttctttcttcaataataaattaatctcagtttactgtaactttaattcataaacctaaaacattttttgactttggactcttgtaataattcttagattaaaacatgaacacattgtacagctgtacaaaaattttttcttccttgattaatgcattccataaggctttattttaaaattttattatttttatttttaaaacttttttgttaaaaactaaaatacacacatatcagactagacctacacagggtcaggatcatcaatgttgctgtcttccacctccacgtcttatcccactggaagttctttaggggcagtaacactcatggagctgtcatctgtgataacaatgccttctcctagatacctcctgaaggacctgcctgaggctgtttttcagttaactttaaaaaatgaatacgtaggaggagtatactctaaaataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagtaccacatgactatttttcggtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctgagactacaggcgcccgccactgtgcccggctaattttttgtatttttagtagaggcagcgtttcaccgtgttagccaggatggtctcgatctcctgacctcgtgatccacctgcctcggcctcccaaagtgctgggattacaggcgtgagccactgcgcccggccttcagagattctttaatgggtgaatggttaaacaacctgaaaatataaaagttttcatttctctgggataaatgtccaggagtgtatttttagtttttaaggaattgtcacaaacctgttttccaaagtggctgtagcattctacattcctgtcagcagtgtgtgaatgatctagttatccttgccaccgtttgttgttgcaactgttttttattttagccatttcgataggtgtcgagtggtatctcacttttaatttgcatttctctcatggctaatgatggtgaacgtcttttcatatactaatttgcctctggtgaaatttcttacataattggagtgcttgtttttttctgttgagttttaagagtttaaaaaatacattgtagatatgagtccttggtcagatacgtggtttcaaatatttctttcactttgtagcttgccttttcattctttttaccgtgtctttcacagagtaaatatttaacattttagtgaaatccagtttatcattttttcttttatggattgtgctcttcacctagccctagatcctgaagattttctcctgtggttctttcctaaaattgttacagttttatgttttaagtctgtgatccattttgagttaaattttgtataaggtgtgaggtttaagtcaaggttcattgttttcccaatagattaaattgcagcagatcctttgttgaataggctgtccttcccctgttaaattgcgtttgcccctttgttgaaagtcatgtgggtgtatttgtgtgggtctatttctgggttctctagcctgttatattaattttgaacgaataaagttggcttatgtttaagttttcttggtagtagcgaggcaatggtgccttctgagcccaggatttcacaattttgtgagtaaactgtgttagaaattgtttgttattcttttggtaggttgtctagttcaatttcattgctcattaatcttgcttatagatagcaaattgagaggcatctcaaaaatagtatcttttgttagcttatctcacagagtttggttggagcagatattaaaacaacaaaccaaaaataaattaaatatactagttagcaagtttatattgagggaaaatcaaaccatgtgaattgagctccaatgatgtggctggccttgggtcagattttagtatcatggttcaacaaggtagctattaaaatcttcatactttttcttgaaataattctttagtagtcacataggacagcacacactcatggatttcttctttccttactgtctctttattctcagcctcctgttccttctcatctccctgaccttttaatgttggccttccagaaactttagtctttggacctacctttgcactcattttcttggtcatttcacccaacatacagttttatgttattttattttttttatttttgagatggagtttcactcttgttgcccaggctggagtgcaatggcgtgaactcaccttactgcaacctctgcctcccgggttcaagtgattcttctgctcagcctccccagtagttaggattataggtacgtgccaccatgcctagctaattttgtatttttagtagagatggggtttcaccatattggccaggctggtctcgaactcctgacctcaggtgatccacctgccttggcttgccaaagtgctgagattacagatgtgagccaccacgtccagcctacagttttaaatatcaagtctatactgaggactcccaaatttttatctccatcatagactgatatcagcagtatatgagtgattcagttgtttttgcctctttgccagcatttggtgttgtcactattagttcattttagccatttaatagaatatatgtacatatatatgtgtgtatacacaggcacacatctatataactactcaacatgcctctggtgagatgaccaacaggtatctcaaacttaacctcttcctaattgacttctgcatagcactccagatctgctctttcctcactctcctccatcttgtttaacagcagctccattggccaaaattttggaattttcctcaatcttttctctttttcttacactccactgtttatttaaacagtaaggaaatctcgtgaggtcttcagaatatatgcagaattaaatcacttctctcttgatccctgccattccccaggtacgggccaccatctccttagggcctcctgctttcactcttcccatccctcattctgtttcaacacagcgtccagagtgatactttaaaaatgaagtctgatagatcatgtcttcggctcagaaccatctagtagcatgccatttcattctaaataaaggcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatcattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccatacaacatcctgctagtttctaaagcaaatgatttgaaagaggcataaaacataatttctgccctcaggtagctcatagttcagtaaaggagtttagattcatacctataacagtagaagtaatagcaccaaatgaaatatggtattatgaagtggtacaaataatataaaaagatgaacagtgttagtagtacatgtttagaagggatttctgtggtgaaagtcactaggcacagtgcacctggaggaccgatttccattaatttagaatggtttaaagtaagcttttggaaactaggaagattactttctgtaatcctttcctaggcctttgattctagaaggattgtgttaaaggagttttaaatattttatacagttcttaaacattgttaagcttgaattaaatcttttattatgtctggccatggacgtcattggatcattttcatttcttgggaggattaataaagcacattccttctgttgggcctccagtgcggggagggtgttggccgagcagtggctgagaaaacgtttttcccctggtgttttcaagaaccctctttattagctaagtggtgagacatgccacctggtggttatagtagtatcatttttctcactgttcttggtgcttttcttctcgttctgattccagttatactaggacaactgctataaacctggaatgtttcacactatattatttcagtaatttcaaaaacagcagaaatcactaagctgtttggcacaaagattcctatttggaaggaatcagacaaagtgagtgttgagaaagaacagccaggcagaaagctttgcatcagtcttaaagttctttacatttcaagtaagaggaattgtgaaatccataagacatgtggggtttttctattactttctccccagtatctattacaaagatcagcacatagtaggtactcagtaactatttagaatgagtgcatgaatgaatgaagtatgtgtgatgttatggagtacaaagttagaattagcaacatgacctgaatttagaagcaggtgggatacttatacttttctcagtctgtgggcaccacaccattgaagtatatgtctaagattaatttatatttggttgtttgatttagcaaaacttgctgcctgttaaaaaagaaattaagacctgtcaacttaaagaatacattttgtgagttaagaactaaatgacagtataatttattacccaaagcagtttgcttctgaaaattaaagagttcaagctattaataattatgctgtgactgcaggcataaactgggaatgtcctggcaaatgaggatgtattgtcacctttctcagcctgcctgtgtgttgtttttaagcttcactctagtttatatattttaaatgtcataaaataccacatacttataagagaaaaggttctattcattgctgaagtggaagcttatcattaatttttatttatttatttttttttccagttttggaattcttattactttgaacccaagaaccactgataactagcacaatccagtgaaacagaggaagcagcagcttaatcaaaggaaaaatacatttaagattataagtctggttataagcttaaaaagtgacccagaaagggatatcattgctaaaaaaaaaaatccccttgtgacctgggtacattttgcaaagccacaggtttgcagtgttacacaagggccaaaggaggccatgagttgtctttggttgtggggccggagggtaactgttcatgaaaatagtgagtgtctgaagattaagaaaatcatgctgcagcagaggagaagggagaggaaggcaggaagggaaaggagatgcctgagggtcaaaagctgagcccaagcctaagcccaagctcaagttcaagccccagcatggcacaattttgtgaattaactcaggctgagttgcctccagtctttggaatgtcatcttatactggtactgctgaggcagagggcagtaattggttctttgggataggagaaggggcagttgctgaaatacaaaattaatagtcagcatcccaagttcctcaattgcagccaaaatacatgtgttcaggcctttcggcagtaccgcccccagaactaccagctgtagtgtggtctattcccagacagcaacatgcaagaataagtttacaatacactcagcccttgtggcttaagatcaggggctcagaggctgtgacaactcatgatgctgaaaatgtatccaatgaaaacgaagtactagcttgtttagtagtaacgaagtactattaatttttaatatagtctgatactttattttctaattgtagaagcaacattcttagctatatctttctagaatgttgaggcaaaagagtaaatttatagtgattttcactgttaccagattgctggaatagggaatttctggtagcaagatgggaatttttaagttggaagggtctaacacatcatatagccgtctccatctcattttttttgctgaaaaaactgagcccttgcaaatgtcagttgcaaatctgggagtagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacttttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgtgagaatgtgcatgttctaagaacctctaatttttaaacctcccttattctcagccttatatttgttaaaacctgtgtgttaacacagatgcacccatgttaggggttaattagagaaaccaacctctttatagattagcttgttcatctttaagttgctaggcaggcactgtaaattcagagaacaatctgattgtaagccacaaatcaatgaaattaattttggggttgccttttaaaatagtgtcacaaaatttaaggataaagaatgcaaaaatgatgccaattatctcatcacattagttttgatttaatttttttaatttgaaaaaacctactcttaaacttaattgatttttttaaatataagtttggagataatttttaattcagtaaagttatagtgattgaaaaagtagtttataatttttaataaattgatcttgttttaattttgagtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacgagttctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacctcatggatttaatgttttatttaaatgatttctgatttttaaaaagtaaatattgtttccagaaggctgagaaacaagttagtagggagattttttctttgcaaaaaaattttacagttgtgtctttaacattgtaccacaaactgttgtcctaccagtctctttgtaagaaagctatagacatgttgggaatgaatgagctctttcctttttaaaatatcagttttacatcattcaggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaaggtaaggatttaatggttgatgaattttggtaatgatttcctttttttttttttaacaacttatgtattttatgttatttacgatttccttctaatgcatatttaacatatttcaaattccacctagttttggttcaagtcaagcatgatgttatataatcaattcagtgattgagactagtgtatttttaaaagcagaaaccaattctcctaatattttaataccccattctgttgcttaaacagggcatatactatttatttttattttttaaaattttacttatttatttatagagacagggtctctctgtcgtccaggctggagtgcagtggtgtgatcacaactcactgcagcctcaaactcctgggttcaagcagtcctcctgcctcagtctcccaagtagctggaactacagtcttgcaccaccatgcctggctaggacatatacttttaatgattgataagtaaacaagcaaacataaaatgactctttcatctgaattctgtctagtttactaattacatgacttcagtcttaaggagcttagaaaaggtcaccttacaaacacagtggagcctgtattgtgttccaaggactattgtaggcgctttctatataaaatgatctaatttaatccctataactgctcagtaagttacgtattattttcattttattgttgaggaaactggcattagtacttttttctgtttattttgtttaaaggcattttaaatatatatgttaagaagttttcaaaagcctatattttactttttataagcctttattttactatttgagacagtgtcttgctctgtcacccaggctggagtgcagtggcgcaatcccggctcactacaacttccacctcctgggttcaagctattctcctgcctcagtctcccaagtagctgaaattacaggtgtgcgccaccatgccaggctaatttttgtattttttagtggagacggggtttcaccatggtggccaggctgatctcgaactcctgacctcaagtgatccacctgtgttggccttccaaagtgctggaattacaggtgttggccactgcgcctggccagtttataattttaaacattaaaataaatgcttcttgtccaatcatggtgtctcacacccagaatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaaaagttcttttgaagaaggctgtttgtcctaggttagagtctccacagtcagatcattatctcctcctaatctttgatcctgttcagtctctatggtactttcccttataataacactctctatggcactttcccttataataacactctcctttttaaagcagtttgccttttttgtgtgtaatattgttctcctggttttctgacgtcctggtcctcttataatcctatgcaaatgtttctttctgtttttcatgttgactctgctaattgaggtctttgttactttttagccgagactattataatttccccaacagatacccctctccccagtgccccttgttgctttctatgcagtttacaaattattgtctgcaaacacatccttaagtctggaatacctttctggaactccttactaggaaataaagaccagactcagtgtaacattcaacagtattgaagatctaggtatttaatatgaatttttttttttaaggagatcaagaaagatttttgtacccatttttaatcctccaagaagacttaggatagcaggaaaccattgagagtcagaatgctttctacagatcttaggtgaacagaaactttcctcttcatgagcagtgaggtagagggtaattaaggcttcagagcattgcccgttatttccatcttcttcccttcctttaattctgctaaattcctttaatttgtttatcagtattcaagtatttttatccattgagctaaggtgtttcttaaactaaccctattttgttaaagtcttaattataatatattcatagtacatttaagtgagatagatgagtctctcatataatttagtggttagattagattagaattttctcccctcagaaaattaagaggaaataaaagtctgtagcaaatcacttggcaaaataatggctccttttgtaataggaatttttactcttttgatttatctgttacataagttcaaatttttacatattttccaccttttttaaaaaagagtgatatgtagtcaatatcaatttgagcaacactgttgcatataaattgaaaaggactccaattttctaattccgtacctcagttgtgatcactgttggtattttggcatttatgtagacttcctttctctgaccctactactgtgcagatatatagttgcagttttttgttgttgttaagttgatacagaaatagttgcatactatatccattatttatgcaaattttttttcatttaaagtatctgctatctttccatatattgcattttcttaaattagagccttaatatataggatattacaatatctaggttttgttgagtagttttttcttctttgaaaacatgtttttaaaataaggtttttttttttttttttttgacatggagtcttgctctgtcgcccaggctgtaatgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtggcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctgtggaaattgaacatttaagttgtttatacttctatggaaatcgtttacgcttttaataaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcacactcctttgtaaaccctcaccagactaattgttaatctggtgccttgcattccccaaagtatttgtatctgtcgtttataagtttttatcaaggtttcagctaaaacaaataaatttgtttctggttttagctttaatttgaactgaaacagtcaaaactgagttttggggacttcacacaattcatttggatatttgattctccataatgttttaaattttcatgcacttaaatatatcattatttttgataggctttcttcctttagtcttttctttagaaggtagaaaggaagaattaaataagataaaaccaaacgggtctgaagcatgtataaagtatatatgtttgctcttttgttcttctttttctttagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcaggtatgaggatcaatcatcattgctctccgttgctcatagtggaagtggatatttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccagtaggtgatgaggggaaaggaattggttatagaattccaggaagaaggactagcaggtgcaaagacactttgatatgagaacacatactgggttcaggaaatgtgactggtatggaatggttggagggaaagacaatgtggggtaggaatggcacaaagtatggacaaagaggcagggtggaaccgttagagacttgagagaacagttgaatgggtcggttggccaggttatagatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgttggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattggactggctcagtgggtgtcatagaggatttatttgggaggatttaagttcaaggcacatgagtaggtttaagtcaacaacttgacactgtcaacatgaaatccacactgtaactataagtccgaggaagagccctctcctgaagttaggaatttaacttcagctcttgcattttctgtcccaccggtcatccatttcttctctatccatctccttttctgatatctagttgttatcagtgttgttgaaaagcttaagtatgattcatattcactgtctataaagttcactacacatagtcatgctgtaatgcatacccgcctgaaagcatctggtctctcttttccttctttccaaagataagaataccattcacagctgtttagaatagaaattttatccaaattcttcagtgtttatatttttgttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggagactttgttggatgcgcctgattttcctgccaattcacagcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttacttactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtcgtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaatattagagaatgttaaaatactctgcaatcaggtaaggacgcttgaaacttcattataatgcaaaagttttctttaacacaataaatattttgaaccccttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattctgctaaatatgtttgtcaaactgtgttgtgatttgttctcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaataaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgcgatgtcttcagccatagttacttcaactaccactgattttgttactgattctttcttcccatgctacagtggtgattattccagaggatttctctcagtccctatttgactcttgttactatttgttttcttggttagttccatgagaccatgccagttctccttgactgtgtatgaatcattgtgttgcactgtactgacagactgccgtaagtcaatattaagtgttcagtatctaagtgcaggagaacctttctacttaagtactcaacaagtagtttgttggcacttaagttctatgagattttttgttgtaaaggaaaacattatcttgcaaagattttggggcagcatttaccaatactttgttccttcatccgtaggaaaaagaatctcaggagaaaaacctatacatggtaaccaatggggctgccaagctgatgaagtattttcagagtacacctttgtgtagctgaataaattgagatcttgaatggacatattagctcattttagtaaaatgataagagagtgcctcccactacagtttttgtttttatgcatcattaaacaatgtgtttttgattgtccactgtgttccatgaactatgctatgtgtgggagatatagtagtaaagaaaagcaaagtacctgcttccatagaattcagtataatgggaatggtaattctttagagaatcacataactatggatacataggcttcattttactgttctccttttgtgtttgaaaatgtcaacaatcaaaattttgtaaaaaaggaatcatgcaacatatttaaaattataactgtgttaagtgtaatgaagggaaattgcactgagtagtaagaatatataatggtgtgtggtatttcccaagttaaaaaggtcagataaggcttccttgtggaagtgatagttcaaatctgaaagaagaataggaattaattaggtaaaaatgtttgatgcaaattttaagattttccttctgagtagtcagtagcttttccttcttaacatagaagatgacaaaaccatcctttttttgtacataacaattcttgttttcctttagacagttgtatctgtcaagcttcttatgatctaatttaaataattgggatagaacacagctgtacatgttactattaaatatggaatatatcaaacataagttgattcctaccagttctgattttatttgtgtattttgttaaaggtactgaggacattaatatccagttttatattgtgcatttgaaggttcatcaataaatacaattcttgtttctctgggtcttaaaagatattttaaatggttatctcattaagatttaacaggaaataacagtgattcaaatcaaatagtggtgccagaaacccatacttgaattttgggtatagacaggttaccctttgcatcaatcctgaggaaactaaaactataggattaatcaggataaaaaagaattgagcaaggattcaggagggatctgtatcatcctggtgacaaccctcttctagaaaaaactagaaagtctaagaataaatgaagttgctggttctcacctggaaaggtcagttactcacaaaatttttagagtctatcttatgccataattctatcactgagagaagaaacttgtccagtcatcatgtaatcttcatgtaaatttatgtttttaattgcagaattcataccacaggcaaagtcccaatgtctgcatttgctgttaccttaaatagtcaaaccccaaagttattgtaatctttttttaacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttctgaagagtgtgggcatttcttttcttgtttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtctgcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatatacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatattataagtaaatcgttgttttcttttgaaatatctgaaacctagttaacatggactttcatttgttcttgtaaagatatgcaaagctatttgggagattgtcatcatctgatatttgatattcatgggctttcttcacagaagactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacgtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataagtaaaaaaaaaagtaagaaagttgccaatacagttttacatattcctgtgatgtttttaatcgacaggcaccttcttactgagatacgtaatgagaagtttcgattatacaaattaaagatgatggcaaagatggaaaaatatcttcattctagcagatgtaggagacagtatgtattatttattttatgccaatagtatggatttatggatgatgctcttttaagacaacaatttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaatcatcttgtctcattttgaggacaaacaagtacaaaaagcctccttgggaattatgggaactgaaaaatgctgtgataattgcaggtccaggtaaagatttcttattatagatggacattctaaaagtctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaaatgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaaaagaatcatttcaccaatgtatcagtcagggttcaccagagaaataggacgattgatattatggagatatatatatatatatatatatatatatatatggggagggaaaggaagaacaaatatggggagagagggatgaggcgactgattttgaagaattagctcacgaaattgtgggggttggcaagtctgaaatttgtagagcaggtcaataggctggaaactcaggcaagaggtgatgttgcagtcttgaggcagaatttcttctctagcaaacctagtttttgccctttagtcctgccactgagtggatgaggcccacccacattattgacaataatctcctttacttaaagtcaactgattataaatgttaatcacgtctacaaaatattttacagcaacatctagattagtgtttgaccaaacaactgagcatcataggctagccaagttgatgcataatattaatcatcacaaccaagaagacatcatcctaaatatatatatatatatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatcatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaaggtctcaaatcagtacctaagcttacatcttaagcaacaagcaaataagagcaaaataaatcaaaatgaagtaaacataaggaaataacaaagaacataagtcaatgaatagaaaagctatggtcataccactgctgtccagcctgggtgacagagtgagaccctatgtcaaaaaaatttaaaaacaaagcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccaggtattactagggatgataagggaacactatgaacaactcagaacataactttaataatttagatgaaatggatcaatttcttgataatctcaagctaattaaacttacagtgaattagataacctgcatagtgttacaaccattagagggattgaattctatgttaaaaatctctgaaaataaaatcccctagcccaaagaatttcaatgacaaattctaccaaacatttagaagacaaaataataccaattctatagcatgattccatttatataatagtctttgaaacataaaactatactagagggatgaagaaaagatcagtggttattagagattgggggagggagaaggtatgattccaaaggatagtacaaggcagtattttggagtgatagatttatcgtgccctgattgtgatgggagttagatgaatctatggatatcttaaaatgtgtagaactttacacatacatacaaccaatttgcctatgttaattgaaaaaataaaataaaaacaaattatttacctggtgggttagctacgtacctaagttcaatagctgcgttactgtaagacaaaagaagcattattagggatggagttgttctctgtgtaatgacaaatacttcttcactaagaagacagaattgttttatgcacctttaaaaaaaaacaaaaacaaaaaaaatacaaccaacaaacagtaacttgctggtgcggtggctcacacttgtagtattagcactttgggaggctgaggtgggaggatcacttgagaccaggatttttaagaccagtctgggcaaaaaaccgagactgtgtctctacaaaaataaaaaataaataaaaaaaattagctaggcatagcattatgtgcctctagtcccagctactctggaggctaaggtggaaagatcgcttgagcctggaaggttgagactgcagttgcagtgagccatgatggcaccactacactccaggctgggcatcagagtaagactctgtctcacataaaaaaaataataataatgataaaaactagtctgggcatggtggctcacacctgtagtcccagtcctttggaaggccgaggcaagagaattgcttgaacccaagactttgagaacagcctgggcaacatagcaagaccccatctctatttaaaaaaaaaaacaaacttaaaaatccagcaaatacataaagcacaaagccgacagaagaggtggagaaatcaacaaatccaccatcaaagtgggagaatttgatataattttaagttattggtagggtaaacaatccaaaaattagtacactgtagaaaatttggtcaacatagtaataagtttgcttattactatttatcagtatacatagtatactgatttatcagatacatagtatatggagccctagagcaagcaactatagcagtgtatctcaagtatttttacttcatgacccacatagcaaatgatatgtgtatataacacactgggctaattgtcagagttcagtttctgtccaaaaccctaagatctggagtgattaacctttcagcactcttagaactcacttgtttgtagcacactgattgagaagcactgaaagacttcactcctcaaacatacatggaatatttctaaaaactatgtattgggccgggtgcagtggctcatgcctgtaatcccagcactttgggaggccgaggcgggtggatcccgaggtcaggagatcgagaccatcctggctaacatgatgaaacgccgtctctactaaaaatacaaaaaattagccggatgtggtggcgagtgcctgtagtcccagctactcgggaggctgaggcaggagaatggtgtgaacccaggaggcggagcttgcagtgagccgagatcgcgccactgcactccagcctgggcaacagagcgagactctgtctcaaaaaaaaccaaccaactgaacaaacaaaaaaactaaaaaacaaaaacaaaaaaactatgtattagagcatgggttggcaaactatggcctgtaggccaaatctgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcatgagccatcacgcttgactaatgtttttgtaaataaagttttctcagaacacagccatgccttttgtttatgtgttatgtagggctgcctgagttaagtagttggctgcaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaaaacaaaacaaaaaaaaaaactagtaagagggcccagtggctcacacctgtcattctagctctttgggagactgaggagagaggatcagttgaggccaggattcaagaccagtctgggcaacataacgagaccgcatctctacaaaattttaataacaacaacaaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatattgaatgcattcttattgctatttcaaagatacttactctaaggaaagcaattgaattaggtagttgaactctatagtagattttctttaatgagtccttttgttctcaacctacttaaataattctcatttgaatttatgatagtttcagatctacccaaagggtgacttaggaatttaacttctaaatctatttaaatgaaaggtttataatctttttgtcatattttacagtcgttagcgtttaacaatttatagcataggatttgggtttttttttttttttcattttaaagaagaagtttatttaagcaagacacttgactaagggaagactatcttggagttattattactagagtaatttatttctacttaaagacagattgccccacaagtaacagctacataaaaacagttgtaaaattgtccttggttttacaatgataaatgaaaaacattaaaattctctaattgaacaaggtatgcaaggatttttatattgttttttgctaaaactatgacagcaaaataacatcctggagtataaagataagagctgaatgagcaggccactaggggacaaagggagtcttttcacagaaccaatgcttcttttgcccaccccatctccatcgaagtcaatctaaacatattattggccatttagttaaaaaaagaaagaaaagaaaagcaatatgcttgtggacatacaccagttactttatgtgcagtaaaagagtaggaaggggaaggtgaaagaatagagaaaactatgtagtcaggatgtggtggaaccaaattgcaactttctttttttttgagacagagttttgctcttgtcacccaggctggagtgtagtggtggcccaatcttggctcactgcaacctccgcctctcagattcaagccattctcctgcctcagccttctgagtagctgggattacaggtgcatgccaccatgcctggctaatttttgtatttttagtagagatgggttttcaccatgttggccaggctggtcttgaatgcctgacttcaagtgatccacccgcctcagcctcccaaagtgctgggattacaggcgtgagccactgcgcctggccaaattgtagctttctaattgagactgtcttcttggtctggaagagcagagttctgcagtaaaataacaggtcccccttttagtagacatctccatgtctgctgctggaacacatcagttttgtcttaagcctcacttccaaatgtgcagatgtgtctggttcattgattggctgcctgtcaaattgaaacctgatctgcctcattggcaaaccgtgccccttacaataggctttcattggtttactaagcggtgtggtgcgtggctgttcatcttaaactgcaccacagtttaagatgaaccttcaaatgaacattatccttgttctcagtcttgactttccttgggctttttgtggaccctggtgagtgtggcagtctcctcagctgctgcttcacaaaagaggtaccaggtctgccccgaatgagtgagcccctaaacaggaccaggagtggcagaagaaagaggcagcaactgagatgtgttttttctaagctgaaaggctttttttttttttttttttgcaacacacctttaacactaaagtccaatatttatataattggtcaagtaagtggagctgttctagctataaatatggcaactctgcttgctcgtcctattattgacattattcctttctgtggtctgaggtgcctcccatgaaacttgcttctaggacactaggattgagaaccatcagcgtaacatatctgttacgctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtagctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcattgtgttaatttatcacattgcatttgggtgaatccctagactagtcttgcttaggataattaggaaaagttaactttcattgtatcaagggacaggtagaacaaaattgtccttttgtccaggaaaccattaaattcttcaaggaaaactttagttatagggattattttttaaatgtctaatttcagtaacaatatttgggacatatttatttttccttctgtttcctatcagaagtatttaaagttataagaaaattgtggtttttgcctttactaatgaataaataatcaattaaattcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactcgaatgcttcatgtaaatactttctgagtttgtatttttagaaaggaacattttggaggctgaggcaggagaatggcgtgaacgtgggaggcggagcttgcagtgagctgagattgtgccactgcactccagcctgcgcgacagagcaagattctgtctcaataaaaaaaaaaaaagaaacatatttattaaattagttgtgaaatatttttaatgaaatatattgaaaacttctgttgatttttcatgtactgatgtttttagattctaaatggagtttaaaattttgtttgtaaatcacaagttggattagaaatttaatagtagaagtgttgcctaaggactattttaggtgctgtgagtgaaactgtattttttataacaagaattttagttgtaagggacagcttaaatataattgagatctgtgaaaatgtattctgtctctatcaccttcagaacctgtgtatctcagttgaatgtataatttataaaaattattcttgttttaatttggtgtaatccagccatatccagtatcaacaaataagtctaagtaggctccttgacaaacttgaactggccacaagagagatcagatttcacctattaaaaaaccaaatcagaccacttacactgacagtctcttctgggagtcctcaaattaagaagtctatcctttgtgaaatattacactacccttgctagataaaacttttctaaaagtaccacttaatgaaaatctgtagacactaaatgcaatgaaaataaggcattgtttttttttctccccatttcagtgatcttggtatcctgggatattgtttttaaaattatcgttataattcctttgagaatttagtgaaatgttccctttaaccaacttaggaaaaattaatatctttgtacatgattttgagctgtaaaataaacattttaaactgggaataattggagtttagttaaagagataatgtatataaatatataacatagtagcagcatataattctgtcttacacaagatttttctgaatagtataaacagttatgtagcctatctaggagtttgtgaatagagtttaaaattttgttttgaagctgcaaatttgattagaaattaaacagtgaagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcaccgagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaaggtatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctctcttctttttcttttttctttttttctctgtcagataccgttgtaaagactttgcttttaccggaaactgatacgttgggtcatgtaccctggccagtcagttctctttattctaacacttagccgatcagttagatttccacattccatgatatgtcagttttggtgacccttatttttccacctggtttataaagggaaagaatgtgatatgtcacccaggctctggagtacagtggcatgatcataggtcacagcagcctcaaagtttccagttcaagcgatcctacttccttggcttcctgagtatgtggcactacaggtgcatgccaccatgcccagctaacttttttgtagagacagggtctccctatgtttcccaggctggtcttgaacccctgacctcaagtgatccgcccaccttggcttcccaagatattggcattacaggcatgagccactgtgccggcctgaaaatttctcttttgagatggcatcccacagaagtatacctgcttagagctaacactggtaaaaagactatttaaccctattgccttattttactgtagttgagattgagttaaactgaaagctgaatgacctgtcctaggtcatactgttactttgtgccagagtcaggatgagcaaatggatttcctgcctgctagtctagtgtcttttctatttattgtgctgtaacatacagttttaaatttgtatttttatgcccaatggacatggtagctcacacctgtaatttcagcacttttgggaagccgaggtggggggattgctcgagaccaggagttcaagatgagcctgggcaacatagcgagactccgtctctataaaaaaaaatttaaaaattagctgagtggtgatgtgtgtgcgtgtagtcctccttgtgggaggttgaggtgggaggatcgattgaatctaggaattcaggactgcagtgagccatgattacaccactgcactccagcctgggtgacagagcaataccctgtctcgaatgaatgaatgaatgaatgaatgaatgaatgaatgcccaaatccgtaagctatgttctgtatagcagctttttcatcataggcagtttttactcttatcagtggacaacctacaaaattaactaaacacttaaacaattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactctgctttaaagcaaaggtatatcatcctcttcatggtgattgccatggaaacaagacaatgtaaatttattcaaatagtacacagtttttatagttattgatcatgaggggaagggacagttaatccctactgatcagataaaacctcattgtttcatactaataaatggtttttttatgcttatgaaaggaaaagccagaagtgtaatttttagtgtttagagagctagtgattctagttagggaacttaatacctttgaagttattagtttgcaagcaatagaatctactactaccaaggtgacccctagcagatgtagagtaccattaacaagtgttccagggaaggaaagccaactagataccaagtcatgctttttactcttagattaagaaattcaggttgagttaaaggatcagctgttaactaataaaaagcagattaatattacagagccaggctctgtcctggttatggacttaatcttcacagcatcctcaagagataaaaatgaatatacctgcatattagatgaggaaatagaagataagtaacttgccagagctatgacgtgaactcaggtaatgtagcttaagagcccccacatgtatgtatattgggtgtgtgtgtggagggggtgcgtgtgagtgcttgtgcatgcgtgtggtataataagaaaaaattagcatttatgcctgtaatcccagcactttgggagaccgaggcacgaggatctctcaaccccaggagttcaagaccagtctaggcaacatagcgagaccctacctctacaaaaaaagttttaaaaatattagcgggcatggtggaatacacctgtagtctcagctgcttgggacgctgaggtgggaggatccttgagtccaggagattgaggctacagtgagctatgatgacacctctgcactccagcttgggtgacaaagagagaccctgtctccaaaaaaaaaaattagaactagttatctggaggcctgtgttctagtcctagctttagtacggctacacagtgacacattaggctaccatttaacatctttgaacctctgataatttgttaacaatatgggtaaaaatgactaagataaatcaaagagctccagcattccctccagctctgaaattctatgatgttttatcttattttacttacaaaaataaattatattatgtatatttaaagtatacaatttgatgttatgggttacctatagtaaaatgattactataatgaaactaattaacatatccatcatcttatattgttaaccatttttttgtttttgtggcaaaagcagctgaaatccactcatttagcaggaatcccaaatacagttcagttgtattaattgtaattctcatgttgtacattcgatctctagacttgtttatgctacatatgtttgacttttaaacattctactcaaatcaaccctaagtcagggttagcacagacaggacttgttaacaaggtagaaggtgccacattgtacctgggtgtttatatttctctaaatcttgttctgatcatattttaataaatataatcatcaggacaccaaaattcattccttagctattaaaaaattctattctattttattgttaagatttaggagagcatggtacagattctcttaactatacctatcagaagcctatgttttaagtccaatgtataggcactgctctgtttgtctctggtgggaacttaccctgctttacctaatttcatcctagcttcctttttgtgaaagatcacccttgcttagcctattttttggcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaatagagagccctatagttgccttagttaagtttgctgcaactcattttatatattcttttaattttgatccctggatttttaattgattattaaaccttcattaggatatatatgaaatgtaaaaatattgagttataatctaccgttttctaaaattttatactgcatttttatatagaaattcaaattgctcataatcattctagtgaatttaagtagaaaggtatttattactaggtattaaatggcttataatattgttgacaaggttccactgcaaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagaggagtagccttagcctcacttcctgcttatacctgtcatgcaaatatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgttttttttttttttttttttttttttttttgagacagggtctcactctgttgctcagtctgtagtgcagtggtgtcatcatagctcactgcagtcttgatctcctgagctcaaacgattctcctgcctcagctcctgcttcagcctcctgagtagcggaacaacaggtacacaccaccacactttgctaattttttattttttattttttgtagagatgtgggtctcactgtgttgcccaggatggtctcgaactcctgggcttaagtgatcctcccaaagtgttgggattacaggcatgaaccactgtgcctggcccatatactacatatatttaaaagtagtatttaaatgtgtaggatgaatgaaagaggcagtaagagaacaaagtgaatgaaaaagtatttctatatgaagtgaaagcaggagagtcctctctgttagagaacaacagaattgcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgtttttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgcgttttatataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaacggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttggttgatgggaagtagctgaccatggtatttagaaaacttctttctcatcgattaaagaagcagtactgaaatcaatgcggaggaatccatatatcatatttacttctggtgtgtagaagtggaaagggaatacatttgttgcttacttttttgtacctttacatgtgattgatcacttgtgagttttttctttcaaacatcttaaagcttccagagctttttctagaaaaaaaaatcagttttaagaatcaccagttctaaaagggtaatatcttattcatctttctgagaatggagtatcatgattcatgaattagatacttgcatcttaacatttgaaataatttaattttattattttttagttcgaaaactgtatcttcgggcaccaaagagcattgttataatcaagtaccagttgaattaagtacagagaagaaggtttgttttaaagaaattgttctgatttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagacacacacacacacacacacacacacacacattctctctctctctctctcacacacacacacatgcacacacacttatgtactttcttgctttttttgacctaagatcttagataactattacagattaaatactaatccactggcagacttcagctaattagaacactggaataataggcaagcatagtgaattacattttctggtgaactttttctgctttattgaagtatgcagaatgtaaatgaattgtttttataactttggcacttgctgtatcttagaacattcttttgatgatttattttctgtagttttgggagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtgataagatttcttctgggagtaacatttctaaaaaaaggtacagagttccatatttctatgttctatacttgctttatgagtacttttttttctaaagagaaagaactgtcagatgttgggctatttcattggcaaaaggaagttaaatttaaaacataagcttttcagtattagaatgatcaaagtgagctataaaagaataatgttaatttaatagctaacacttcttggatattactgtttgtcaggcattatgttaaatgctaagaactttatatgtgatatctcatttaattcttacaagagtctaacagctgttactatttatcgccattttatagttgaagataccaagggttaagaagttgacaaacttgttcaagagcatacagctaatggccgagctggctttcaagtctatatttgtctacctctagcatcaagacactatttatttttctttgtatgaaatatatacaggcatactttgttttattgtgcctggctttattgtgacttgcagatattgcatttcttataaattgaaggtttgtggcaaccctgcgtcaaacaggtcatattagccccattttccaatagcatgttctgttgtcatgtctttgtgttatattttggtagttcttgactggccattcaccatttctctccctctcctcgggtctccctgttccctgagatacaacaaaattgaaattaggccaattaataactctataatagtctctaagtgtgtttttttttttttcgagactgagtctcactctgttgttcaggctggagtgcagtagcacaatctcggctcactgcaatcttcgcctcccgggttcaagcgattctcctgtcttagcctcctgagtagctgggactacaggcgccccccgatcatgtctggctaatttttgtatttttagtagagatgggtttttgccgtgttggtcaggtggatcttgaactcctgaactcaggtgatccgcctgccttggcctcccaaagtgctgggattacaggtgtgagccgctgtgcctggcccatctctaagtgtttaagagaaaggaagattcacatgtctctcaatttaaatcaaaagctaaaagtgattaggcttagtgaggaagccatgtcgaaagctgagataggccaaaagctaggccccttgcaccaaacagttagtttgcaaaggcaaaagttcctgaaggaaattaaaaatgctaccccagtgaataaaacaatgataagaaagcaaagcaggctttttgctgatatggagaaagttttagtggtctttataggagattaaaccagccacaacattcccttgagccaaagcctaatccagagcaaagccctaactctcttcaattctctgaaagctgagagaggtgaggaagctgcagaataaaagtttgaggccagcagaggttggttcatgaggtttaaggaaagaagccatctccataacataaaagtgcaaagtgaaacagcaagtgctggtatagaagctgtagcaagttatccagaagatctagctaagatcatcgatgaaggtgcctgcactaacagactttgaatgtagaccaaatgctttctaccagaagaagaagctgtctagtactttcatagctagagagaagtcaatgcctggcttcaaagcttcaaaggacaagctgactctcttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctcgcttaacatccattctgtagctcatggatcaagaagtaaattaaccttttaagtattattatttaagaaatacagtttgtaatgctttagcttctgtagatagtgattatcagagatgggtttttaagaggttttccagaaaaccttctggaaaatattcactattctagaagtcatgaagaatatttgtgattcaggagagtaggtcagaatatcaatattaataggaatttggaagaagtcgattcttattaaaatcaagagtttagtgatagacatactgagtttgggatacctgtggagtagtccagaagttaatttaaatatatgggcttagtgtacagaagtgagcagggtgcttatatatgaataaatattattttaagatatatttaaattttccttaaaataatacctatacttgatataaaaagttaattggaaattagtggcttatgacaagcataccagcccacactcttcccaaacccactttgctcttattcatagaagctgtcatcttcaaatcttccagctgatttccctggcgtgtgccttcttatttctgaatgacacgcttagagtactatttttttgacttagcaattttagaaattttctactcatctcctattatggtagatttcccctccttcattcctcctccaatataattatatttcgtcatattaataatttgtttatatatatttttaatataatatgataatattgtatttatattattaaaactacacaaatattatatacacactactaacccaaccgtgttattatggccaccactacctttatttttttccttgtgttagtgattgtctttgttttattttcttggttttgagtattccttttactaattttcttttttcctatttcaatctctcattatttgtttactcatttggagtgttccttgacttttatcccctcttacctagtgacattttaattttagttatcaaatttttaatttctaagaatgcttcttgttctcttcttgtttcttcttccccaccagccaaaaatctatgatgttatagcaaggatcatacattgtttcccagtaggttaagaaaccttggttaaaacctgttgtatcccagtaagttaaaagacgttaacgtgtcatcttcagtatggatgaaagaatattttctttcaaaagcagttggttgaggaagagaatgggacaaatgctctttttaaaacaccaattttgtgatgaactcaaattgcaattttaactttaccattataatgaatgtatttgatccaaaatgtttaaaatctaggctgttgtcatttaaataacaaattaccttactggtatcatgaagaataaatgtttgtactgatttggaaagacattctcatttaggggatgaaatagaaagtcaatgaggagaaagaaaagcttttattatttattttcttttaaatattttagtatcatggtacagtcaccagaaaaagcttacagttcctcacagcctgttatttcggcacaagagcaggagactcaggtaaggcttttgtaaaaaggtaattagtttatgataggatagttatgattctatgtatgcttaaaattctgtattttgccagcattttaaaaattgttcttaagctaagagtctgagtttatatttcagtttatattcattctaaggaaaaatgtggtatctgaagctctaaaaataaaggactagatcttttaagtacactttaaaaagtgttgtttctttgttttttgttcagattgtgttatatggcaaattggtagaagctaggcagaaacatgccaataaaatggatgttcccccagctattctggcaacaaacaagatactggtggatatggccaaaatgaggtaaactatcttttgcatgtgttctatttatttccttctaacaaaatagatttggaaaatatatctaagttgataatatgaccatagcttccactgtcacatctgggaggtgactcagattccccctgctgcgatgcttatctctttgccaagctttagtaccgtgtttctgtatgaataaaaaccagttacgttttcagcaatcatattcaatatttataaaatctaactcattatttacccaccctgcattttatccaaatgccgaaactcctctttttggattctttatttttgattatcttaccatcacatttgtagtcagaggttcctaatgcttaaaacctctgatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgcacctcagcctcccgagtagctgggactacagaacatgccaccatgctcagctaatttttgtattttttgtagagacagggttttgccatattgcctaggctggtcttgaactcctaagctcaagcaatcttcccgcctcagtctccaaagttctggcactacaggtgtgagccactgtgcctggcctctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctagcttagaattcaaggccctctatttatgaacttaaacttacttttccctctaagttacagaatttgaaatggtttatcttacctggattgtttatcacttgttgaagatccattttcaacttccatatatttatttacagtgttgcttctccttgtagtttccttgattcctcaaaactccttttaagaattcttgaagatctcgctttattactatttctcgctttattactgtaaagactatgagaaggtctttcatgatcttatcagcaaagtaattcctctctcttgaattcatagaggactttcagatgaattctaaagatgcttctgtagcacttaccacacaatgctatattttatttttttgtaattagtggtaaacaagtattattatatcttctagattttaaactccaaataaagatactagctccttacctttttgtgtgtctcctgtagcacctagcacaatgcctcataaacaggaggtgatcattaaatatttagaagaaattatttcccaagaatagttgcttggtaattgtatttgtcttttacttccttttaaaaaattgtttctgtcactaaattgcatccaatagatgttacttgagtgcagaattttctaatgacattacacagtgctacatctgacactaattcttttgttaaaaaataaatattctggccgggcgctgtggctcacgcttgtaaatcccaggactttgggaggccgaggcgggcggatcacgaggttaggagatcgaggccatcctggctaacacggtgaaaccccgtttctactaaaaatacaaaaaattagccgggcgtggtggcgggtgcctgtagtcccagttactctggcggctgaggcaggagaatggcgtgaacccgggaggcggagcttgcagtgagcggagatcgcgccactgcactccagcctgggtgacagagcgagactccgtctaaaaaaaaaataaaaaataaaaataaataaatattctaagaccatactttaatagaggtgttttttttttttttttttttttttttttttttttttggtgatagagtctcactctgtcacctaggctagagtgcagtggcgcgatctcggctcactgcaacctccgcctcctgggttcaagcaattctcctgcctcagcctccggaatagctgggactacaggtgcgcgctgccacccccggctaattttttgtattttagtagagatgaggtttcactgtgttgtccaggctggtgttgaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaaagaaagaaattataaaacatgattagttgtattatacgttgtttttggttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtcaatctgttgtaaaaacatgtcagttatctacttttaaagatgatactaaaaagtagttgtccaggctgctgatgtctttctatttcattgggaggttttgtttttaaattggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacattagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtgatcaaatcgtattctagtcccagctactcgggaggctgaggcaggagaatggcgtgaacctgggaggcggagcttggagtaagccgagatcgtgccactgcactccagcctgggcgacagagcgagactccatctcaaaaaaaaaaaaagactatatgaacatgtatggcataaatatgtacaaatattatttattttaaaaaaattcaggggtagggacagggtagttagaaaatatctaaggatgttcatgaaataatactggctatgaatgacagttgatgaaaccgggtggtgcccatcttattccctcgactcgtgtatatgtttgatatatcccacaataaaccttaaaaaaaaaaagatgagtggtcaattataggaagatataaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgagcccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaacccaactaccctgtaacaagacacattagacttttgagattgcaaggatgaggactgaaatgctggcctagaccatggtgttgccatagtggggtgaccagtctgaatagccaacaatgcttcctcagtaaatacccattttgtcttggtgggatttctataaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttgggtcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttacgatatattagtggttatagtacctaaatttgaatagtgattctgttcattcattcattcattcattcaatattcacttccaggagattggggacttatttaaagacagagtagttcacattatagttcctttttttagtccttcttattcgttaaagaaaagactaggaaatgtttgttattacaaatattttattaaaattttgtgtgctctagcattattttaccttttaaaatcaatatgttaaaaatccaacttctttttgagctccccataaaaagggaattatttgttgcttatgggtttaacttgtgttatttttttcttaatggctaattatcatacatatattctattattgtattgatattactgatcatttgtgctacattaaaaattctgtagacagacctcttttcaagtacaaaacctcaagaagaacagaagacgagtctggtagcaaaaaataaaatatgcacactttcacagtctatggccatcacatactctttattccaagaaaagaagatgcctttggtaagtgtgactttcatgttacagggaatttttttagtttacttaaacttgtgttttatcagctttttagtattaaagttctgacttgggatcaatttcctccaaccctacaataaatctcagtttatctttaattttaaaagagaatgttgttttctttttctgttaagcctccctgttaagtaatagcagcaagtttagtttggccatgaatatcttctagagattgtatcggggtactgataaacacatttgtagctcagggatactgcatcagccatattttaaaatgggactaacagtttaaaaactataaatattcacagtgttaagaaacaatctcaagatgcattaagaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatgtttttaaaaacttgcttttcattctatctcttctagtactgttttgatgctctttgaaaacaatctaattgctgtaacaaatgaccatacgtaggccgggtgtggtggctcatgcctgtaatcccagcacttcgggaggctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgagattgcgacactgcattccaacctgggcgaccgagcaagactcggtctccaaaaaaaaaaaaaaaaaagaccatatgtaatgtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaataaacagtccatagcttatcttacttactgaataaatgctctaatttgacagtcatgtttcttaaagttccttacaaaggccattgcccaagaaaccaaataattccattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcttaggactaattaatcaggagcaatactacaattagttggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgttttacctaataaatatctgaaatgtatttggagccacatttgtttaaagaactgtataaatatgtagcactgttcatgtgaagttcaatagtaggaaaatgctgacagcccttgtggaactgtggttattattattttatgaatagagccaatttcaaacacctattagagtcttctcaggaacattttatagaatgcatctggagccttatgttatctctaagcattttaggatttgtcttcttggaaattcatgtaaccaaaccaccatgtgttatttcaagtgtatatagtattgggttacagtttactatgttttcagaaggttgtgacaactattagacttacagagaatgacttctctgccactaacggctttctaaagtgaatagagaggggcgaggattgaattcttcggtaaagctgggtgattttgttttattcaatacagtataataagtataaaaagtagaacctatagagagctataatgggggtagttttaaagaaattctgaaaatgaaaaacttaagtaaaggtttagttcattgtttatttcacactgagcatttactacctgaatgttttggacattttatttccatgactggagtggacacttttacaactcactgggttctttgctgatctttctctagaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgctctcttgtctaggctggagtgcagtggcgtgatcttggctcgctgcaacctctatctcccaggttcaagtgattctcttgcctcagcttcctgagtagctgggactacaggcgtgtgccaccatgcccagctattttttgtattttttgatagagacagggttttccatgttggctaggcaggtctcgaactcctgacctctgatgatccgcccacctcagcctcccaaagtgctgcgattacaggtgtgagccatggcacctggccaatacactgagaaatttttattttccttttcagcttaaggttacaacttccccaccatccaaaacgtgcactttcattttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcaggtatagtaaataaataacctatttataagttatgtcaatgtcatgtttgaaatagaaaaccaaatactgcatgttcttacttacaagcaggagctaaagttggtgcatatggatataaaaatgagaacaggccgggcgtggtggcttgtgtctgtaatcccagcactttgggagacctagatggaaggattgcttgagctcaggagttcaagaccagcctgagcaacatagtgtgacccccatctctacaaaaaataagaaaattagccagacgtggtggcatatacctatagtctcagctacttgggagtctgagtcaggaggagtgcttgagctcaggagtttggggttataataagctgtgatcatgccactgtgctccagcctgagtgacacccagagtgagaacctgtctcaaaaggagaaaaaaaaaaaagtaacagtagacgctggggactactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccccccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggtgacagagtgagactctgtctcaaaaaaaaaaaaaaaaaaagaccttgtaccctgacaagttttagtttgtgcaggaatgctagaatgactcaagattggaaaaatctttaaatgttaattacacaataagggtaaaaggagaaaaattacctaatgtcatctgagcaacaagaagaagaaatgaaaggcattaaaaattgggaaaaatttatatttgacagtatcttaacaacgaattctgcttctatatcacttcctagctttctgatgataacttcccgtgcagatctgtatgtaaggaatggacgtagtagtcatgctaatctgagtatttatctgtgtgatacttacgaattaacgatgtaagttaataagttagcatttcgtgaacctggttaataccatttgctaaggttaaattagccaaatcctgaagtaagctgtaaaacatccaaggtagggtagagaggcatcttatgagaaagctggccaactctcctggtcaccttctaatcttcctaacttcagaaatcaaggcagagagaggaaaatagtaattactttgtaggattagatttatggttgtcgaaacctttgtttctccagtgcagaatgagatagcgttttagggaaagccaaagactcagatgtcttcttcatgctcatcgtgtggaatttttcttcctttagaaatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgtcgcttgatgatggggatgaattctgagaaatgtgttgttgggcgatttcattttgtgggaacctcacagggtggacttaaacaaacctagatggtatggcctactacacacctaggctgtacggtatagctcctgtcttcaaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctactcaggaggctgaggcaggagaattgcttgaacccaggaggtggaggttgcagtgagtcaagattgtgccactgcacttcagcctgggagacagagcgagactctgtctcaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtgatacgagtctacctactgtataacgtacctgcatatgtacccttgaaactaaaacaaaagttaaaaaatttatcttcttttgccaataataaattaaccttagcttactgtaatgattcttctttatgaattaaaatctttttactcttttgtaataacacttggcttaaaacacaaacatattgtacagctatacaaatatattttctttatatccttcttctctaagattttttctgtttttgattttgttaaatttgtttttactttttacattttttttgttaaaaaccaagacaaaaacccacacatcagcctaggcctacatgggctcaggatcatcagtctcactatcttccacctccacatcttgtcccaccaggtcttcaggggcagtcatatgcatggggctgtcatctcctgtgataacaatgccttcttctggacacctccagaagggcctgcgtgttttacagtgaacttctaaaaaataataaaatgtatagtatagcaaacacataaacatagtaacatagtcatttattatcattttcaagtattatatactgtacataattgtacatgctagacttttacacagctggcagcaaggtgagtttgtttacaccattaccaccacaaacacatgggtgatgctttgcattgtgatgttacgatggcatgatgtcactaggtggtaggaacttttcagctccatgataatctaatggatacttgttcctgttggctgcccgtcgttgactgcaacatcattatgtggtgcatgactgtaaattagatactgttcagaaagctttggcacactggtaatagcaaatggtggtggcaaatatgatgatgatgatgatgatgattgaagacatagatggtaaaattttatggtgtcttaaaagtaccctctaaatatgattatttttatagtctgtccttttgaataggcacttaagaatgtatgaacttaataagtatataagaaagaatgttccccaaaatatatcttacagaggcatacaatttaagaattcaaacaggttgtaatggggtgtgtgtgtgtgtgcacacgcgcacgcatgcgtgctcattcacactaaagaattcttgggcatatgttcctgaatgtcctaaatggacattctaacatcacttcattatgggcagagggaaatggtaaagaaaaatttcatattatattattcagccacatattgacagcatctgttttatttgcctatggtaaagaattgaagcactgttaatttgctttttaaatcatgtaggcacaaagttatcgaactttagatttagaaatgaaactggaaatcattacactttccctttcctatccccaccctgttttggagagaaagagtgtgaggcttagagagttataaaactgttttaataccatgtctaagattaataactgaacaagtttctctttttactcgtgttaaagttgtactgccaattaacttaaaagaaagaaatatgcaatttctaatcctgatataggatatgggtatataaactctaacttgatgagtgaaacaaattaacttatttataatcagtttcatatctttatttattgagtgtctttaaataccccttacctttaaagtaagaaatattaaaatcaagcagaatataataatgaaaaattcttaagatatacttactaaaaacttatccttcggttaatacactgtatgtaggttgtacatacaatatgaaaaagtatatttttgtagcctacttttaaatccagaatagaggaggttaagaaggttgtgataaccatgagctcttttttttttttttttgagacaaggtcttactctgtttcccaggctggagtgccgtggcacaatcatagcttactgcagccttgaactcttgggctcaagcaagccttccacttcagccttccaagtagctgggaccacacctggctaatttttaagtatttttgtagagatgagttctcactacattgcccaggctagtcttgaacccctagccttaagcgatcctcccacctcagcctgcctaagtgctgggattacaggtgtgagccactgagcccagccctcttttatttcttttgatagtacactcataatcattaaactatcatttctggatgtgagattgtgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagagtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagtaaggttaatatgatctcttttaaaacactgaaggcgtgtagccagtgttgtcattaattctgcagtagatattttcagcacttatttacatgggaagttagagcagagtaagatgcacctgtaaagctaaatgccacttatttgcatatatataaaacgcaggatgaatttaccatagaaatataaagggtacttatagaaatgtattagaaaaatatatgaatttttaacttatatctagaagttaactttatacatttaactttaaatcattaatagtggtttaacaccataagcggatgtttatgcatcatcattttatgaacaaaagacattctaattttagaaataaagtgattcaaaagagaataaaatatcttactttttcttttaaaattaatttgtttagcgcattacatgataatagctcaagcttgtgtgatttttccctaaaaaattggtttataaatattacatttatagtatgaagaaattaatcatacatagtttatttatctaatttctaaatacccatggaagaaaatgaatttaatggaatgtagttgtgtattacttggtttcgagtgtgggaaaatttatatggtctttctaaaacagcactgtcagtagaaatacaatgtgagctacatatgcaattttaaattttctagtagccacattttaaaaagtaaatggatgcaatttattttgataatataatttaattagtctactatatttaaaattttatcatttcaacatgtaatcaatatgaaaattattaatgagatattttacatacttttttctgtaataagcctttgtaatcaggtatgtactttatatatacaacaaatcttctgatgctaaattttaactggaaatacttgatctgtgtttagcttttgtaaaatttactgttgaacaacgtggactaatgtgcctaagtggttccaaacatattttaaaatttgaagacaaataaaagggaactcaaagtaaattgggatacatacatacaacagaatactgagccattaaaaaatgatgaaatagtaaaattgggggaattttgatgatactaggatgatataatgaccaagagacaaatacaattttagtttggttgagagatgtgatcatcacgttgctgattttactatgtatagaggttatcttttcctttctaagattttgaaactttaattagttaacccacttacctagtttctattagctgtgtaactttctcttcctgttttttgttttgttttgttttgttttttgctttttaactgcagtattttgaggagtcttggagtagcaagctaatctttggaagaaaggaaaatataaacctgaaaactaacaatttaaagaacgtcttttcaggttgtcatttgaaaaatacttgatttctgatcactgatttgaattgagtgtcaaatatttgatatgttttgtaaattaggtgaagatgagtgagtaggttctaaactgcttgggtttaccgcactctggagcattgcagaagaatgtgatgttggaaggaagtgctgaaacataattattggcttgcctataggagggtgctacataattttagaaggtgtcaagaaattgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatttttatacttgatcttaggcaaaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttcctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggtttagtccatctgtttagcttattatgtagaatgtcagcttaaattttacctgtacctcatattgaccgtatagcctggaaaatctttcggaggtatagttaatggatttaagcatatggcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctctgtgtatggcatgagataaatagcaatcagatatattgtttaataatatgactctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtacttgagttacgtctgtatatatagtcatgtcctagataatctaatggaacttaattagttggaaatctttatattgtttataactgaactagctataagaggaacattaaagaaaacatattttgagtggaggtaatgaaatttagcttctaatgctcagccttttatttctgtaatctataccagatacctaagaccctcttattgtttcccagcttcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtggggagaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataattctgattcaatatccataggtacatggtggattctttaaatatttagtattcttttatttctggaaagttttcttaaatgatagtttttttaaaatttcatttctataaagttttcttaaatcatactttttagtgttttattccattacttcatatttcttcttcaggaactcctgctatacatgtatgttggatcttcattacccagcttcaatatttttcacttttcatgcattctttttatttcttcatttctctttaaatttttttcttccttttcaccttctatttctcttttaacataattgtatttatttctgtattccacatagcttagtattcacttattttaaaattattttaaaacgttttttagatttaaaaattctttttttatttatatatacatattttatttttaccaaaggagcaacactattaactgaagacttctataatttttttcttttatttctgattctttcttcggttttccccctcagttttgaacttttctaattttgatttgtgatgtccttttgtattttagataattttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttttgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgcaggtcttaattgctgttggtggtttgcccctacattcttacagttttagtttcccaaggatacctttaaacttggttttattgtaaatgtcgacaatggattttgggttttactatctagttctgtcttaattctggaattcagaaagattaaaagctctgttgttgcagctgctgccacctcttcccagtaccctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtatcaggctcggtaactaaatatatggattgatcttgtttataaatgaaattaaatgtgaatgtaacttacatatttctgtatttgcttacatccgtatgtacacatataatcagcaaatgagttgatgtttcctattcgtaacttaatggtaatagcttggtaacagagttgggagtattaaaaagatgtaaagagccccttaaaattttgttgctgggaattttagtgttctactgatgaaggaaatagacactggaaggcgttgtttctattaggtaacttagatatcatactgaagacttcaaatacttattgttgacactcaaaagacacacttagtgtaagtaagcatttccccgcttttcccaatgaaataagatcattattataattccattataaatgctgatgatcatatttatagaaatatagaagataagacttgaaatgatattcgctaccaattaatgagtttgaagaagaaatcaggatgtgttttgctattttacatttattcttatttaactccaaagaattcagtgatgttatgtactattatttccatttctctgtgaagacgttgaagcttaagtaacacgcataataaggtcatacatttagcaagtggctcaattaaagttcaaacctggttctgcctggtttcaaagtctgtgctactccatggtattaggctacaacatgacttagggtttcttcctctgctctattgctgttcagatgtactcctcttttggcagagtgggagaaaatttttgcaatctatgcatctgacaaaggcccaatatccagaatctacaaggaacctaaacaaatttacaagaaaaaaaaaaaaacattaaaaagtgggcaaaggacttgatcagacacatctcaaaagaagacatttatgtagccaacaaacatatgaagaaaagctcaacatcactgatcattagaaagatgcaaaatgccttttctgtatgccaccttatatccccagtatttattatttctaagtcatagtatcttacagtgtatataagtctcatccgttcttttgattttctcttccctgcttgcaattgggtacctaggaacaaagttgcaatcttagccagttttttctttagcctttgctgatgtgtgaaaagcccttttttctaccctggatttctgtacttaagctggaacagctaagtttttaccttttttaaatataaagtttcagagtcttctgccaaggatcttttgctgttttcctactgttaaatatttcaaagccttttttaaacatagggaatataatcaaacatagcaagcagctgatgaacaatatctagatagtcttcattattgaaatggaataaatggtatttttgtattttaggctaacagacaccttgtaccttagataaggccaaccttctcataaaatccctcagttacttttattaataataaccaaattaactctggattccagggtgtactcatgatggaatgatttctctgtcatgttatcctgaggatctagtactctgagataacataagtgtatgacactttaggcttatgaaacacttagctacttaaattatttaattttttttcatgtgcagatggtattgtacccaaacactacctttgtgtgtgtgtgtgtgtgtgcctgtgtgtgtgtttttgagacagggtcttactctgctcaggctggagtgcagtggcgtgattatagctcactacagccttgacctcctgggctccagtgatcctgccaaagtgttgggattgcaggcgtgagccacctcacccagccttaaattatttttttttcaaggatgtttaacctgagggttagaggctctttggcacgtgagctgctgaaatgtgtgtgaaagtgttgtgcacgtgtatgtttctctttttttctgggaagtggatctgtagtgattcttagatgagtctatgagacaagaaacttttatttttttcatttatttagcgaatgtttgttaagcgtactatgccttggccactctacagggtgctgattggaccagtctgtctacctaccgttgtagatgttagaagctatattcttttcacatgcctaatataactctttgtgtatgtatacatgcccaggcatgttccttcctcagaacattaaattcaccattttggtcaactcaaagcaagtacaccatgggacacagatctgaaataatgtccagatttttacttactgaatgaggtgtgttgagtgtataagactacatgatgagatggcaagtaattgcctgaagaaatgatgtagtgattttgtgtgtcttatatttatttactttttgatccagaaataaattatatagataccactattttgtttggatgggggagaaaggatgggtgtgtattcaggaacttatgttacttttttgcaactaataccccttctcagtagtacaaagatttgatttctttttctttctatttcctacagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttaagcagttcaccatccatttcaaagcctttgattggcttttttgtaaataaaaataacttgttaagaaacaaatatatctgtcatagaagaactagaaaatccagggaagtgagaaaaatgaaaataaaaatcattcatagttttactagtagctaatcacagtcaacctcttttgtgtatcccaccagacttttttatattcatttgtttttagttaaaatataaaagtctcgtatattcccatttttctgcattgcattaccagaaggtagtggcgcctattaaatatgtgatatgttgttgtccagccatggcttctgcatttgcatgcttttgtgtgtgcatctgcaataccctgtgaatatcctgtgtgatggagtggcaagtacgcacagacacgtctgctgcatgcctaggtacgaggctgtctccaggagaagcacttgtttgattatttgagttgccaattgaatttgctgctttttttcatggcttgccattttcactgaaaagaatgactaatgaaaaacgatgattggttattagatttggatgtttggcagacattttctcaaaattgaactaagttggcctcttcacggaaaacaactggtatttgttgtgccaatgataaaattggagatttctagcaaaatgtataattttggaaaagttgtgttcctccactggaagcttgacagctttccttaacataaagacttctctttctcttcgctttcactactactactactaattcttcttctgattcttcttcttctccttcttccttcttccttccttcctcctcctcctccttcttcttcctcttcctcttcttctttctctctttccttccttcccttcccttccccttccttccttccttccttccttcctccctccctccctccctccctccctccctcctttctttttctttctctttctttctttctttctctctctctctctctttctttctttttctttctctttttctttctttcaagcagtcctcccgcctcagtcccccaaaatagtgggattacaggtgtgagccaccatgcacagccttacataaagccttttctaatgagatggatagtaattaacaaatgtgagtttttgatattatataaagattttttctgtgtttcgaagatccgtataactcagtgaatcagtatgttctggatgactaatatgtgatgttaagaaatcatgactgaggccgggcgcggtggctcacgcctgtaatcccagcactttgggaggccgaggcgggcggatcacgagatcaggagatcgagaccaccctggccaacatggtgaaaccccgtctctactaaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctcaaaaataaaaaaagaaatcatgactgggtaaaagatctgttcagagtacaagatggaccaatggatttgatatatttgaatataacagagtatgaaaaagtttattgatatagtttcagattacacactgcaactaatctttaagaaactattacttgtccactttttggtaaaatttcagagaacaatgtccaccattatctgaacaggctattaaaatactcttctcttttccaactacgtgcctgtgcaaagtcagatttttttcatatacttcagccaaaacagcatatcaaaatggattgaatgcagaagtagatctgagaatacagccacttttgttaagccagacaatgagatttgcaaaatgtaaacaatgctgctgttctcagtttttaaaaatatgttttttaaaagtatttatgttaatgtgtacttggtttactactgctatttttaaataaaacaagaaacatttttaaatgtctgttttaatttctaaagtggtagtgatagatataacccatattaataaaagctctttggggtcctcagtgatttttttttaagagtatggaagggttctcagacctaagagattgagaaatgctgatgtaatgttttattataaaggtgtaccatgaattatgtaccttacttcatattgttggacattaaagttgctttcagtttttttgttttaaacagcactgctttgaccttttttaaaaaatgagtcagggtcttgctgtgttgcccaggttggagtgcagtggctattcacagacatgatcatagcatgctatagccttgaattcctgggctcatgtgatacttctgcttcagcctcctgagtagctgggactataggcgtgcaccactatgcccagctgctttgaacattcttgaaatgaaatatggtatagtctcataccatatcatagccagagggggagagagagaattttgttgttgttgttatgttatctgtagtggactttatgccttcccagcataaattctctctttccccatttttcgtgactcttgatttttgttggggttcgttccaaggagaataatttccatctggatattggattggcacctgtgacctcttctgagctagaccctagtaacagcgtttggatctggggtaggtgtgtggccaactgagctgctggttcatgcctttcctgaaatgagccctacctctgaatatttcagaaacatgggacattaacttccctttacttacgttaaacccctttgaatgaggagttgtttttcacttccagttgtgttcagttgtcacagaagcacagcgatgtgattggtggaaggacccgtcaacagacccagaagatgtaaagtgtttttaatctcaaaggatgtggaatctcagagatagttacaccgagtagaggatgaagcggctcctggatggaggcagaggcttcctggatcttcaagttctgtatgggttgttgtatgaggttggtgcaaaagtgaggcaggagaatagggtctggaggcaaggaaactaaggccgattcacactgacttcctagaactaaatcaaaaggaaaaccccaattttccagacctaaataacaaaagtaccagatggctcctccctttcaactgcccctcccccacacctttctgcgtggcacatggaaaattgaaagtatctctggttgcttctgcgtaggaatgtaactttgtaaccaatcagacggatcgcaggccaagtcgcctgcatagaaatgtaactttgtaacttcactttagcctctgattggttgctttccacaaccaatcagatgcttgcatagggtgtacctgttgtgacttcacaaagtggtggaagtggtggaagtggtggaagggtggaagggctatttaaatttttattcatcctctgattggttgtttcacttaagcctctaattggttcttgagtcctggagcctgtgaagggtactttattttcagtaaatgcatgctttttttgcttcattctttccttgctttgtgcattttgttcagttcttagttcaagacaccaagagcctggacaccctccactggtaacaaaagtaactggtgtttttgccattagaagtaatggcacagaacaagtacatgagagcgatttcttatggaaaattaaatggcgcataagtcgtgtgctcaggtaagggagctgggaaccggtagaggaaggtctccaacccacacccgtgggatctctgagtctttgaaagtccgtcctcaccctttgtgaagaatgggagcacggctggactcgtcaccgggggttttggggggctgaacttgtcatttgagggtgtagggaggttggatgaatcgcaggggtgcagggagggggcccactggagctccaccaggaccccagcaccctagatccaaacctggtcatgcttcccatgctcagaggcaaatctccctccccttggggggcggagtcagacgagaccccctctccatccttttccaggtccggcgggggcgggactttaaaggtaaaaacagcaattacttttgcaccaacttatcttctaagtttcgctccctaccacctgagtgtgtttggaggctctggctcattgtacctgcctgatcaccaggtgcaagtagctgggccagaaggacctcggcacgttacggaatatttactacaggaacaggtgagctgaaggcgaattccccaggtgtagcctgtgaccatagattcagacaaagccctgactgttgcctggaattcaaaaaagctgtagccctaccagatagaataagaaaagaatataggattcttcctattcaaataggttgcatataattaagagcatgaacgatccaatggaatgaactcaaagtagtttttgagtgtaatagacttgaagtgtcttatggaaaagaattgcaaaaccacagaaacagtgaagaaggttagttatagccttgatggggtagctgacttcagcagtctcagctatctgaaaagttatttaccagattttggttgggaacataatccctaaatcatttgagataatgtacttgtttccttactgggtaaatgtgtttaaaccttgagaaaatgtagacataagtagaatatagaataaattaaacctttggtagttatgttttaggattaaggactaataagtacatatttgatatttaagcatttgtaatgcttgagataatttatcctactcaagtaacagattactcttgtgactccaatgtaaaatatatcattgaaaaattagtatctgcttgtgatttttaagtagaaaccctgccatttgaaaggtatttgcctttattattggagatatttcatatgaatgtttaactttgttattgcatagaagtatttaaacagatttcacttgcaagagaaagatatctaataggttactcttaatcagtactaaattactacaattactatattctattaatatcgattcattaaaacccagagctttaattatgtctcagaaaattaattaaactttagcctcataatcagctttattttctaactcaatgtttaaaaattgacaagtatgtattatacttatttatgtcttcattcagtaaacatttgcatttgtagcatgcaagacaacatgctagacacacgaaagatggaataaatggaagaaaatgcaacacagatctcatgcttaagagggacagatttactctgaagattcaatgaaaaaacatccacaaacaacttttctacaagaaacaaaacattttaaagaaaacatttacttcagccgggcgcggtggcttacgcctgtaatcccagcactttgggagggcgaggcgggtgcatcacgaggtcagaagttcgaaaccagactggccagtatggtgaaactgtgtctctactaaaaatacaaaaattagcctggcgtggtggtgtgtgcctgtgatcccagctactcaggaggctgaggcaggagaatcgcttgaacctgggaggcagaggttgcagtgagctgagatcaggccattgtgctccagcctgggcaacagagcgagactccgactcaaaaaaaaaaaaaagaaaaaagaaaaaaagaaaacatttacttcacataataagatatgagaaaaaatggactctctgaatgaaaaaaagaggagatcatgtgaaagatttgcgctttttttttttttaaagttatggactgaaacactcctaatcattaacatttgttattttaggggagtggaattggaaaggtggaaagggctatttacatttttataatctccatgtcttttaaatcaatatatattgcatttattcttttagttaaaattttaagaactctataaaaaatagagacagggactccctttgttacccaggctggtctcaaactcctgggattaagtgatcctcccacctcaattagaagggtggaagggccagctgtttaagtttctataatctctgttaaatcaaatgtatattgcatttattattttaaattttaaaaacttttttaaaaatagagatgggatcttcctatgttgtccaggctggttgtgagctcctaggatcaagtgattctcccgccttgacctttcaaagagctgggattacaggcatgagccaccatgcccagcctatttatttgtttatttatttttagaggcagggtctcactctcactagactgaagtgcagtggtgtgatcatagctcactgcagtctcaaactcctggactcaagcaatcaactagcctcagcctctgagtactgagatgacaggcatgtgccttcatacccagctaatatttttgtagagatggggtcttcctgtgttgcccggaagagtctcaaactcttggcctcagcctcccaaagcactgggattgcaggcatgagccacaacacatggccctgcttttaaaaaatatatagtgggccaggctttctgggatgatgggcaaccattacatttgctttctctccattctgaatgtcagcctccatacacctctcttgagccatctcttgatgcccaggactggcaggcaagcaggatgttagggtgctggctggagggctggaaagccccagggcaaggatatgaacgtgaaggattttaaggagattcttggacctcaagggaacttttggtcctggtttcctagagtatgttagatcttcttggcccccaaagaatcaaggaaaagctgaataggtggaccgaatcctttccagcactgaggctgggagaactctatgacaccagtgggtgctcatcctggtgctgccatggacctgactacctacgtccgctaaactctccagcagctgagccttcaagagaagacgtcctccaccttttccatgagatgaagaatccttggggccaggggatgtgctcactagctcacacctgtctccatcctctagaccatgcttgcagtacacaggaccccagaatgcctggcccaaacactcgtgagcctccaggggctgcaggggcttctggccttgtttccccatctgatgagttcgtttcttggtctgaaagattgtgacagttactacgagactgaatgaagggggatgaatgcagaaatgaaaacttaagacaaaagtaacttttaatgagaggggccgagggaagaagaagagggctccctgcttctaatgagcaaaggcagccaccctgagcttctacagcccttcgtatttattgagtagaaagagcagggaggaggaggtaatgattggtcagctgctggattgatcacaggttcatattattgctaacaggcttcagatgtgcctgatcacaagaaacacttgcgcctgggcatgactgccctcagcattccttctgggcggcagatgcagtttgtcagtttgctaacaacctgctttcatgagaacagtttgctgcttacttacacagccaccagtgatttactgagttgatcacgaccctcactctttcggcctccaacaaaagacgatcaaagaatggttgtttgcagaggttatggacaagacttgatgtccaggccgagtgtccgtatgcacaggagcctcttggtggtgcagagtgaagccagaggaggaggagtgggttgtgtccatgggctgattctccctgcaccaacaggacagaatcctaaggaatccgagcatttgaaattcaaatctggtcttacaggttgttatgtatttgtctaggtaggaggctagaatgtattgaaatggggttagcctgacatatttatatatttcatatttaggcttccatttgttcctttgtcttgggtcccaaaaatatattagaggtgggcctgtctgttctcttggacacgaggacctcaacgagtttccactgttctctgaatgtttccttcctggttttctgtgtatacaataattcctagttttctgttatttacaattttacttccactttttaaagacaaaaatgtatgtttttttagtcaatattgatatagtggaccaatatattttaccgttatttttgcttactgtttttgtttttttgccttcctcatcttctcactaagtttgtctgactacagccacacaccattcattcaataccaactcttttttatttttattttttggagagagggtctcactctgtcacccaggctggagtgcagtggcatgatcttggttcactgcagtctcaaactcttggactcaaatgttcttcctgcctcagcctcctgagtagctgggaccacaggtgcacacgaccatgcctggctaattaaaaacaaaacaatttttttttttttagagacggggtctcactatgttgcctaggctggtttcaaactcctggggtcaagtgatccaataccaactcaacaggtggtgagacccagtggtctagacaaacagccacatagcaatatgtttttctccatgattcatatccatgttcgtttgttacaaaataacaggcatgaacattttcttcagagagggagatccccacttatccattaatgactcatttggtgtccattccaaactattaaactgcaaaagcagacatgagaaaagaaacttaagtcaatgtttttatcacatgttggtgccagcgtcccatagtggtgctaaatttatgaaattgcaacaaaacaaaaacccaaacaacccaacaacgaaaagctatttagtgaacaccgtgactaacaagcttattagaactgcttatcagagctatgtgtggattttgtagggggaaagattttcttccctcgtagacattttgcaaaataaaagtaaaatattacctttatgtacgtggtagatagaattccacaagcttcaaattcaacgactcaaaaatgttgcttttactttccatatctcagaagtcacttttattttatttattttttagagatagggtctcgctctgttgcccaagctggagttgcagtggcacaatcatagctcactgcagccttgaactcctgggctcaagcagtcctcttatctcagcatcctgagtagctgggactacaggcgcataccaccactcctagctgatttttaaattctgtgtagacataggatcttgctgtactgcccaggctagtcttgaactcttggcctcaagtgatcctcccaccttggcctcctaaagtgccgggattgcaggtgtgagccaccatacctgcccagaaatctcttattttaaaccccaattcctcctgatagtaaaaaaaaaaaaaaaaaaaaaaaaaaaaaaatgtcatcttggtgtattttgggtaggctggatcacttcaagtttccccctcctcctgaagctccgacagaggcctgcaagccctgctgggatctgtcctcagtccctctcgggctcatcttctaccatcttgctgtcactccatctccctgtccttccctttgcttcacccataccagaccctgtactgtttctggaagacaccaggcatgctgtgtcttaggggagaatgtgatttcaccaactagtgctgcccaagtaacatgcatttgccctgactgctcttttcacctgctgtgctgttcccccagataaccacaggcaaaccccgccaactcctagtttattgaactataccatgagtaacttacttaaaatctccataccttgtcccattctctcttacctgttccaatacttatttatgatgttgatagatgatctccctctactagactggaagctccttgacagcggggattcttgtctgttttgttca

SEQ ID NO: 1205 - DNA, 37843 bp, Homo sapiens
atgttagctatgactatattaaatctcatacagtattataatagggagaaaaatggtttcaaataggatcagaacttttaagactttattataaggagattttcaaaacctcaggcttttcatatgtttaaaaaaaggtttgagtcatgggtcttagaggcttttgaaaaataacatttaagttgtcaaaggaatttggttcttaagatatcctttgtttttaatatggtgcacaaagttgacagattgtccctgccgcagtgtccagggtcacctctgggcagctgctcctggcttggacgtatttctcatgaggcagacttttgccagccactctgtgtaactctgacttcctaaatggtgaccgactttttagagactgattcctagtaaaactattttacaagtgatcccactttaagttctgtgagtaagaagtctgatcacctcaggatggtgaaaccgagttcttctggagaacatattggaaataataaagttatgtgcctgatcagttgtttcgttactctgtctttttcgttgttgttgttgagatggagtttcgttcttgttccccaagctggagtgcaatggcaccatctcggtcaccgcaacctccgcctcctgggttcaagtgattctcctgcctcagcctcccaagtagctgggattacaggcacatgccaccacgcctggctagttttttgtatttttagtagaaacggggtttcaccatgttagccaggctggtctcgaactcctgacttcaggtgatcttcccgtctcggcctcccaaattgctgggattacaggtgtgagccaccgtgcctggcctattttgtcttttaaaagctatttaaaaaaaaaagtatgtccactttttcatctctctcagtatccctgataacctaagcccttagaactgttgccatacacggccagggtgcggggtggccagagatggcccagtcccttagtggtagggctcaccctcttgtccgcttggtatccctgtgggagtctctgtcgtggatggagacttctcttcatggctgtgagagaggtgcaggcctgaggcaagaggagtgacgtggcttttgtaaggagcttctcacaactgttttccagcccatttctggagagggagttttaggagccccacaaatgttcattcagaaaactccctggaagatcccaaggatttgaagactggacttctggaagtttatggggacttagcagcaaattgcttacaatgaaacaaatgaactcttatttgggggaaatggattttaaattgcctttggaatagtgatcttattttaaaatgtttacagatttccagaaccaaaatgatagattactatctgcctctcgatgaattttgagattacacatttcttcttaaacagcattgagagggttggagcagtgctgtgtgactgcttggtgtcgcttccttggaatgatgtgaggtgtcacacagcagctctcagatcccctccaggaattacatgatgcccagagagagcattctggacattatttaattcctggaggggatcacactgattgtttgaggttcttaagttttgaagccttttaagtgcagagtccagttctggtgctgagtgttgtaacttggaccacactcccacatgacagctctcagagttgttctgttttctcgtgttttgtgtctttgccgtgataaaaatgtagcagtgtgtgaccagtccccagtgttagaactgtggtcagtgttcatggggctgtagcactgccagcctgaaccatgtgacatagatgcacacacttgcacggactaacgttttctacatgactttggaaattgcatcccgtaaaatgcatacaactgaataatctttccaaataagagtgactgtttttattaactagacagtagtctcagacatcttttggagggtttgttcagacagagactgtgaggccccacccctgagtttccaattcctgagtccctgatctcagaatttgcatttcacacaagttcccacagtgctggggctgctggcccggggccactttttgagaatcgctcaaggaccagggtgtttgcagcttgctgtttggctgactcctaacagtgactgtactgaaaggttttgaatgccacgtgttcaaacaaggcagttcgcaagagtggtaggaagagacgttgaggattcgagttgttctttcgtttcgtaaaagggggtttgagggaaggttgtgtagctcttttaaaaagagttaatggcggccggtgcagtggctgatgcctgtaatcccagcactttgggaggcctaggtgggtggatcacttgagatcaggagtttgaaaccagcctggccatcatggcgaaaccccgtctctactaaaaatacaaaaattagccgggccaggtggtgcatgcctgtggtcccagctactcaggaggctgaggcaggagaatcactggaacccagtagggcagaggttgcagtgagccaagatcacaccactgcactccagcctgggcgatggagtgaaacttcgtctcaaaaaaaaaaaaaagttaatggccactttatagcaagaataactgagtatgtcagatgataatttacttgtgatttggtttgattttatactttgttcttgagtggttctaggtagagaaaaacctgtttgggactccagcaatgtctgttgtgggcttcattgggatgtttttgttttgtcctggttgggacattttgggggtgagttttgcctggggataaggaaattcaggtcttgcttttggtgcagttgttcggcaggggctggctgagtatctgccatgtgccaggcgctgtgctcacagcactgctgacacacgggtgggtgccctgggctttcagcctcatcccagtgtcctgtgtgaggctgtccctgtcacccctcaagcctgtgcctcagcctcacagccaccgtccttggctttcccaggaactgctgcgctcatgttcgctgtcccatgttgcatgcagttcacgttcagaattcaagtaaccctcagtatcggttgctttagctttaaaacttcaggggagtttatgttcaaaggcatccatggtggtggtgaacaacgatagtcattttatgactgtccatcatttaagttatagattatttataggctgtttcatcaagtattttaaatacatcagatggaggaaaagtaaatatatgtatacattcctgtattcctttaagtggagaaccatgactttatgttacattttgctttctaagtagaaaaatactggcttcagagtttattttactaacaataaagttgatttcccagcttttaatatagaaagataaaaaatatgacagtatatttatgcatcatcttttagcagtgagttttgagtgtctcttcatgatcccttagtggtgacgagtctgacatgagccctggagcaccctccctgaaaagcatcagactgaaggcagagcctctctgctcccagatggttccccccactttttttttttttttttttctgagacagagtcttgctgtgtcgcccaggctggactacagtggagtgatcttggctcactgcaacctctgcctcctgggcttaagtgaatcttgtgcctcagcctccagagtagctgggattacaggtgtgtaccaccacgcctggctaattttttgcatttttagtagagacagggtttcaccacgttgcccaggctggttgtgaactctgggcctcaagtgatccacccgcctcagtctcccaaagtgctgggattacaagcatgagccaccacgcctggcttttttttttttttttttttttttttttggtaggtggagtctcactcttgcgtaggctggagtgcagtggcgtgatctcagctcactgcaacctctgtctcctgggttcaaatgattttcctgcctcagcctcccaagtagctggaattacaggcacatgccaccatgcccagctaattttttgtattttagtagagatggggtttcaccgtgttgctcaggctggtctcaaactcctgagctcaggcagtctgcccgcctcagcctcccaaagattacaggtgtgagccactgcagctggtcttttttttgtttcgttttgttttaaagagagacagggtcttgctctgtctcccaggctggagtgcagtggtgcagtcatggctcactgcagccttgaccacctgggctcaagtgatcctccacttctgcctcctgagcagctgggactacagatgcatgccaccacgcctggctaatttttgtatttttgtagagatggggtttccccatgttacccgggatggtcttgaactcctgggcttaagtgatcctcctgccttggccttccaaagcattgggattacagacttgagccactatacccagtctagatgagccactttttaaaagtgcaagtctaaggacattttgagtttgcatatggtactttaaaagaagcattttgctgtgaaagatgcagagaagctgtggtcttttctcctgggcactaaatagagtgagacataggactccccggttacccaagcaagatgaaggcaaggtccctagagcccccagtgtcacagaggcgttggagggggctttgcttgtgcttcctgttgctggttgaccgatgtgctgatcgtttgtccttgcatgtccgtgtccgggttgcagcatgaagcgtgccagctctctgaatgtccttaacgtgggtggcaaggctgctgaagatcgctttcaagtaaggagcctaccccgaattgtgtcctaggctgcccagaccacgctggcaggtctgctgcagacccgcactcggcccctgctcggcccctgctcctgcagagggctggggacgccgccacgtttgttcctagacagacagttgtgacagtagtatttttatattctgcttaaccactgattatgtgaattatgggcatgttcacactgtgaacattctcagaatattaattaatgatctcaaatggtctttaaaaatagtttaacctaattaatgtattctgttaaagtactgtcaaagctcgaccaattactagtttgtatgattgtttgattttagcctctactaagtttataactattaataattaattgtctacttaagctgttgttcagtgttcagaagtattcaaaactctgttaacatgatgactagcgtgctgtcagtttgacactaaaacctgaagcactcggtgcagttgctcgggcctcacacagacacatcaggtttacatctgaaagtactgcctcccttccccatcacggaggccgtttgagttttcatccactccgccctttggtgtggctgtcagtgggtggccgggtgcctgtggctgctctagaacctgtttctcaggtgcctggggcccacccggcagctcgagctgttgggacttggcagtccctgcccctgtgctggtgctgagagttcgcgacagtggccaggcactgccctcccagttgtccagatccactaatcctcacagacaggccagtgccccgacctgtcccccaacactcttgggaggcagccatctcgggaaagcttttccccagcccccttctcggtggctgttaaagaggcttgtagggtgctggacatgttgcttgaagcacccctaatgacaagaggaaagaaagtctcttcattttacagggtcctgtagctgacccagtgtttgccctccagtttcttggagtttctacatgcacattgacccctgggcctctcgagtgccaacctagatttagctgtgcagctggtactgttaggcctgaggccatttgaagctggcatcatttgaagtcctggttaagtgtaatttttctatttgttttttcatgcaggaacgaaataattgtctggccgactcgcgagctctgagtgccagccacactgacctggcccactgagagccagcagggctaggtaacctgtcttgggagtgtgagaccgccccgccctgccacgcccctcaccgccctgcccggaggcgccagccgcactccttggcttcctttcctagatagtgacgtccaccaaccttggaggtgccttttcaaaacacccgggaggccgtgcctcagcattctgttactcggcctgcagccccagtgccaggagccaccccgaccgcgacccggccaggctggctcagggaggccgaggtggcgctgaggtggcttcagcacgctggggattggctcctgctcacggatgctgttgcatttcctgcctgccacctttttgccatgacaccagactctcttttaaattgtaatattgtaataaggctgtaaattaagaatctggaaacataaagtacccctttcagaacgataggcatttagtgatctatggcagtaaagcctgaagcttagcggacactggtcagtgggaagtgaattccttcccagctggagcatcttccgggtctctctttccaaggtccccatgcctgtggccctggggccccatgcccccttttgagctgtgttctcccggacgcccctgcacacgaagcccatagagacgtgtgtttcactttttttttttttttttttgagacggagtctaactctgttgcccaggctggagcgcagtggcccaatctcggcccactgcaagctccacctcctgggttcacgccattctcctgcctcagcctcccgagtagctgggactacaggcacccgccaggcggatcacaaggtcaggagatcgagaccatcctggctaacatggcgtttcactttttaaaagcttaagctttatggaatgagggagcacggtggactctgacaggaaccttttcaaatcaatgctgaggctgtatttcttagccgtccacaaactagtccataggtaaagagcatacaaaacagacgccgaggtgatcagtgattccaaaggctgacgctcagcagcgccacctccatgccagccaactaggctacgggatggaggggcggtctgtgaaacaccagccatcccgtgaaagctcagcttgccactgtcatgtaacagggtgggtggtggcacagcagaggctcacacttgtcaccttcagcctctagaagctccccgtggggcacgaaggctggggacagagtgtcctgaggttttgttacaaggctagactttaaaatacctttcaaagtttcatcccgcctcatgtcgcaggactgctgtgtttgtgaaagcgcgtttgtttccacaagacaagctccgtgtagtcgccagcgggtgcctggcccaggagctgccctgtggagccagcgttgtccccgagctgctcgcctgtggccgtggctccttttctgaggctcctgactccattcttgcagattctggtggatcaggagcttacattctaaatgctacatagaggtgttgaagaaaatttcataggttctgtaatagtggatgggattaaaagaaaaaatgttaaattatatatatatatatggctgggtgcggtggttcatgccagtaatcctataatcttagcactttgggaggctgaggcgggaggatcacttgagcccagttcaagaacagcttgggcaacacagcgagtccctgtgtctagcaaaaaaaaccatgtgtatatatatatatatgtgtgtgtgtgtatatatatatatatatatatacatacatatatatacatatataatttgatgggttgtgagaagccaaccccccccaaaaaaaggggggtgtagagcagcttcccctgacaggtgccgtggctgcccccgtagtgggctatgtctgtgcacaggcgacagggaggagggctccggagcttcccttgtggtgggggtgccttctccctgtgaggatgctgagcagagtttggaacccagacagtttcccttagtgacagttatctggaaaggaaaaagggcatttagaaggaataaacatagggctgaatatggagttgaattttaacctcttcagactgatgggtgcagacgaggttgtgtggggcctctgtggagcctgctgtggcttccagccatgggactttagggccgaggtggcctctgcagcactgtggctgtgggagcactgtgtgttggggtaagagaagccagggggcctccctgaagccagctcataaaggaaggttcgtgtttcagagggaggcggcaagggaatctgagtacctgagtccccgatgtttgaacccttccacccaatagaagtgcggtgatttcagccatttcccatctggcggtctgaatttttcccttcagaggagagaagtggtgggcccaggcatccctcctcctgtgtgtggtcgttctggtgagaggaaccccacgcgagagtcagcacctgtttcttcagagttgctgtcaaaataatcactgcgcccccgccccccgcccccccccacagcagccgtgtgtgcagcgcccgtccccagcaaccatggcatgggagcgtctggatctgtgggcggacagcatatctctgggtagttggtgcagctgtggcagaaatcaggcccctggggaagtcctgtgacatggatgcttccctgaagcagcagcagtgtgtggctcaggggtcctcagaggccggtggtgcccgcgggtggcacggggcactctcatgggcagcacttggtcttgtgtttacagtattggagggattcacatcgttgttttctggattaagctgctaggagtatcatgtacttagaaattcagtgtttatagtaagatgtattaaacattgctaatgatgtatcgttacaatgtataacaggttttccattgtcataactgtatggaattttcttggaggatgtcattagcttctgtttgcactgacttgtgagctgtgtgtacgctgtggtcagatttctgaatgctgtagagcacttaccagctctgaccgtgtcttgctggggccagcaggctgcgtgtgcagcggggccagctgtctcagggctgatatgtagacgtgtattctgtttacaattagttccccaactctgtggggaagaacttaagcggttttagtgttttataatatggtgaggcaatgagggtcagggcgcgtggtccctgagggagggtcttcagggcaagacccatggccctggcctggaactgtgctccccagggcgtggtgcctccctaaggggatggtcagtgttctgggactgactgccaggccagcccgtctgcagactcctgtggtgggagttccctgggacgggaagcccctcggccccttccctccaggggcaggaactgagccagcatgggcggggccggccgagcttccaggcgtgttttctctgttaaatgtacctctgtctttaagctgtctcattttctaatcgctggcatgtcttgcctagaaaagcatttggaattgcttatgttcaattacagaaataaaatgtcttacttgccattgtagaattcctgcacttttgcagaaaggctgttttgtaaaaatccaaccccaaaataactttttcccatgttcatgccagtgattcttaactttagggtcatagagagccttgataacatgatgaaggtttaaacggattgtcccaccctggaaaacggcaaacagaaaaattctgcacagtatggccccagcccttacctttcccccaaccagtgccagccccccttcctcccactgtaggagcacccacaggctcaccctgggcacataaggtggggggtgacaatttctgcctctgggttgtgggaggagtcaagctacttaacggttctgggcctgaatttccctacctgcaagtggagatgtaacagtacctatccctaggagttgtgaggagaacatacttcaatgtgtataaattactcagagcagtgcctggcagacagcaagaagcaggtcctggaactgcatccattgaacatttatttgtcaaaggcctggtctgtgccaggcagcatgtggaggcactgagtggggggtggagggggttgtacggtgggaatcaagggggtcaccactgtgcccatggggaggccacgccactctgcctgctgggtggatatttcagcctgtgcagccagatgtgttcccaggaggctctgctttccagccagatgtaaggcctggccacagtgtgggactgggtctgcacagtgtgggactgcaggacagggtcctgcaggtggccctgccaggagtcctgccatatccctaccagaataccacccagccaggccagggctgagctggacgcccagacccccagggccaggatacaccgggaccctccttcctctcaacctcggatcctctttgcccagaactgtgttcccaggtggctgacgagcctgtcacgtgccagccctgcgctgcctgcgctcctctgaccggctgtggtgctggcacaggccacactactagagacaaggcagtccccccacccccaggctctcctggaccctgacactggaggttggtgggatatgctttctccaccttgtaccacactgaagttttgtggggcacagtgtgtgccgaggtggggcccccgggagccaaggacccagaggtgggtgaggaggagccgcctgcctgcagccccactgtggcctgagtggtgggggagtaaggactgccctgtgtgcaggaggggagaccctcgtgggcacggtcccaaggctgagggggtctgaggccccagcccagggggcaggcctcagacgcaaccccagttgggcttccatgtggagagaagaagcaggcggctcccagggagtcactgtaggacaccccaggctccagccctgagaatcacctctccccaagggccagctcagcagtggggaccaggtacccagcaagcgggcctgtccccagacccagggagaggcagaacatccccccagctcagatgggggtcagtctgtggccaccatcttcggatgagaaagtggagccgctgccctggaagagctgtgtctgaaccaggctcccagctgtgccacggcccaggcagacgcgttttaaaggcccgagccccgtgtgtcggggcttctcaggcagggctgttgtgcagccgccaccgtgtcagtgggactgggtcccaggtgtccctcgcaccccttcggcactgatcgtgtaggaacaggaggaggggggcaggtggggggcagagagcacccgcagggtccgggctgggcagccgagggcagcctcttcctcgcggagccggtcagccagcagtctcaccaggagctggttagcccaggttatgccaagggctggggaaacacgttcgtcccagaacctgagaaacaggaagcaggcaagctggcgctcaggcttggtggccccgcccacttcggcccagctgtgcccctggcacctgcacagaggtgcacacaccacatggctgcactcaccccagcggcccgtgtgctgcgccctgctcctccatggcctctgtcacctggaagagcacagtccaggtcagctgcaacggctgagggtcttctcgatggttaggcacaggctgctacccgcaggagccggaggccacctcactgccacccgccccacctccagaccggctctgcttccgcatcctggctaaaaatacgagctcaggggtgcaaccctgccttggtgctcacctggttgatgcacagcacagggctctggaaggcactgctcagctcacgcagcgtggcccccagggactgcagatgcctggccctgggggcggaggcctggctgtcaaattcacagcggaatggggctgccaccgagtcgatgaccaccaggcgagccatgccccgagacagcagtacggggaccttcttattcacacactccaacaaggtgtcctgtggggacagctgtcattgtctatgctggtcagcaagtccccgccccaggtgaccagaccccgtttggactgtcactcgaccgtctgaaaaccttcctacccacctggggctcacagtgcccatactctgtagtccccatactctgagcccaattctgtatttttctcaaagaggccccaactatagaagcttcaggctcacacaactggttcccttggccccatgtccttcctctggcccccccaggcagtcaccccttggctgtgccaacaccgtcctctgtagaggtgtcctttgcgcaggctcctgagtccttgcgggggtctgctctccttctgccatggtttcaccctctccccctcacaggtcagcagcaaccagccccctccttcagtggccccgcaccaggtactcagaccacccaaacctggccacagtgccaccaaagccagcccgtggtggccatgacctcttcagacgctcagcaaggcaggggcctgatgcccttcaggcgttactcaggcgagtcaggcctggcctgcctctgccaaggcgtggggcactctgggagaccacctgggggtcaggatggggctgtaggttgagacaccctcaaggccagtgcctcccgtgcatccaggccttagccctgtgctctgagctggcctggcctggccaaggggtggaaacagccctgtgcccaccagctcccaggagagcttccaggggaggacccccccagtgaaggcaggtgtcctcggcctccctctgggtgctgccgtggcctgtgggtgccagagccattggcatggctggcctggcctctgaccgcacagcttggtgagccatggtgatgggggagggtgacacagctgctcctggcaccaagcagtgtagttcaggccccacgggccttgccagcagctctggccagatggaggctgctaaggggcccctaggctgtccctcaagtccaaggtctgcagccacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccacggcctgcagccccaggaagcaggcagctgggccagggagggactttgcacatgcagggactggggggagctggggatgggcaagtggtgactgctgctagctgccaggctgggcctccaagaggggcttggctcagggtccccatcctcatgcaagcccaagggccacagagtgggggggtgggaatggcaccaggctctgcttatgcaagagaaggctctgtgtccacacccctggcttcccccgtgccagacgcaggcctttggtgctccagggagcagagaccaaagacgcaccagtcccccatgacccctcggccccagggaggctcacaaccagcaacaccctcttctctaggcagacttggggtgggggttccccagagagctgtttccagaacagaacttagtaacactgtcaggttttggcggcccagccctgaccttctatcttctcttgcagtgaccccgacctggccccgctccaggatgggactgccgagtgtggcccggagctggcccgggacagccagggcggcagggagggcccctggccgggagccgcagcgctcactcatttctcctgcgtctgtgtgcataggacatgatactaataaccacacggctggcgtgaccttggggctggggctgggcctaagctggtgccctggtgcggcgtggtctctcccaggagacctggggcatgagctgggcccacggctcccttcccatgtgtaacttcctcacgttgtgtgcgataacgtattttattgtacatttttttaaattaaaagtttatatgccttatgctttacttgaaagtttttataagacctcttagaagtgggggaaggctggcgggcgcggtggctcacgcctgtaatcccagcactttgggaggccgaggtgggcggatcaccaggtcaggagatcgagaccatcctggctaacatggtgaaaccccgtctctattaaagatacaaagaattagctgggcgtgttggtgggcgcctgtagtcccacctactctggaggctaaggcaagagaatggcgtgaacccgggaggtggagcttgcagtgagctgagattgcaccactgtactccagcctgggcgacagagcgagactgtcttaaaaaaaaaaaagagaagtgggggaaggcccacccaggagctgctctgccaggccacagccatgtctagggtgggctggacatggcagccgctccccctgcacagggtggaatttccttacttgcctttggtcaggggtttactcccaaacgtcccatcttttcttctgcgtcttttctacttcatcacttctccctcccaggatgatgtctataaactaagcactgacagctcacagcactgctgccccagctgcagggatgggtcccagcctctcttgcctgcttcttggctacaggacggactccactggcccccggtgagtggcccctgctctctgcaaggccctgccataggtccctcctccaagcccagccagtgtctgcagggaagccagcagccaggcagtggtcaaggatctgaggtcacctgtctgagctgggtgcccagcaggccttggccaggtggagcccctgtgcccctagtgagggccgtcttcccctcaggggcaaggggaaaccaacacagctatctcaccagggcagcagcctggagagcaggtcgcatccttctcagggcggtggtctcctggggcagctggtcaggggcccacagcccagaggaggtccttgccacccgcctggggcttctcttccccactccgtcttcatgggcaaggttgacagatggtgtacaggcgcccagttacatctgagtttcagatcatgaagaaagttgatctgaatatgggcatcctcattctagaacacgcttcaaagctgcctgagattcagatgtaactgggtgtcgcagcctgccgccctgcctgcctggcccacagccactcctggccaggattctgtttggccaaactgccgtcaggctcctgagcctcctcctaggcccatctgtgcacgtcctcatgaaatccagttttggcaatccctgctgagattgtagcaggacccctgctctccgtatccagtcgccctcagtagctgactggtccatcctccacagtccccagaggccgtctgatccccaaggcacaccttcagcaagggtcctggcaggatgctttagccagaattccctcccctgccagttcctctcagtcactctccatcctctgaccccacctgctcctcgggcgtaaacccccatgacccatgctgtgttcagagctgagccccaactctccctgccctgctgtgagaccccattgccgtggtggctacacctgccccaatggtcctgaatagcttgccttgggggtgtcatggggcttctcccacactcaccacatcggccacgtgctcgatgaagatctggctgccaaatcggagcttctgaagcagctctcctggaacgtcagtgcgcagccgcggctgctgggccatgagctgctgcaggcgcttgtgcgggaaggcgtcttccgtgcagatgtagacggctcctgggaagcaagagtgcctgatgtgcccaggggactccagacgggcctgtgactgccacacaaatcaagtgcagatgtctcccgccatttctaactctctgcccctcacaggttctttgcccctcgcctggggagggaggaggctggtgctttttctcaccctcccactggcagccacctccggggccaggtgacccctcaggaggaatatgggctgggtctccacttctgacacccaggcaaggacttcccctgtcctgggccctgggctggaatggccacagatgggaggcctctcctgctccaccctgcccctccttccccctgtgaacctccgttccccactgcagggcagggagcaagtggcagcatcagggcaacgccttctggaaatggcccctgagccccgacacatggccaccctcaaggcccccactgagcaagcgtttcctctcttcaaagctcctgcaatctgggctccatggtgaaattcaaaaagccagcttgaaaagacacgtgttggtgaggatgtgtaggaggcagacccctgacccctgtgcactgccgctaggaatgtaaaatggtgcagctcggaaaacaatcggtacttccttaaaaagttaaacaaatcacatgactcagcagccccactcctaggtagatacccaagagaaagaacgtccaccgtagcacgtttcatgacagcccggggggagacggcccaaaggccatcaactgaggagtggacgaatgaagtgcggcccatccttacagtgggatgatcgaatcttaaaagggaaggcagttctgacacctgctccagcacggatgaacctcgaaaacacaatgccaatgcaggaagcctgtcacgagaccacgtgctgtccggctgcacttgcatggagctcccaggacaggaagagtcacaggtagggaaaggggaggcaggctgctgggggtgggggctgactgctcatgggtagggtttccttttggggtgagggaactgttctggaattggatagtggtgacgggcacagaactttgtgcttctattaaaagccactgaatttatttattttattttaatttttgagagacaagagactcactctgtcgcccaggctggagtgcagtggtgcgatctcggctcactgcaacctctgcctcccgggttcaagtgattctcctgcctcagccttctgagtagctgggattacaaggcgtgcgctaccacgcccagctaatttttgtatttttagtagagactgggtttcaccatgttggtcaggctgctctcgaactcctgacttcatgatccgcctgcctcagcctcggcctcccaaagtgctgggattacaggcatgaggtactgcgcctatcaggccgaactgtacacttttagagggaattttatggcatgtaaattacatctcaatttaaaaaacaggaaggcttagggggactgatttgagtaataataaaactccagtttcctgcaaaacaaaaacaaaaagacaaggccggcgagctctctaagcactgactatgccaggaaggctgcccagccaggaccccgtggcccacggggcgtcgtcctgttcctgcagtggcacatgcagttgtgggagagccagtgcccccacgccgtgtcatgcagcctgtttgtgagtgtccgcgtaacctttaattctgagctgattttgctttgacagaatttcaaacgtaaagaagagttgcaaaaatgggtcaggaaccccccgccccattctgtgtcagaactaagcttctgagaagcatctggcccgcttgaggccaggaacgtataaatactgccttgggaggccacatcccttttgtggctggttcccttccccaccagtgtccccagcagtgactgtgcccctagtcaggagccacaggaaggtcggggccctgggcttcctccgtcctgttggctggagagaggctgggctggaaggctcggaagcaggtggaaccggtcaagcagcgtgtttttgttggggtgacgttatgtaggggctgcacagtcatggggacatcgtgaagctggcaggagggtggctgtggacagcccagcggtgggcggggccccagcaggcctgggagagcctcacgcggcttaagcacgggagtcggaatcacttcagagcccgcctgccgctttcttttcaaaattcgggcctttagattggatccaggaaaggaagtcatttccccaggaaagcacatctgacccctaaccttgcatgtggtcacggtggccgtggggccccctcccttcccctggcccgcaaggctggactgtgctgtcatcccgcagcagtcactgggctgggcacagctgggggattcagggagggtgtcctaaggcttctgtgtccctgggtatcggggagtgtgggcttcactgaaaaggccaacggggtggaagctgagggggagtcattgcacaaatcagatttgcacgaagcctggcacggaggacgctggagaatgagggcggctcccgtcccgttcctgagcacgctcgagtcccgcctccacctcacagcagctcttccgtgcggtaagcgggagactcccattttcaaggccaactcctgtcctcccggcttctggctgtctccaggctcatccccaagaccagccgcagggactcaggcacctgacaagagggtgccctcccctgggctgcagggacaaaaatgcctgtggcgtgagcagaccccagctgggctctcaggagacccctcaccctccacccgacacggaggctcaggagacccctcaccctccacccagcactgaagctcaggcaggcacagcacaccctgggtcctggggatgacgctgacctgagggtggcagaggtgaggttcccagccacaccgctgctggcaggtcaggcccgtgaggaggtggctggctgggcctgtgggtccagggcctggggtccggccctgtgtgggaagtgagcctagcagatgtgctcggaggtgccaccgatgaaaaaatactgccactctgttcacgtggagtttaagacaacgtgggaatcgcatgttgacaccagggaattagtttaaaagttaaggagctactgagaaacatctctcctcctcacagctcacagtttaaaactacgtgaacttttaacacctgagagacccaggcaggcatgctctgaacgctttagtccaatgcagggaaccctcgtttcacagacagagcgtacaggctcacggggccgcgccaggagcatacctggcctggcggcggggcacccggggaaaggctgtgctgccctccctgcgttgctggctctgtggactctgggcttggcagctgtgcggaacgtgggccggcatcgctgtgctcagccagcgacccctgggggcctagctctgctgagggccggctgcctggtggtggggttcgtaccctcccacccctcctgctgtcagctgagcccagcctcacttccccctccctgttctggaaggagcgagggcaatcagggtgagaaggagggagacgcaatggtaggaacagcgcaagaggcggccactgccccacctcaacggaaagctgtcccacacaaagcaggggccgcccacctgcccagaccccacggaaggggtggccactcaccagcctccaggcctccgtgctgccgcgggaactgcacagccaggcagagctgcagcgccagctgggtcttccctgccgagctgcgtccggccagctcagtgatgccgtccaggggcaggccaccgcggagcagcgcgtccagcaccgggcagcccaggctcaggcgctggtgctgcgtggggaaccgctccttctgctggtgcagctgcagtgctaaagggcagggatagtgtcaggcctgactctcctgggcctgcgggcagggctggggactgcgggaggcatggtcagcctgcctgtgccaggtgcagtgtggctggagcacaggtgcctgcggtcatgggggtgagcaaggtgctgagggcagggaggggggcccagccgggaagggcgggtgcacctgagatgcagagtcagggggagccccagggccaccatcacatgcccgcagggatccccctatggggcaattgcagcaccagacgccttcagccaaagcttccagagagccccgaggcgctccctaacagcctccatgtgaagaaaaaggcacagctctgtccagctgggatgccctggggtgctgaacagttctcaagcggctttaatgggctcccgcaggcgcgcacacatgcacaccacatgccgtcagttctctgtgacagataccattctggagcaatgctggtctcagcctcttggctaaagggccttggatgagccatttgacacagcctcctccacgacaccgaagcccctcagggcaaggctcaaggtgggacatgcggtgcaggctgcgctcttggcctggggcctgggccgggaggagcagcccctcccttggagtctgcacactgccttgggcaccccgtccaggtggagcaggccaccctgactgtgaggcctgcccagagccctgcccacagcaccgtgtgtgtggccgtggcacctgcccaccacggcagccccaagttcagcacgttcctcggggcctgggccactgagccacctgcaggggagagagggccctgctcatgccaggaccccgctgcctactagggcctgctgagatgcagggatggaaaccttgtccgtccaggcgcatggggttccctgggtacctccttcccctgctgagacctggtttcccacacgtggtggtgggaccgtggccagggccccatctcacaccgttcccaccctgccagagcctgaagggctctgggtgctgactgccaaatccacccctgcttcctgcaccccctcctctggtccatggagcaaggtccccaggaggtcccacagcccgtgtccacctcacgcatcttctgacccgatgctgtgaccacagccccatgggtgtaggacaagcaagatgggaactctggggctggagcagctgccacacgccctgaggctggtccctgggtgaagtctgcacagcccctgccctgcaccactgggaccatgatgctggagccacatgtcacccctggcagagatgccagggcccacctacctgtaaggatgctgcttccccgcaagtgtaaggaggccgttctcagcaagtgccagacctcggggctggagaggttggtcagtctcttcaagtctggtccagaaaagtgtaaaacctcctttaccgatttcagtttggctgaaataacacagataaattacaggaaaatgtcagactgtcacaacgcagggcaacacagtgacaaaaggtgctttgttaagagcactgtgagagcaccgtgcttccgattctggggacaaggtgggtagggaccggatcccctgctccctggaaaccctggacacagtgtggccgatgcacaggcacgaggaaagggctgctggacactgcgccctgagtcctggcactcggacagataccagcctcgtgagctggggcagaagccagaagacagggctgggcaggtcccggtgctgagagcaggttccggtactgagaagaaacgacaggcacccagttccatgccagctggagacagtgctccagaagggggcaggaaaaaaccagcaccgagctttccaccacccgcccaccaggcatggatctgggctgagccgcgggagaggacatgtgccctggggaggggagcgctgggagggtagcagagcccaggtccaaacgccagctgcgcagggcagtcagggcagggggcagagcatgtgcgaatcagaacggcggtggcagcagttacaggggtgcagatccccaggacctgccatctggggaggagggcaaggaagttaattttggactcagataagtgcatcactttctaatttcaaacttgtagaaagacgacaaatgctgcagactgatcagccgatcagggaagtgcgaggaagcgcacacgagagggagcagtggtggacgaagcgccccacccggccacggggacttacacccaccacatcagaaaccccctcaacacgggtgcgctgaacgctgcagtgaaaagacaaccattgtgcggctggaaaacagtaagcactggtgtgatcttcagaaaagccacacagaaaacacaaggagatggaagggtgggaatgaagaaagcgcccctgggtttcaccagatccagcggagggggcttcccgcagacaggctgctccagaaggctctgtgggccctgaggactcaccgggatcggggctgtggcagggcgctccccctggtaagcctcacagccccagcccccttcacagccgtgaagtctgcagggacttctggaaacattggtttttggataagagacacaggtgagaaaggaactccctggctgagcccttctctgtccctggtctgcaagcgtcgtgtctgcagctgtggcagcagctgtgatcacaaggccaccaacaggaggataaaaaccaacagccaaggatggagggtcaggacagcgaggccctgccctgtcaccaggctgctgcggcagctccatgagcactccggcttctcgccacagacagcgtgctgaggttcacgtagctgaggcccggggagacgggggaggatggaagctggcaggagggtccccggatgacagccaggcggctggcatggggagcagggggcaggggctgcacgtggggcctgagttttgagcatttactaactcgggcgaaaaaagatgctgtaagaaagaaaaccatcccctgcaccaccacaccaggttcaacaatggccagtatgcacccagtcacaaccctgacagctgatgtcacccaaactaggttctaagtatgggcagggagctggggggagaggaagttggggtacacaggtgtaggcacgctcagtcctcacagcccccaagagaagtccatggataatcagtaacactgacaaatcaaacattacaacataaacacgtttaggagcccagatgtaaatattttttaaaaaaataactaaaagacggccgggtgcggtggctcatgcctgtaatcccagcactttgggaggctgaggcgggcggatcacgaggtcaggagatcaagaccatcctggctaaaacagtgaaaccctgtctctactaaatttacaaaaaaattagccgggcgtggtgactggcgcctgtagtcccagctactcgggaggctgaggcaggagaatggtgtgaaccccgggaggcggagcttgcactgagctgagatcgcaccactgcactcaagcctgggtgacagagcgagaccccgtctccaaaaaaaaaaaactaaaagactttatgtggctccattttaccttttagacaatatgcatgtattactttgataaaaataaaagtaactgaaagaaatccatgtagttaagaacacacacacacacacacacacacacacacctgaaaatcccatagtacatcccgccctcggtttaataatcagggtaggcaaaggaaggaaggcttagccagccagcgttttgttaacctgccttatataaactgcacacacccacccacaccctttatgtaaatagaaataaatgtacctttcttaattgcagcaataattctgggattcaggtccagtagatccaaatccattttgtcggtgggctggccaccaggatgaataacttcccaggaaagacagaacaatggatgcaaattctgaggcactcgccttcaattcaaagcctgtgggaggcccgaaccagggaagtgacagcagccgaggtgtccgtgtcatcggggctctgtcactgagggtggaggagacttcactgtagagggaaggctgtctagctacatctagggcaacatgtctgtcatttacctctaagaattatttagcagcttagaacccattccagacactgatgcatttgaaaaaccccccaaacccaccacatttacctcctgtggaaagtgctagaaataagaccatcctcctgcagcagttgagtgccctgcccgactcacctctctggggcttggggatgacccgcgtgtttttggctgacttgactgaggcatctcttgcactctgcagtttaatttcccttaagtgtctccctggggactctggaaagagtgggaaggtgagtctgggattggcagggtgctcagggatccaaacatcagtcgcccccagcagccaacagcagaagacagcttcctgtgggacgggaggaaggtgctgtggaccccacccagcctctcccaggaagggagctggcagccattccacagcccgagcctggcccagcaagggagaagctcagctcttctcccctccggcctcagcaggctgctcagggactcagcctggggtcacataaggcctttccaacaggccactctgcatcccctgtcggcctcccaaatggtgagaccaagagtgtccaggacatggggaaactggaaggcagcagcctcgagggccgggtccaggatccatgtcctccagtgaggcctggcgcccttggccgtaacccagcagaggaaagggcgggccgtggacttggagaaggttttcccttggaccacacagaatgcggcactggcctggacacgatcacgctggtcactcgtatgcccatgttcagcctgctcagggagacaggaacagactacaggagcagcaggctgaggcacgcccccaggcaccccgtgaggcgggcagggcagggaagctggtgctccaggatgcgtttcctgcccgcgcaccaggcttggctcccgggcccccacagcctgtgggttttctgagcaagggacagggaggtgcccaggcctggttgcccaggcaggcctgacaggaactggcgagaagccaccctggagggccgggcgcaggccaaggcagggcggtggggcgctgaaccagctccaaactgctggcagagctggccagagtgaggaagtgaggttcccaagcacagaaggcaaatcaaaaaggaatgccacctccagggaagacactacactgccaaaggagatgcggccttgcccggctcgaaaagaggtcattttcagaacatgggactctccaagccctgaggacaggaggcagcctggggagtatgaacctcgcacctggtaggggaccccacacccgaggtaccacccaaaacacagcccagatctgcacggagggatggttccctgagcaggcgtgactgtcacagacaggctgggcctgggggctgtcgggaggctgctgtcccaggctgggtctggatacaaaacttggactgtgtcaagcagcgggacgctggcaggagcaccgggaaggccagcacgtggctgcaacgtctcccgccttcaggacgcgggccgaggccaaggcacctggaagcagagtgtccactgacggataacagactcaccggttggccaacggcagtccggctcctgaggctcctcctgggccctctgtgcacatcctgctgagaacttggtttaacaggcctggctcaaagtctgtttagtgacgacctcctcccgtgtcccatcacccttgacagctgattaggcgcctcatcttccactgtcccccgggcggcctgatctggcaggtcagttgaacctgcatccccttcgcccctgggggttcctcttagcaaccttccatcctctgcccctgcccagctctggagctgtaagccgccaccagcccatggcctgttcagagctgagcccagcctctctcccactgcaagaccgcagtgtggtggttcccacatctctcaaaggttctgaatgaaagcctggtctctgcctaacgtgctttcacagatatcctggaatattttccctttaacaccaagcacctgccgcatcccagacactggcctgggagctccacagacagcccggcacatgcctctgtcctctcgccgctgtgaggggcaggggtgtgaccagcccatctctctacaccggggtgaaggccacacacagggagcagcccacagcaggcaaggggctggcccaagacagacctgtatgtcttcctgcagcacccgagctgagcaatgacttcagggggagagctgatgtcacgtgctgctaggtgagtacggacggtcacaccagagctgttaggctcacacaccagactctggaaatgccgtggttactgcctggagctgctctgagccttccgaggtggactcactcctctgccttgggccctgggacctgctgtgtagctttgaagtgattcacagcacttacatagtctgatgttttggggtgacctgacccccctgcaagagtgtgatgtcttatcagaccacatatgtgaggacttgagtgaactccgcaaccttgggaatgccacttaaaccttgtcagacactcccttatgtgagttactgaccctgactgctggactgcaaaaacagacatcagcttgaaggttgtgcagatgctttgaggcaagctatacgctgctggcctgggagctggacctcggtcccagcttctcagagagctcccgctctcacgctctccactgctaccaaggcaaacctcgaactctcaccagatctcactctccaggggcccgctccatcccagcagagcaaccggaccctggccgttctgccactcacctccctgccgtgaatgcaccccatccatggaggccctgcttccctgccaggtgtcttcacctcctcccctctcctcccctctgagcactgtgaacccgagaacaaatcttctttgacaataaaccgtgtgattcgtggaatcatactttgatcatctccttatttcctccacacacaaggacccctgcactgccaatggccccaggagagggcagagtcagccacagggaccccacctcacaggcttcaacactgctgatgcctgtcatcccagcaccgtgggaggccaaggcggccaaggtcgcctgagcccaggagttcaagaccagcctgggcaacacagcaagacctactctctaccgaaaaaaaaaaaaaaaaagaaaaatagctggccagtgtagtggcgcttgcggtcccagctacttgagagcctgggaggtcgaggttgtgcctagctgtgaagacgccactgcactccaccccggatgacagagccagactgtctcaaaaaaaacaataaaaattcacgccttgtaataaggaattaaaggcaggatgaacaaacattttcttcttttttttgtgtgctttctgagatggagtctttttctgtagcccaggctggagtgcagtaatgtgatctcggctcactgcaacctccgcctcccgggtcctggttcaaacaattctcctgcctcagcctcccaagcagctgggattacaggcacgtgccaccacacccagctaatttttgtatttttagtagagacggggtttcaccatgttggccaggctggtcttgaactcctgacctcgtgatccgcccgcctcggcctcccaaagtgctcggattacaggcgtgagccaccgcgcccggcctaaaggattttctttccaaatcaaagtattaaaataactgttcagacctctcccacttcgatgcgaagccagcgcggtcccaggcggacgagcgaaggcatcgaaggccgggggcgcagccgcgggcccacctcggcctcccctgagcggacgcctccccgcgcgcaccgggggccccggagaccgccttccccgctccgaacgcacgcggcccggccccggcgaggtgcctgaacgctacccgagctgcggcggggctcccggggtgagtgctgcagccccaggcccgcctgctcccacaggctcgggcaatggagacccgcggccgcccccgccccttgaccctgcctcacccctcacgcccgctgccgcccacgacctccgaccccgctgccgcccggctcgcagcccggctcgcagcccggctcggcgggcctcacctcccgcgggttccgcactcctcttcccgccgtcctgctcctctcggccttctcctccaataggcgcctagcaccctgagtgggctacaccaatcagagacgaagcggcgctaacgtgactgactaactaaccaatccaaagtctcaatctccctgagaggggcggagcgtacccgggccagccctcgccgccgattggtgatcgacctcagggttgcaggggcggtgcccttacacggattggagagggcagcgatggggcggagttcaagctccgattagtccgcgctccgtggcgggcttggcgattggacgccggcgctgtcagccgcgcgcggaccggggcggggcgggcggtgccccgggctgggcgaggggccgggtgcggggccgctggccgagaggctgaggcggcgtcatgtcctccgaggtgtccgcgcgccgcgacgccaagaagctggtgcgctccccgagcggcctgcgcatggtgcccgaacaccgcgccttcggaagcccgttcggcctggaggagccgcagtgggtcccggacaaggaggtgggtggccgtcgccccggccagcgcctccgacccgccccgccgccccggcccggccccgcgggcttccaggctcccgcgacgacccctccgcctccgggcggccccttccccagccggcccccgcccccgctctctcccaggttggccgcgtccccgggccgccgcctcaggctcctacgcccgcggggagggcgggaggcgcgcggtgtcccggtgcgggggtcccgggagggcaggaggcacctgtccagggcgggcgccgggaggcggggtgcggggcgcgggctggtcccgggggtgggtgcggccctgcccgaggccggttcgtgctgggctagcgcgtgtggactgcgtcccgagagctggggctcgctcccgagaaagtggaaggcggagcgccttcctcgcaggctcggtggggagggcgcgtgctgtccgcggaagcgctggagctggcggccccgcaggggtccctcccgggaaccgggggaggcgtcggtgccgcgggcgggtggccggttccgaagccacctcctgctcggaaggagggccaggacccagtctgcgggccaggctgccccccgtttcccttcgtctataccaccctccacctcggaagcgaggtcgcagtcgcccactggacagtttgaaggagaccgcagatttgcacccgtttcccatgggcccagacacggcaggagttgcccaggccactcctgcagacattggggcgtgggcgtggggtccctgagccaggccatccgctgggcctcccgtggggttccctgtgacctgatcggaggtgcctttgcctcacaccagccccttggccaactgggaaggccccgagtgcatttaatcccactggctgtgcgctaacaggtgtgtccagtttctgttctgtggattttaccacgataaaaaaaaaattgggggagaaaaagaatttttgtaatatgactttcatacttaacacgtgttacagattcgtttaattccctcagtgatagaactaagcagacgttggaactaggttcaagaagtcaaagtagcactaattgactgggttcattgaagcttggttggaggcctggtggggggtgagcggccacagagcctcggggacaggacggaattcgagtgactctggggaagtgtctctggcatctacagtgtacggagccatcaccggtcactgagcgtgtcctggagagttgagaccagtgctgcccacctctccccagtatcgccaccatgaggagtctttttagacactttccgccaatcatcctccttcatcttttttaaaatttacttttaagttgacacgtgaaaattgtatttatggtgtaacgaactcttaatagcacagaaatactctacgtctgtatgaaccgtaaggagcacgtgagaaagtgtggccaagatgaggcagaggtttccaccaaagcacaatttctttctccctgctgtacacatgcactgatcttacggttctgttttatagtgaaccactgtgttcccctccttcattctctcttccagagcccttctggtatcagctgaattgtttagcatttttccctgcctttctttgtggcctctgctgaggcactgtgtggcagtcccgcggtgacttccgactgagtggagttgaaacacttgagtcaaggtggcacccctcgtggaagagaagattcattcccacgctggcgtggtggcaggatacccctccagagccccccaccatgtttggatgattaactgggatctgagcagctgagggaggtcctagcattgggtgggcttgggggacagagaaaccattctaataagatggactttgtctctgagttttgcgttgtgaattgtattggagcatggtcttacaggccagaaacgaccaaagacagtgttctggaggaacttagaacggggcagtaagggctggaagatttggaataaagtccagctttaggtgcaatagctcgaggggacatgtacggtaacagtcgcctggcatgtggtgatgctgaaggggacactgagctacactgtgctggctgcgtgcttggggccgctaaggtgattgtcgggaggtgactcaaatgtgcagataaccagttgtgggaaataggtttatttgaggtggtttggaatggggagaggagaatttggtagaacttggcaggtgggtaacattgtccttggcttggtggccgtgtgccgatcggcatcatcgtcatatctgtaaacgtgttggtccattttcattccagctctgttcttagccaggggagtctgaatccagcccagtgcccgtctcccgaataccagctgcctgaccgggctggtttatcagtttgggcccatgagggttatccctttaaaatgctgcaaaaccccctggggagcatgtgcacacatgcacctttctccgagaggtggcctgcagctctcagattctcaaggctctgacgcagaaccagttgagaatcgtttctccagtctgtgcctcctcaggaacctgtggggcaggggaggcagaggcggcgtgtaaagcttcgtgcgacaccactttggatagaggtgctttgggggtgtgaaggaagcttcagatgatctctggggcttgtctgactctgccatcaaatatccgacactgacgcaaggcagtgggcttgggggtgggcggtccgggcgtgcagccatctgggcttgtcacaagcagctgagatcctgagttttatccttaaaatccttgccgctgtgcacccctcccacctcccatccgtggtgctggcagaagaatgaccgcagctccatgctggcgggttgacactttgatggatactctagattcagagccaggaaggagagagcacgtgcgcgtctgatcacgagcctggactcggatgaggagagatctgaagtgaggactgttgctagaggcgtctggagctgtgcagcggggagaacaggggaccctgagttctgcgagggtctcacaggccaggccggacagggcttttcttttgcagggaggagtggccaaggctagaaagaatcaagctggggaggtgggatgggccagtggagggtcaggacctccagcagatcagagagctgaggccagaatacaaaaattagctgggcgtggtgatgagtgcctgtaattccagctacttgggaggctgagacaggagaatcacttgaacccaggaagtggaggttgcagtgagctgagatcgtgcagctgcactccagcctgggcgaccaagcgagactccgtctcaaaataaataaataaataataaaaattcaaaaattagtcgggcgtggtggtgtgtgcctgtatcccagctcaggaggctgaggcaggagaatcacttgaaccgggaagaggaggttgcaatgagccaagattgtgccactgcacttcagcctgggtgacagagcaagactctgtctcaaaaaaaaaaaaaaaaaagtccaggtaagggaattgtgttccagttgatcatgaggagaaatggccagtgttttctgaggcagagaatgggaatttggagggccttgctgcaggtaagcaaggggggcatctgtgatctcctctggctcgtatggggagggtggttctcggtggaaggctttcccagcacactgcagggtggggggtttcataattgtttccaggatctcagcgcttgggtaaagctcacccctgtgaggtgccaggggctgccagagcctccacaggtgttctgggaaccagcagcctcatgagatactgccagggacaccagcgagctcctcaagggtccctgtggctggctaagagctttttcttttttgagacaaggtgttgctgtgtcacccaggctggagagctgttactgatgttaggtaaaactgagactttgaagccacaaaaaaggattcctgggcgtcctgtgggaggccaggccgcctgtagcataaccctcccaggctgtgatcatagtgtctgcacctgtcaccgtcttcaaactgtctgacagcttcaaattgtagaaaactgatagtaacgcacgtgtttctagtccctgagatgcaagtagattttgtctctcagaggtgaagttgatgtcctctctcacacaccccaccgcggggtccctgtgagaggagccagtttacaactcatatcttccttcctcacggcctgtatccatgtctgctctttggattctcctttgaactgggtttttagtcttattggttctctcattaactaatgaggtaaatctttgacgtgggttccttttctgtttgtaggagttacgctctaccagttaaacgtgattatctttcaataaaggtgcattgatacatgcatttaaattgttttttgattggcgagttcttggggggctgagaattagttgactgtgggagccccaccagccagtgggtgacgcttctcactgtagtgtgggagctcagagtgcgtggtggggcctgatgttttttgtcaccccagcctcaaagggagggcaggcctatgtccatgtccagcctgtgtcctgagacttggttctttttataactttttttgaacatccatttaaactccctaaactatactttcagattatatggaggcgcttttggtttcttgcgtgctgccaaaccccactctttggggtgggccgggtgctggttctgaggagctgccctgtgaccctcgaggggccgttcctgttgcattggagtgggggagcgggtctcgacctgcaggtctctaaggagctccatgctggtgtctgccgcactgtggaggagtgatgggcttcatgatttctgttttttgttttgtttgagacggagtctcactgtcacccaggctggagtgcagtggcgcgatctcggctcacttcagccttcacctcccgggttcaagccattctcctgcctcagcctcccgagtagctgggaccataggtacccgccaccacgcccagctaatttttaggttttattttgtagggacagggttgtgctatgttgctcaggctggtctgaaactcctgagctccagcagtccacccacctcagcctcccgaagtgctgggattacaggtgtggccaccacgcctgacctggtttcttctttcattgctcgcggccatcttgcttacccaccgggaagcctagtttatggcatctgccttgaccgcctccgagcatgtcatctggcagggtgggtgcaagtcagttgtggtttactggactagcaaggaggggacaagcgcccagggctctgactcctgtaggcagccaggagaagtgtgttccgaaatttcactgggagccgtctgcatgcacctgccctgatcctcgctccctcttggccccgcttcccttgagacagctccttctgtgtccatatagcttcccgccgagcctgtgattggccctgcaaggtggccacggaggcctcccatggaggtgagtgccaggcgccccagagaggcctgggccgaggctgcctctgtgacgccactgcacagggcacagagggctcctggagagcacttgggccccgccgtccatcctagggggcagtgtctgtcattagcgggtttatctgcttggcttgggcaagagggtcaggcagcagatgggtgttattaggggcactgcccaagctgaccttgcctcactctccctcttcatctctgtgtgtttgtcacagcctgcacctctggcctcgtggccctcactaaacacctttattatttatttattcattttcctcactaaacgtcttgaggcctgtttcattgggttgttcttggaggttttagtttccccagcgaatgtgctggtttgaaagtctgctccagcccacgctggtggtgacacatgtgtacctgggatgtgacgcagaggctggcattccagacaccgctggccacctacggtgaaaacggatgaatcacacttggtttctgggctttggtgtattctccctagctcctaaaatagctgttccactgagcatcagagctgcggggtccagttaaaggaggcgctggtgggagcctggtctggggcccggcttgctgtcctgcgcttcctttgcggggcgtgcttactggcggggtaggtatttggcagtagttttaccttatgtcttcatccattgctttatttcatattaaattgctctgttgataattttttaaatttctttcactaatataatcaataggaaattaccttatttaaaagcctatacatctaagctccttggttattttatagtaataaacttctggatcacttatatttttaagggggcaaatcctaggtgtggtctgtctctttttttttttttttttttttgagacagggtctcactctgcttcccaggctggagtgcaatggcatgaacatggctcactgcagcctcgacctcctgggctcaagctgtcctcccagctctgcctcccaagtagctgggactacaggtgtgcaccaccatgcctggctcattaaaaaaaatgttcaggccgggcacggtggctcacgcctgtaatcccagcactttgggaggccgatgcaggcagatcacaaggtcaggagatcgagatcatcctggctaacacagtgaaaccccgtctctactaaaaatacaaaaaattagctgggcgtggtggcgggcacctgtagttccagctacttgggaggctgaggcgggagaatgacgtgaacccgggaggcggagcttgcagtgagccgagattgtgccactgcactccagcctgggcgacagactccgtctcaaaaaaaaaaaaatgttcgtagagacagggtcttgctgtgttgcccaggctagtcttaaactcttgggctcaagtgatcctcctgcctcagcctcccaaagtgctgggattacaggcgtgagccactgctccagcagtgtggtgttatatttagaaattggcctttcagcttgcccaaacacaaactgcacagtaaatgtgaaaagcagtcctctttcaccaccgtctgctgagaatattgagagccctctcccctcctgtcgggcgctgtgggccagggtcaccatggagagaccatcaatagttactctcactggaacctggtgataacgtggcctcgtgtttgcttaagctcagagttaaaacccccgtgaagctttctctagcagattctagtggattctgtggctagtggatgtctggggtcagggaaggggccaccacacagaggcagggactgtgccaccgcacagcaggcagaacattccagaaccgacaggcccatttgagggcaatggcagggctgggctgaagcacaatcagggcggggaacagccagccaacgcccacagcccgtgggcagggagcccctggcagagctgccagctggactttttagatgcttccagaaggctggggtgggccaggcctggtttccaagtccaggaagcagcttaaaagcaaagggaaacaaaaaaaggctggtcgtgggatctcacaaagctcaggacctgcctgcctgagttggggcagtggcgacatggaactcggcagggatgaggccctcgtgtgggtcgcgacgggccagtccttgctgcagaatggcgtctgaagggcccctgatgtgcgccacaaccgggacctctgtcctcctacagtgagggtacacgtggctgtgggccccataggactccttccagaagcatctgcagagtcccaggaccaccagactctgttttgccaactaagcacagtgggcacttggcacctgatgtggactgtctccgagccccctgtggaggggctgcaggcttcctgtgctgcctgtgtgggtcccgcaggctggagggaggcccctgcctttgcagattgcagggtggcagggacacgctgagggtggcggggacatggtgagggtggcggctgtgatggcaccgcatcagagcagctcctccacaccagcgtcttctggggctcagagaaggggttggacttcccagagaaggggtgcagggcagggaagagtccccatgcctatgagggagaggatcagggtggggtgatggaggatccgtggctgggcccccagaccacagggaggctgtgcagccatgtcagaggcgctgggggattgggcggccgcgcggtccccaccccagctcagacccaggggcctgtgttccagaaggtgctcggccccggtgaccccacaggccttgcctgcctccttgtggaatcagccccagcagtgttcgccggcccagggttgggctggaacggtgccatgcgtgtgggagcagctttcccacggaggggccgagccctgtcagctgcttgtcggtgccagcacagcccgtctgtccttggtggagctctgaggcggctctcgcgttagataagacgtctgagctcttgtgtggcttggtaatgctgtggccacctccagtctgcctccttttcgagacttcaggccctcagtttatgctcgccaggtaattcctggtctcgtttgggggccccctccttcccccagaagggaaaagggggctcttcgtggagcgaaggtcttctcttacatctcttttgaggattattgtgcttagaacatggatgattcttggtcaatattcagccgagcccttaatcatcagaagccaaaagaccctccatctctcccaagaggacccctttgactcccaccgttccgtcgctggttcattgaacccacacctgtttctggttcaccacccgccaccgaggtctctgacagcgaggaccaaagcggggtgtgcttgtcacaccttgtttcatccttaccaaggaccccagagcacgagggtcttgttctcatgaagctgagggaggcgaggcgtcctgggtcccgcagcccccaatgcgctgctgaagggcctgctggggagcgggtgggcagcaccgagggccagctttgaaaaaggctgtaccggcttaccaaatccggggaccattttcgtggcaaaagtgtccctcactctgttaaaagaatgcatggtgacacagatttccttcagagccaggtctgaatgtcttccccttggactgaagtccctgctgttagagcgggggagccggcggcgatggcggcgtcctcgtgctgcgctcgtgccggcgtcagggtccccctgccatctggagtgagcaggaggcggccaggccaggccttcccagctgaggtttgggagttccgtgcctttggtgctgagggtgagcgtgttcacggtgacttcgtcccttggtcatgaggaggttcgagctaggaaccccctgcaagtggtcaacgcatccggcttgctgttctaagtggaggcggcaggcacagctgggacccacgcccctcagaagcaggctctgtggtggtcggagcaggcacctcaccaggccacgctcc

SEQ ID NO: 1206 - DNA, 27408 bp, Homo sapiens
tacaaacaaatggaaaaacatatgctcatggattaggagaattaatatattttgttttgtttttgtttgttttgagacagagtctcgctctgttgcccaggctggagtgcaatggcacgatctgggctcactacaagctccgcctcccgggttcacaccattcttctgcctcggccttcccagcagctgggactacaggtgcacgccactatgctcagctaattttttgtatttttagtagagacagggtttcaccgtgttagccaggatggtctcgatctcctgaccttgtgatctgcctgcctcggcctcccaaagtgctgggattacaagcgtgaaccaccacacccggctgttttttttgagacggagtcttgctctgtcgcccaggctggagtgcagtggcgcgatctcggctcactgcaagctctgcctcccggggttctcgccattctcctgcctcagcctccagagtagctgggactgttggcatgtgccaccacgcctggctaattttttgtatctttagtagagacaggttttcaccatgttggccaggctggtctcaaactcctgacctcgtgatctgcccagcttggcctcccaaagtgctgggattgcaggcatgagccactgcgcctggcagaagaattaatattgttaaaatgaccatactgcccaaagcaagctacagattcaatgcaatccctatgaagatatcaaatgcattttttccccacagaattagaaaaagttctcagagctttgtagaatcaaaaaagagcccaagtagccaaagcaatcctgagcacaaagagcaaagctggaagcatcacactacctgacttgaaaatatattacaaggctatagtgaccaaaagagtgtggtattggtataatagtcacatagaccacggaaacataatggagacccagaaataaatccagatatttacagccaactgattttcaacaaagatgccaataacatacattgggaaaggataccctcttcaataaatccaaaaactagatatccatatgaatgaaactagacccccatctctcaccgtatacaaaaacaactctaaataaagacttaaacatatgactcaaaactgtaaaactactagaaaaacaagggggtcggggcagtggctcacacctgtaatcccagcactttgggaggccgaggcggacggatcaccagaggtcaggagttcgagaccagcttgactcacatggtgaaaccccatctctactaaaaatacaaaaaaaaaaaaaattagccaggtgtggtggcgcatggctgtaatctcagctacttgggaggctaaggcaggagaatagcttgaacccaggaggcggaggttgcagtgagctgagatcgcaccattgcactccagcctgggcaacaagagtgaaactcagtctcaaaagaacaaaataaaacaaacaacaacaacaacaacaaaggaaaaggaaaagcacgtgttgggagaaaatatttgctaaatatattcgacatcttttatctcaaatatataaataacacttataactcgattataagttaataatcatccaaagtttaaaatgggcaaaagatctgaacaaatatgctttgaaagaagatatatggttatcaaatacacacttgaaaagttgttcaacgtcactagtcattcaggaaatgcaaatttaaactatgatgagatacaactactacacatttattagaatcgttaaaatgaaaaagacaaacatacaaatatatggcaagaatgtggagcaactagaactctcagtgagttctaatataagtgtgataaatttttttgaaaacagtttgacagttcttaaaatgttaaacataaaagccgggtatggtggagtgcacctgtagtcccagctacattgggcaggaggatcttttgagcccaagagtccaagtccagcctgggcaacatagccagaccctgtctcaaaataaaaacaaaaacaaaacaaaacaattaaacatacacctaccatatacccccaaaattccacttctaagtatctacccaagagaattcaaaggatatattaacacaaggacttgtacacaaatgtttatagcagcttcatttgagatagtcaaaagttagaaacaatttggccaggcactgtggctcatggctgtaatcccaccactttgggaggccgaggcgggtggatcatgaggtcaggagtttgaaaccagcattgccaacgtaatgaaacctgtctctactaaaaatacaaaaaaaatcagccaggcgtggcggtgcacacctgtagtcccagctactcaggaggctgaggcaggggaattgcttgaacccaggaggtggagcttgccgtgagccgaaattgcgccactgcactccagcctgggcgacagagccagactccatctcaaaaaaaaaaaaaagatggggtcttgctctattgcccaggctggtcttaaactccccggctcaagtgatcctcctgccttggcctaccaaagtgctgggattacaggcgtgagccatcacgcccgactgaacctcttttccttataaactatctagacttagatttttccttccttccttccttcctgtcttccttcttccttccttccttctttccttttttttttttttttagacagaattctgctcttgtggcccaggctggagtgcaatgccgtgatcttggctcattgcaacctctgcctgccgggttcaagcaactctcctacctcagcctcccgagtaactgggattacagccgccaccaccacgcctggctaattttttgtatttttaatagaaacgccgtttcaccatgttggccaggctggtctcaaactcccaacctcaggtgatctgcctgcctgggcctcccaaagtgctgggattacaggcatgagccaccatgcccagcctgagatatttctttatagtaacacaaaaacagcctaacaaaaaggtcacatagtaggtaggatttagtaagaaagagagctgagatttcaaggcaggtgaactgggtctaatgtttccactgctttactcacctctccctacctctagatttccaccctcccatgttgaaatctcttggttataaattttcacttgtgcttctttcttagatcaccttcttgaatcacagtggtgtctattttcatatccattgagggtatagtgattccttgagggttacaaggtctgcagatcgatgagttcttggcattttggagaggccagagactggtagctctgagtcattagttgtcaggccatgcctccccatcaaacaatcgaagcttggctgacttctctgagtgccagaagaaggctggggctgggggtagaggatctgggtttcacaagaggcgagtctggaaatgtcaaaattggggtccaaggtgagaggatggcgtggtaggacaacattgtctgccatccgtgtataatggctgaagctctggttagtgggtgtggcctaaggagaatgtagtgattcccactgtcggtgtaaagggcttcatattgatggagagttttctgtgttgtcagaagttctggtggacactgtgagacagatttcatggatttatagatgagacagctgaagcttgggagtctgtgccccagatcgcacaatttattagcagtaggagtccaagttgagccaagccagagaaggttactgagtgttttggcacccttggccttaatctgctgctcttcagatttcacagcccccatgttccagatagttcactcaaagcttgggagttggagatgagggaatcaacagatgctgacactagcatgaaggagaggtatagctgatctggaggtatgattgggagaggttgagaagcctttcaagggtgtccctgatgtgggagggcacaagcaaaggcccaggggcaaggaactgcccagtagattccagaagagaactaccattgcatacagcagagtgtacaataacagggtagtcagtacactgcatcaaggggctgaaggcaactgccttttggtttgagcatagtctgaaagcagtggagccactgaatcccacaaaagctggtaacctggacagctcaaaagtcacagccatcaggactttgcctggaatattctggcattattggcaaacatctatcttcccctaacaggttggctgctgtatactgagacccagtcggagatcagaaggcaggttcagtagaaacacgtaggactctactcatgtattaggaatcttttttttttccttttttatttttattttttattatttttttgagacggagtttcactcttgttgcccaggctggagtgcaatggcgtgatctcagctcactgcaacctctgcctcccaggctcaagcaattctcctgcctcctgagtagctgggattacacgcatgcgccaccatgcctggcttttttctttctttctttctttctttctttctttctttctttctttctttctttctctttcctttctttctttctttctttctttctttctttctttctttctttctttctttctttccttccttccttccttccttccttccttccttccttcctttcctttcccttccttccttccttccttccttccttccttccttccttcctttctttctttttctttctttctttctttctttcttttcttgtagagatgggatttctccatgttggtcaggctggtctcaaagtcccaacctcaggtgatccgcccgcattggcctcccaaagtgctgggattacatgcgtgagctaccgcgcccagccttttttttttcctgttttagagacaaggtctcattatgttgcccaggctggagtgcagtggtgcaaacatagctcactgcagtcttgaactcctgggatccagtgatcctcctgcctcaagtagctggaaacaggcatgccacaatcatgcccagcaccatcttatgagatctaatcttggccactcacacagaggattgagctctgatgacgtgtctaccctaactttatttgcttagaaggctgagccccatatggctcagctaacctttaattctgatcccacatgtgtcttacatattggagacattagcatcttccatattggagacattacactcaggaaggaaggcctgagtagggtaggtatcccccagacacctcactgtgctggggagtatttgagaagccctgctgtaaactttgctgacggcaaaactgttgtggcttctgctcacaatgtggttatcattgtccatcccctcaggggcttccaggagacgtggcagctgcagtggcctctgatccatcatacagtatggatggacaccacaggccaaagattctcatgtcagaggatttccggtcttttctcccctaggcctcaggaggacccagggaaatatctaaagccaacctatagttttggtgaactgagtttgcattgaaatgtttttggaaatgattttcaacatttataaaatcacatgccacatagaaatctgaatatttggctcttcttggaaaaccaggagatatgggaaatctgtactgactccaccatattgtctccccaccccttaagagggacagacctgcttggtggccaccagaagtggaattatgaaggccacggccatatgattctcaagaaaccctggctactcacataagccactccagaccatgatttctgtcttctctgtcttgaggtgcctacctgtgcagtgatggccatgagatgaacagcccagggagtccacaggaaatccacaaaatatttatttgaatttcagttatgagtgacacataggtctgcatgtcctgagaagttctgtacacccttatctcacttggccatagtcattggaagtttctgatgtgcgtttagaacagacatgtcccctcttgtctaccacagtcttctccacacttagagtttttgtaccaatgatagttcccacatagccctggcaggtctgaaccagttatgcctgcctactgagttttatatttcatgagtcatgagccatgggcaggtactgggggatgtagctggtaaagtgggacatgcattgggaacagaggaccaaacttttgctgtggaggttctcaaagaaactaccccattcttcagagctagctctgggcccacaggtgacccttggtgtccagatcacaagattcagtccaagcctgtcagtctttcataggaggccttagggcaacaagacaaattcaaccaaaactggactgagcactcttcctgcccatgcggctgtttgagacactcagtgcccccttacaaaagctgttctttttatattaggatgaattgtttcaaaccacctcaccaactctgatgcaggtggctaaacattaaggcctttgttatctcagagagagacaggcagatccaggagtgagtgattgagactaaacagatcattcctaagtgtcacatgtagatgcaaacaatgtccatgaagagaaaccttttcttctattttagatggagtctcacactgtcgcccaggctggagtgcagtggcacgatctcggctcactgcacaccctgcctcccaggttcacaccattctcctgcctcagcctcctaagtagctgggactacaggcacccgccaccacacctggctaattttttgtatttttagtagaggtgggttttcaccatgttagccaggatggtctcgatctcctgacctcatgatctgcctgcctcagcttcccaaagtgctgggattataggcatgagccactgtgcccggccaagaaaccttttctggaaagctccagaagacaccagctcagatcttagcaagaattgtcataccaaaatctaaagccatcagtgggaaagaaaatgaaggtactcaaagcctatgtaattctctctagagaatggaaaagggagtatagtctgctttcccttagcacagtgagggagactgatacatatcatgagatcttgccaggtggcagagatgagacagtatggcaggcagctttggacatggcttccaatgatctctgccctctggtattcatgctcttgtgtaatgctctccccttgactgtgggctggaccaagtgacttgcttctaactaaatttagcaaagatgatgggatctcacttctgttattaggttacaaatgactgacttgttggtattctccactgcatgatcagcttgcaagctttgattgacaagctgccattttggagaggcccatgtggcagagaactggaggaggtctcagaccaacagacgggtcctcagtccagcagcccacaaaaaactgaatgctgccaattacatgagtttgcttggaagcagagccttccctagtcaagccttcagatgatacacccccagctgacatcttgatgttagccttgtgagaaaccctaaagaggagtcagctagctgcaccaaagttcctgacctatagagactgtgaaatagtgactattgttttaagccactaggttttgagtaatttgttacacagcaataggtaactaatacagatggcttctgcaatagcagtaatacagtgccgcctaagattctgggagctgtggctttcccacatttgttgcccataactctcttgtgaattctctggtgatttttcttaaaagggggtgtctatagctgaaggctttcccattttcactgcatttgtaatgcctttttcccataggtactttatatagctttctcacataggagaggtgactgaagaccatcccacattccttagatgcaggggttttctctactgtgaattttttggttatagataagaatcgatttcttcttgagggtctttcttcataccaagtatttaaagatctctcttcagtgtgggttcttaggtggttgaagagggcaaaagtcttcatgtcttcccatagccactgctcttgaagggcttctccctatcatggcctgcccggtgttatctgatgttagagctgtgtggcagcatcttctcactcagctcttcttcatggcttccctgtgccatgagtactctggtgatggagaaaggaaggcctttccacattctcttttgagcttctcattattctggtactccagtgctggaagggggtagttaccctggaaagccttcacaaatgcctggcccttgagtcctctcacttatgaattttgctgtgcatgaactgaaaagtgctcttactgtgagccatgtcacatctgaaaaggtggtcttcaccataaatggtctactgttggtgaaggtttgatccactcccttgtgtggggtttctacctggagtacactgcctaacgttcagccaggagtacaatctttggcagggcaagggtgccatggtcagggtgaggaacgaccagtcatggagtactggtcctgtcacatatcccactactgagcctgttaggtgacattcacataggcagggagaacagagagggatctaggacagatgtggaagcagcagtggctactgaaactgctgttcagtgatgtgagcccaggccacccttcttttctagagatggggccttgctatgttgccctggatggactcaacctcctgggctcaagagatcctcctgcctcagcctctcaagcagctaggactataggtgtgcaccactgcacctggccaggcctctcctttatggggactcctgttcacatcccagccaatgctctcatgagtacttccttgtatgggggaggtcaaagaaacagcagcagctcacatgtgatgatgctgaaattacatggtaaataagctttttaaaataggtgccggccaggtgcggtggctcatgcatgtaatcccagcactttgggagtccaaggcaggcagatcaggaggtcaggagatcgagaccatcctggctaacatggtgaaaacccgtctctactaaaaatacaaaaaaattagctgggtgtggtggcgggcaactgtagttccagctactcgggaggctgaggcaggagaatggcgtgagccatttaggaggtggagcttgccgtgagccaaaatcgcgccactgcactccagcttgggcgacagagcaagactccatatcaaaaaaaaaaggtgccaaacaccatattctacaaggttctggatctctagctccttctaaaataccagctctgtcaactgtgttaaatgcccccatctgcctgtgcccactctgttggccagcaagactgtgaaggcatgaagtgtgtgttagtgaccagaaaccctggccagactgcaaaaaccactttcctggacgtcaggctatcacttctctcagctcccagttcctacctggggagtgatgggtgccaagatacagtttgagagaggtgaagtgaatgtacatgacattgcatttatctgctttaactgtggcaaaaactttaacatggcaaatacaaaggtctgtagctctggagttgttctgcacaccctcaccctgcacagtcccagttgatggggaactatggctattcctttgtccatgatggcatgtgccctagttcaccagtctacccaaatccctggttattacctcacatccagtgtttctctatgcacatagagtcctccatggacccctctaggtctttgccttggtgaccctgtgactattttagtgttgtagatgagtttatttttcctctgggtaagctctgggccctacggtaactgaaacaggccactatgttcaatccagagcctttcagtctttcccagtctttcacacagcaatgcaaagtaggctacaacaggacagagcaactacccgctcttctactgtgcccttaggcagattttgtgcccccaaaaggcactccccaatctatccattcattttctcaacctaccccaacagaacccctaagattaaaggtgacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtgacaaataaggctggattttcggctaaagaatttcccacattcactgcatttataaggcttttctccagtatgaactttctgatgcttaatgagaatggagttttggctaaagaatttcccacattcattgcactcataaggcctttcttttgtgtgaactctccagtgttcaatgagagtggagctgtgagcaaaggctttcccacactcactacactcgtaaggcttttctccagtgtgaattctccagtgctgaatcaggctggagctgcggctgaaggatttcctacattcgctgcactcataaggcctttgcccagtatgtactttctggtgctggatgagggtggagctattactgaaggctttaccacaatcacagcattcaaaaggccgttctccagtgtgaactttctgatgtcgaaggagatgggagctttggctgaagtctcttccacattcactgcactcaaaaggccgttctccggtgtgaactttctggtgctgagcaaggttggagttattgttaaaagctcttccacattcactgcattcatacggtctttctccagtgtgaactctccagtgctgaatgagagcagagcttcggctgaaggatttaccacattgactgcactcataaggtcttacctgtgtgtgaactttctgatgccgaaggaaattggagctttggctgaaggctcttccacatttcaggcactcaaaaggcctttctccagtgtgaactttctcatgccgaatgaggtgtgatctgttactgaaggctttcccacattcatcacactcataaggtctttctcctgagtgaattctctgatgatgaacaaatgtgagtttgtggttgaaggttttcccacatgcaatgcactcataatattttacttcagtgtgaaatttctggtgcttcctcagcttagatgagtgactaaaggccttcccacactccttacacacatggggtatttccccagtgtgaaactttttattaccaaggattgatttctcctctaagaaatttccacctgttgggcatgtaaatggtatctcttcagagtgagttctcagatggttggggagagtggagctcttcaggaaggcttttccacagttgctgcactcgaagagtttctgtgtggtacagacttctggaagctgcccaagattggaatatggcttctgcccactgtcaacagcttgaagctggaggaggtcacagctgcccaggatgaccttcccaccttccctgcaagtgaaggggttctctgacaggtggactttagagctcttcataagtgcgtccctgtccttgtaccatctaaagggcttccctccactgtgctccttctggtgctggtgaaggtttgcattcaaccaaaagtctctcccacatgctccacatgtgtagggtttctcctcagactgtgttccctgatgctcagccaggtgcaaaatgtctttcaagaatggcccacacatgtcacaggagttagctttcttggtggaaggatctgcattagggatcctgacctgtaacacttctacagaaacattctgcttgggatgggccccctcaccctctactccatgccaagaacctgaaagtagagaaatgccagttaactaagaattccacttggtgggaatggttgacttcattagaaatgttacccaggaattcacacccaagaagaggtcccagggattgctgacaggccaacagggccatcatcagggtgaagaagggcccattactattggcaggatagggaccagccaagcaacagaataagggagacctcaccaggggtaaggacacagaaatgggtcaaaggacttaaatagacatttctctaaaagaagatatatacacaaatggccaataagcatatgaaaagaagttcagcatccttaaacatgaggagtatgaaaaccaaaaccataatgagataccacttcacatccactagcatagctataataaaaaaaaataaatgacaacaaatgaagtagaaaaactggagcacttatacactgcagacagggatgtaaaatggtgcagccaatttggaaaacagtttggcaagtctgcttctacagagctacacaagagaactaaaaacatccacacaaaaatgtgtacaggactgttcatagcagaatttttttaaaatttgagatggggtcttgctatgttgcccaggttggtctcaaactcctgggctcaagtgatcctcctgcctcagcctcctgagtagacggattataggcaccttgcccagcttctatagcagcatttttttctaacacctaaaaaatggaaacaagccaaatgctcatccactggtaaatggataaacaaactgtagtctttctatacactggaatatttggctataaaaaagaatgaaatattgatacatgctacaacattgatgaacttcaaaaacatgctaagagaaagccagtcacagaaaaatacatagtattctataaaatgtctaggaaacgtaaatctatatagtcagaaagtagattagtggttgcctaggaccggggggaaagggataagggaacatggggagtgacagctaatgggactgctaataggacctacagtttctctttaggtgatgaaaacatgctaaaattacattatagcaatgattataccatgtgaaaacatatagaaatcactagactgtgtactttaaaaggtgaattgtatggtttatcttaataaagctgtttttaaaaaatatctcactgggggctgggcgtggtggctcacgcctgtaatcccagcactttgggaggctgaggtgggtggatcacgaggtcaggagattgagaccatcctggctaacatggtgaaaccccctctctactgaaaatacaaaaaaaattagctgggtgtggtggcaggcacctgtagtcccagctacttgggaggctgaggcaggagaatggcgtgaacctgggaggcagagcttgcagtaagctgagatcacgccactgcactccagcctgggggacagagcaagactccatctcaaaaaaaaaaaaaaaaaaaaaaaaaggaaaaaaaaatctcattgggaaagagacagaatctgggcatgacctcatactgggtaacccgaccagggattggtgaatctcagtgggatctgttaggcagactggaggtgtctgatccccaacctttgcctccacaaggctcctgggcaacagctattaggaaagctcatgaggctgctcagagagagacaggggaagtacacacagcagaacctcagcaccccagcacctacaacaggaaacccgagaaggaagcagtacccatgatctggctttgggatgaacagagctttctatggggaaaagacacaaggcataaggtagtcatcaccatgctgagacagggcattaccaagtgaggtcacaagctcaaggttttccagcatcacactgtggtacaggtgcctctgggctgcatcaaggagctcccactcctcttgggagaagtatacagccacatcttcaaaggttaccatgctcttcaatgtggggacagctgagccacagggccaagaagtatgctgacaaagaaacaaacaattggtcaaatggaaatatgcaggaccttgctgtgtgactcagaatcctgatacatctaccactaatatctctttttcttatgatcctctcagtccacccactactcacccatccacagcttatcttcttcctcagggcccccacctaacatgccctggaattaatggtgcccctctctcctagtagtcccactggtcactgtatccaggccaacccaacctagaggaacaataggcaggtgggcagatggatgcttcctcctccctcctgctggccaattttccttgtgtcttctggctcatacctcccaaacataagaaaatttgggcttccctttcttaagcctcttgtaccagggccatgggcccaatggttcacattctctcacctttacatgtcactcctcagaccatacagttcttatatttccaacccctccctgttcacactgtaggcattctccctagcatctcaccatgcacatggcatacctgacagatgcaaccgggatccattcctggtccaagccagctacagagctccaaaaaccccactgcaagaggcagtcatagcccctcaagtcaatgcctcccctgccagccctgttccttcaaccatcagctgcccagaaccataagcagatctcaaatatctcttccctctgatatctttgcctttgtatgtgttgtctcctccccagtcatagctgtccttgctcttcctaacactcaaatccaagatccactggcccccaccttggcttggggactcagcttaggctgaccctttctgatcttgccactccaccagcctgacaaaaaccccaggaccctatttaagaagagataacatgccctgaccacaagaaggatggccgcaacaatgtagtgagctgtagagaagcaaatcaacctaaaccaaagcccaactctcatcctacttttgccgctatgcttcactgttgtcctagacctactctctgctcaggaggctcagccactatcttgaacccaacccacaactgcatgcagtgtccacacacaagcatccatcccttggatgtttccagcctaaacccgacataatttcataatcacatgtttagtggtctacttggcacctcaatttggtagtgtctgggacatctcaaatacaacatggccaaaatccaactctttatcttccccctgaaatctactcctcacaccaacttccacatctgaaagatctaaggtcaatttttttttttttttttttgagacagagtctcgctctgtcacccaggttggagtgcagtggcgcgatcttggctcactgcaagctccgcctcccgggttcaagccattctcctgcctcagcctcccgagtagctgggactacaggcacccaccaccacgcctgactaattttttgtatttttagtagagatggggtttcaccgtgttagccaggatggtctcaatctcctgacctagtgatccacctgcctcggcctcccaaagtgctgggattacaggcgtgagccaccacgcccggcaatttttttttttttttaagacagagtctcgctctgtcactcaggctggagcgcagtggcacgatctcagctcaatgcaacctccatctcccagattcaaacagttcttctgcctcagtttcccaagttgctgggattacaggtgcacactaccatgtcctggctaatttttctgtatttttagtagaggtggggtttcgccacgttggccaggctggtcttgaactcctgacctcaagtgatctggccgccttggcctcccaaagtgctgggattacaagtgtgagccactgcactcagccttaggtcaatcttaacatttcactttctttcactgtcccacatcaggtaatccatggcccagtttgggcagattcagaagccaaccatctgtcctacctccacgggcacccctctgtccagctacccaaagcacacatctggaccacatctgtcagctcctcactggccttcctgctccaccatcaccatccctccagtctgctgcccactaggcatccatagggcgtctgttaagactggagtcagagcacctacttcctctactccaaaccttccatggctcccaccaccatcagaatagaggtccagctcctcaggctgccattccaggcctaactattggtttcccttccctgtttccaccagactaaatggagaccggcagtccccagaatgcttccatttcatcaccactaaacaaggtacacatgctggtcactgtccctgggacagccttccagatctcattccacaggattccagaaatgggaatccctcgatataaccccttgcctggattcaggatggtaagggtaagtgactcccagggcagggcccaggacccacgtgtgaggacaggacacgatcaagagtcccaggacaccaacatcccctctatctgggcttcaggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagccggcccagtgggaccctcaggttgcaccgcgcggaggtgtccgcggctctcgggagtcgtcgcccttggcgttatgttggctttagggagcgcgaggccgaggccaagaaaagctacgcattgggaggtcttgacccagtgtgcgcccggctgtaggcatggaacgtgcgccaaaggtctcctggcacccactccgctggactcagcaccattgtcctaagtctccgattgagaagtatctgccccaggtcctctgcgggccccactgaacagtgtggagcgttcacaggttgggggtcaccatttcagaatccagtttgttgagacgtggagggtacaggaggagggatctgcatatgcgaagacttggacttgaccctgacctgagcgttcaggcaggctctcatgcccccttggcagcgagtggagagcgtaagaggagtcctgcctctcctggcacaccgagggcgcctgggagccatgaaaggtgttgaacagaaaagggatggacatgacctgagttagaatttggaaagtatttcagtggttgctgaatgaacacactactggagaaggtggttgtagtggggctggaagcagggagactgtgggggaggttattgcagtattgttccagacagttatgatagtggcctgtccagaacggaagcaagaaggatgggagaagtgatcagattcccagtggatcttcaagatagagctaatggaattttttgctaccttagataagtggaataagcatgagtaggggtgaaggaccatcccaagtagttaggaagaattaggatgcctcctgtggagaatagaggttggcagttggcaggaggaggatgtttcatggaagattagcgatggattttgtaggtatagagtctgaattgtctggagacctgtgagtggaggtgtcaaatgggcctctggatatatagaattctggtgtggcttcaggacgtccagactgcattatgttggtggcctggcccagtgaacggcctgaggataggatttgggaaggagggttttaggttggaggaccagtggctagggctcacgctcagtgcttagatcacatctgtctgcccattggcttggtgttgcagggcttaatgacctttgaggacagggtcagtacatcttccaagaatgtggggctccttagtgaggtccaagggggcttctacagtgacatgatactacagagctttgtactccagtgcccactaggtaaggctactgtgtctcctctttcccctacacatgaaatctaggttttcctccgcctttccattgttccctctgggaggtgctgctggccctggcactggccagtgtcctgctgtgtccggaattgtttccttcctctgggttcttggtctcgctgacttcaagaataaagccgcggaccctcgtgttgagtgttacagttcttttttttttttttttttgagacggagtctcgctctgtcgcccaggccggactgcggactgcagtggcgcaatctcggctcactgcaagctccgcttcccgggttcacgccattctcctgcctcagcctcccgagcagctgggactacaggcgcccgccaccgcacccggctaattttttttttttgtatttttagtagagacggggtttcaccttgttagccaggatggtctcgatctcctgacctcatgatccacccgcctcggcctcccaaagtgctgggattacaggcgtgagccaccgcgcccggccctgttacagttcttaaagatggtgtgtccggagtttgttccttcagatgttcagatgtgtctggagttttttccttctggtgggttcgtggtcttgctgacttcaggagtgaagctgcagaccttcgcagtgagtgttacagctcttaaaggtggcacatccagagttgttcattcctcctggtgggttcgtggtctcgctgacctcaggagtgaagctgcagacctttgcaatgagtgttacagctcgtaaaggtggcgtgtccaatgttgtttgttcctcccagtgggtttgtggtctcgctggcttcaggagtgaagctgcagacctttgtggtgagtgttatagctcataaaggtagtgtggacccaaagagtgagcagcagcaagatttattgcgaagagcaaaagaataaagcttctacagcatggaagaggacccgcgggttgccgctgctggcttgggtggccagcttttattctatttggccctgcccacatcctgctgattggtccattatacagagcactgattggtccattttacagagcactgattggtccattttacagagcactgattggtccatttttacagagtgctgattggtgagtttacaaacctatagctagacacagagtgctgattggtgcatttacaatcctttagctagacagaaaagttttccaagtccccagccaattagctagacacagagcgctgattggtgcgtttactaacctttagggagacacagagcgctgattggtgcatttttacagagtgctgattggtgcgtttacaaacctttagctagacacagagcgctgattggtgtgttggcagtcctttagccggacagaaaagttccccaagtccccactggacccagaagcccagccggcttcacttttcactgctacttatccctggctgctgcataaacaacccccacaccttccctgggatcttgacaaccttgtgaagccacagtgatggtccctgcacccactcccacgcccttgtccagctctagaggcctcctgtagcccaacccacaagccacaaaatgaggaccatcatggcggtgccggaaatctcacccctcaatgcccacctggaatcggaagtctcaaaacctgtgtagcatatcacatgcagctgggtcgtttcctggctaggttaccctgtcaggatctgtgacttttctgtcctttctgccacattccctcactctagtaggagttttctgccagctgtcccttgtgagtcccagtgggcactgacatggtcattgattgtggggtcactgagcattgactttgtgaagttcagttctttccagctatatacctgcataggtgatcttcacctacggtgatttgtcatggggtggatcaccttgacgtgggctgccttctcacaaaccacttgatgagagctgtataggatcactgccaccacccccgccatgtgatcacctaactagaacaaatgaagagacctggctggtggacagggtggcttgaattaggccatggacagagaggccccatggtgcaccagttctgttgagtggaagacagctgtggcagagctgttggcagtgccctggtggctcacctggtacctgagttgtgccctctgttgtcctggcaccaggatgtatagctgtgccttttaaaaaaaattttcctgaccttcttctgacactctatcctactttgccctgactcctgttccctggatggcttcctctctgtcttccaagattcactctttccccttctcccgtcctcccctccagtggccaggtcttctaccattggcctccctttaatgtgtcttgaacggataatgtatctttaaatagttgttatctgcacatggtggctcataactacagtcccaactacttgggatgctgaggcaggaggagcgcttgagaccaggagtttgagtccagcttgggcaacataacgagatcctatctctaaaataaataaataaatacatagatacctaaatagtttttgaaaacctcttcttccgtgagactggcttgttccatttgaggagtatgggcataggtgtcaatggttcaagacctggacttcgctcactgcatggtactgacctgtcaccagacactagggccctgcagctccacattttgcagaacctacagagaactgacactgaagagatagctgataaatacacagcatatggaaaggtgtttgaggggaagcaagccttttctcctaccaaaaaacttcacagtggaaaaaattgcaagtgtattatgagcatgggaaggccttcacttttgtcttcatcctgagaaagcaggagtacatgcacatcttcaaaggcccttacaagtatagtaacatggggaatcctccagccagaactctacctcctttgagcaccaatatgttcaccccagagaaagtccccataagcgcaaggagtgtggtccagccatgagcaaaattttgcaaaactctcctctgtatcaaaatggtcataccctaatgaaggactcctaagttcagggaatgtggggcactgccagctgtcctggtggcttccctggtacctgacttgaggttcatacatgttatattcagagttctgctttcattagcaaaaacaaattaacaccggaaaatggttgtacaaatgcaataactacatgaaagctttcagtgaaatatgaaacctcatcctgcagaattctcatcagagaggcccagtgcatgcagctaatgttggaaagcctattctcaattttaatcctatttagcaccagcaatttacagcattgtgagtgtagcatgtaggagagcaaaaaattgcagctcctgccttgatgtgcacaaagtgattcacactggaaaaaccctctatgagtgcagccagcatgggagagcatcggccacagctcctgccttgcttggcaccagaaacttcaccctggagaaaagccttttgattatagtaaatgtaggaaagtcttcacctcccttatttagtataaaagaattcacactggccaggtgtggtggctcatgcctgtaatcccagcactttgggaggctaaggcagggggatcacctgaggtcaggagtttgagaccaacctggctaacatggcaaaccccctctttacaaaaaatacaaaaatcagctgggcatggtaacgcccatctgtaatcccagctacaccagaggctgaggcaggagaattgcttgacctcagggggcagaggttgcagtgagctgagttagagccactgcaccccagactgggtgacagagcaagaccctgtctccctcaccaaaaacaaacaaacaaacaaacaaaaaacacagctgggtgcagtggctcacgcctgtaatcccagcactttgggaggccgaggcaggcagatcatttgaggtcaggagtttgagaccagcctggccaacatgatgaaaccctgtctctactaaaaacagaaaaattagccgggcatggtggcaggcacctgtaatcccagttactcaggaggctgaggcaggagaatcacttgatcctggaaggcggagattgcagtgagccaagatcatgccactgcactccaacctgggcaacagagtgaaactccatctcaaaaaacaaacaaacaaaacaaaacccagccctacatgagtagccttcagccacagctaaaccttgtgtagaaggattcctccctgaggagacactccatgatggccctgcatgtggagaagctgacagaacccatgttgtaccatgatcgccctgcatgtggagaagctgacagaacccatgttgtactttgcaacccgctgagggaccttggcagagctatcacaccactgggtcctgtggtggaagcccatctctgttttatggtgacttcccagttgctcaatgtaagtcactccctgtttcctgtttatactaccttggagggatggtaggggccttgcacacattggggtggtatcatgctcactcatgatggggtttgacatggacatgaccccattccaagcaaggagcctgattggataatttctttctcttttttttttttttttttttttgagatggagtctttctctgtcaccaggctggagtgcagtggtgcgatctcagctcactgcaacctccgcctcccgggttcaagagattcccctgcctcagcctcccaagtagctggaattacagccacacaccacctcgcccggctaattttttgtattttagtagagacagggtttcaccatgttggccaagatggtctcgatctcctgacctcgtgatccccccacctcggcctcccaaagtgctgggattacaggcatgagccactgcacccgacctctctccttttgtcttttcttttttcttttcttttcttctttcctttcctttcctttgctttcctttccttttctttcttttctcgtcctttcttttcttttctctctttcttttttttgaggcagagtctcactctggtgctcaggctggagtgcagtggcatgatctcagctcactgcaacctctgcctcccggtttcaagcaattcttctgtctcagcctcccaaatagctggacttacaggcgtgtgccaccatgcctggctaatttttgtatttttactagagacggagtttcaccatatattggccaggctggtctcaaactcctgacctcaagtgatctgcctgcctcggcctcccaaagtgctgggattactggcgtgagccaccatgcctggccgacaatgcaggagcttaaccaaaggaccacgttggctagggtcaatcagctgccccaggtgaccacccttagtgctaatcctgtgcagggtaggggtctgagccaaaaagaggaggctcttgtgtgtacagaaggcaatttgttgctatttttatttcatgcccaattcattaagaatgtttcaaacaattagcatttttctaagtattaagtaattaacatttgcctgaagaattacacattagatggataatgtaaaaataaagtgtttaagaagttaaacgtctccaaacattaaacattacttgagattggacatgatgggtcatgactgtaatcctagcagtttgggaggctgaggcaggtggattgcttgagtacaggagttcgagaccaacctgagaaacatggtgaaacctcgtttctacaaaaaaagtaaataaaattagccaggtgatatggtttggctgtgtccccacccaaatctcatcttgaattgtaactctcataattcccacacgttgtgggagggacccagtgggagataagtgagtcatgggggcagtttccccacactgttctcgtggtagtgaataagtctcaagagacctgatggttttataaggggtttcctcttttgcttggctctcatttgctcttacctgccaccatgtaagacagggctttcaccttctgccatgattgtgaggcctcccagccacatggaactgtgagtccattaaacctctttgtcttcataaattacccagtctcaagtatgtccttatcagcaatgtgaaaacagatgaatatagtaaattggtagagtggggtactgctataaagatacccgaaaatgtggaggcaactttggaattgggtaacaggcagaggttggaacagtttggaagcctcagaaggagataggaaaatgtgggaatgtttggaacttcctagagacttgttgaatggctttgaccaaaatgctgataatgatatgggcaatgaactccaggctgaggtagtctcaaatggagatgaagttgttgggaactggagtaaaggtgatgcttgctatgttttagcaaagagactggtggcattttgcccctgctgtagagatttgtggaactttggatttgagggagatgacttaaagtatctggtccgggtgcagtggctcacgcctgtaatcccagcactttgggaggctgaggcaggtggatcatgaggtcaggagatcaagaccatcctggctaacatggtgaaaccccgtctctactaaaaaaatacaaagaaattagcctggcatgatggcgggtgcctgtagtcccagctactcaggaggctgaggcaggagactggcatgaacctaggaggcggagcttgcagtgagccaagattgcaacactgccctgcagcctgggtgacagagcaagactccatctcaaaaaaaataaaaataaaaataaagtatctggtggaagaaatttctaagcagcaaagcattcaagaggtgactttgatattattaaaagcattcagttttaaaagggaaatacagcataaaagttcagaaaatttgcagcctgaccatgcaacagaaaagaaaaacacattttctgtggagaaattcaagaaatttgcataagtaaccaggagtcaaatgttaatcgcccggacaatggggaaaatatctccaggacatgtcagagacctttgtggcagcccttcccatcacaggcccagaggcctaggaggaaaaaatggtttcgtgggctccccctgctgtgtgcagcctacagacttggtgccctgcatcccagctgcttgaactatggctaaaaggagccaaggtacagcttaggctgtggcttcagagggtgcaagcctcaagccttggcagctcccatgtggtgttgagcctgtgggtgcacagaactcaagaactgaggtttgggaacctccacctagatttcagaagatgtatggaaatgcccagatttggagcaggcaaaagtttgctgcaggggcagggccctcatggagaacctctggtagggcagtgctgaagggaaatgtggggttgaagaccccacactgagtccccactggggtactgcctagtggagctgtgagaagggggccaccatcctccagactccagaatggtagatacaaccaacagcttggaccacgcacccggaaaagtcacagacactcaacaccagcccatgaaagcagctgggagggaggctgtaccctgcaaagccacagagctgcagctgcccaagaccatgggaacccactgcttgtatcagtgtgacctggatgtgagacatggagtcagaggagattattttggaactttaagattcgactgtcctgctgcatttcagactttcgtggggcctttagcccctttcttttggccaatttctcccatttggaatgggtgtatttatccaacggctgtaccccaattgtatctaggaagtgactaacttgcttttgattttacaggctcataggaagaagggaattgccttgtctcagatgagattttggactgtggacttttgagctaatgctgaaataagtagactttgggggactgttgggaaggcacgattggttctgaaatgtgagcacgagatttgggaggggcgaggaacagaatgatatggtttggctgtgtccccaaccaaatctcattttgaattgtagctttcataattcccacatgttgtggaaggggccccagttagaggtaactgagtcatggggacagtttcccccatactattcttgtggtagtgagtaagtctcacgagatctgatggtttcataaggggtttcctcttttgcttgactctcatttgctcttgcctgctgccatgtaagacgtgcctttcaccttctgtcatgattgtgaggcctctcca

SEQ ID NO: 1207 - DNA, 47673 bp, Homo sapiens
ttcacagttttgagcacgcattgcataccattttttcactgaacacaatctatcatgaacatctttccataacttaaaagaagctgcatgccagaacagtccatcatgttctgttttctttcagaaatctttagagatggatcattttccttacaagaatagataccaggtaagagaagcagcctttaaagcagcgaatagcagctcatgcatgctaattatttgcttacttctctggctcccctattgatggcatcttgagggccggtatgaacatgtcatgcagtctccaagcaacccacagtaggcccaccataaacagatgttgtggccagcatgggaggtgcaatggtgagttgctctgtttcctccctcccgtccccctccccacccctcccctccccctcccctccccctcccctcccttccccttcccttcccttcctctctcacaaaacagtcacagagagaggacagcagcgtacatggtgaggtgctgacgattctggtccactggatcccaccatccctaggacagtaaataccgtcctagtcactacccagcaagttaccaccgcatcatttcctgcatgttccaaaatgaataaaggtaattaagcataagtgcaaataaaaagtcatttctcatgtttttaatctaaactgtcacagtttagtttactattttaagttcttttcgtgctaaaacatttgtttttatttatttatttatttgagacatagccttgctctgtcgcccaggctggagtgcagtggtgcaatctgggctcactgcaacctccgtctcccgggttcaattaattctcctgcctcagcctctagagtagctgaaactacaggcgcgtgccactacacctggctactttttgtatttttagaagaaacagggtttcaccgtgtttgccaggctggtctcacacttctgacctcaagtggtgcaccagcctcggcctcccaatgtgccgggattacgggcatgagcctccatgtccggccaatcatttgtttttttaaagtggcagccataggtcctgtccgtctggatatattttgaacttttgtatgttaaatataacactaaaaaactttattatgttttaggtaatctaagattggtgtatacaaacaaactttacagattactgtagggttcaggaaatgatgtatataatatgacatttatatctctagtttcttatgtataaatcttcctttagaaaagattggctttttaaaaaatgtctccacaaatttaggcttattttataaaatgtcacaacagtaaaaaaaaaaaaatactttttacctttctaaaaaagtaaaatactcttttgccatttcataaaataaacctgaatttgtcatactatataaatactggtactcaaataaaataccaactattttaatcaaaattatttagacagtctatttatataattttatgatttttaactacagtgatgggcattcacaaatctttcataaatcaaacatattagtattaggttttacttagtagttatatacgaaagatcgggccgggcacggtggctcatgctcgtaatcccagcactttgggaggccgaggcagatggatcacgaggtcaggagttcaagaccagcctggccaacatagtgaaaccccgtctctactaaaaatacaaaaaaaaaaaaaattagctgggcatggcagcgtgtacctgtaatctcagctactcaggaggctgaggcaggagaatcacttgaacccaggaggcagaggttgcagtgagccctaatcgtgccgctgcactccagcctgggtggcagagcgagactccatctcaagaaaaaaaaaatttgaagatcttttcaaaatggagatttttaattaataatttggtgctttcaaatacactgaagtcttgtgttaatcacagtaagtctggggatagtgaattaattttatttttttatgatgtgttcaaaaatttttagtttaacctaatattgattgatgatgagtaaacaaattgatttttttcaaatttcataggtctattaaattgtcaaagatatttttaattaaaaaattctgtctttcaatattgtttcagggatttagatctagttgaatctgctcaacctgttaatcagtgtcatgtgccagattccgattcactaacagtgtgcctgtatgacttttctttccatagtctttgaatgaaatttttattacttatttgtatgttatatagtacagctcatacatttcaaacgaaaccacagggtaaaatgagttctggcttagtataaaaaagctgttggcaactcagtattacatatacagatggatgtggctcaacaagaatttagacaaaaatattgaactgtaacgtgttgccatgatttagtctctaatgaggttataaatacatccatatttcagcacatatatccagttgtgttcaaatacctctaaaagtggtatatcaagaattcttaggctactgagaaaacagagtctgctattacccaagaaatcaactggaaggcatttttataaccttacaccacaaaaggaaaaattgaaaggcagtgctaataaatgcaaactacatcacctagaaaatggtaatctagaatgtcactgtcaatatttaagaatttgaactttcagtatgaaaaatttggtaaaataaagcttttattttcttttttcttttctttttttttttgagacggagtctcactctgtcaccaataattgcctatatatgttgtaggcaattattttctaaattcaacaaagttgcaataaactctttcatgtataaatctcactgaaaggcactatccagtagctatttccctcagtcttttctggaattttctatcacttgattcaaaaccaaccttatttgaatcctagcaatttctaaagctccaaaggtaataacaaaaagggagtagaaaagaagccaagttaccccaaacactaaatgtctaatatatttggttccgcaaatgaaatatatttggttccgcaaatgaaccaaaaaccacacaaactaaaaaacagtggctttaaaactcaacctaaattcaatggtagcagtcaaatctatatgcaaaaattagcaaagacacaatacagaaacccagtctgttattccaggaaaaataataaaattcttattttggcatttttcagaaagaataaatacattaaatatgacaaaatatacccagtcaagtataagaaaatctttgaaatataaatgattttattcttattcttaaatatttactataatatatttagaagagcttttcagtgaaaaatgcttatagctactatgtataaattaaaacagcccttggaaaaatagtatcttttattaataatgcagatcgcagctccaaggatgtaaatctgggctcatagctcatgacccaaatcaagctcagatgatctatgtaacaatcataagttatagtattaaattaaaatgcttctagaaataaaaataaaaagaggtaaaagcaaatgaaaaaaaggggaagtggattcctcacaattactcctaaggtatggaatcaaactaagtgttaattaacaggtgaataaatatagaaaatgtggtatatttacacaatggaatgctattcagcccttcaaaagaagcaactcttgttatttgcaacaacatcaatgaacctggaggacattatgctaagtaaaataagtcagcacaaaaactatagaagcagagagtagaatgatgattgcctggggctgggggtggaggagatgtgggtcaaaagtaatgggtcttccctatgtctcttaccttaacatgtaatttattcttctctcagttttgattcaccagggaatggaattatatgctgaggagtcaaaacttaatgttggtagagctgagaatagcagtttcctggtagaacaaccacttctcagcagtatagaaatcactgaaagaaaagtgtgtctctcataaaaagctaatgtttttgtttgtttgtttgttttcagacggaatcttgctctgtcgcccagactggagtgcagtggcgcaatctcagctcacttcaagctctgcctcccagtttcacgccattctcctgcctcagcctcccgagtagctgggactacaggcgcccgccaccacacccagctaattttttgtatttttagtagagacggggtttcactgtgctggccagcatggtctcgatctcctgagctcgtgatccacccgcctcggcctcccaaagtgctgggattacaggcatgagccaccgtgcccagccaaaaagctgatgtgttttaagcaaaataagcatacgcatcaatagtaaaatgcttctggtaaaataaaggttcattttgttgatttctttttttttttttttttctgagacggagtcttgctctgtcgcccagtctggagtgcagtggcacggtctctgctcactgcaagctctgcctcctgggttcacgccagtctcccgtctcagtctcccgtctcagcctcccgagtagctgggactacaggcgcctgccaccacgcccggctaattttttgtattttttagtagagacagggtttcaccgtgttagccaggatggtctcgatctcctgacctcgtaatcctcccgcctcggcctcccaaagtgctggtattacaggcgtgagccaccgcacccggcctcattttgctgatttctcttgagctcaggtaatatttcaccaaaaggctggcatatatttagccaaaaaagggatattgtttgaaataagaatattgtgaataaagttattctgtcaatagaataacattattacttcatacaagtcttacctgtagttgtacatcaaatgctactttttattaaaaatagtattttatataagtattcaatttatatcacctttcttctctatttcaacaccttcttcacttaacaccaatggaaagcaagccagctggtgccaggaaagcacgtgttgttattgccattttaatgatgacagtgaagaacactcgtttgagtgttcttcgtttgagtagtactcgcgtgccaaacgctgttcatttaacacaaagaactggttttctattttatcctaaatttactgataacatttttagctaagaagactttgtctcattcaagtgtgttttatggaatttggttgacatttaagtgtctctgactttcctggaatatattataatttttcataaatccatattgagtactataaataaacaatcttttactaaaagcctttgtgaggtagagtaggatacatcaaattttattataatatggtaagtgtgttaaccatgttcctagtaatccctctgaacacagcattctcagtttccagtattcacattgagtcacttaggggaaattggtatctctgtaagcaggcagaagaaggtgcccagtggaggtgcaccacattgcatggaaatgctgtccacatgcacctttggggtcttaatttaactgggctgtcatttgcatggctagatacttactgaatccggtcatactgtttttggcagctaatggcatttgttccccataagttttctacaattatttgctttgctgaaaaataaatcttttgttaacttactctaaattgagagactagatttgcaattttcaatttttaaacatgaaagcaaagcagagaagaacaatatgtgtatataacatgcattttcctgcctatgaaaattcttgtattgccttggaaaccctaggaagccacctaaagaattctcccttcaaattgtttagccagaattttaaatttcaaaaggtccaaaacttaacaattgagcaaagcaaaaatcttgtctttgcttcttgttagtaatctgtcatttcagaaaacatggcaattatgccaagccattgaaaaaaaatgtgattttggttaattttatcccatttaaaatgttgtctttgttacttttatcatgttaatctaagagaaactatctacataactatttatgccttcaggaaatattatgccaggcgcagtggctcacgcctgtaatcccgacattttgggaggccaaggtgagtggatcacttgaggtcaggagtcccagaccggccttgccaacatggtgaaaccccatttctactaaaaacacaagaattagccaggtgtggtggtgtatacctgtaatcccagctatttggaaggctgaggcaagagaatcacttgaaactgggagacaaatgttgaagtagagccaagatcttgccactgcactccagatggagataaaatgagactccatctcaaaaaaaaaaaagaaaaaatatttctattaagttgtttaaagttcagtattgtagtacagtatagcagaattctctaaaattagcagaagttcattgtaatttcaaggttttttttttttttttgagacagagttttgctcttgttgcccgggctggagtgcaatggcgtgatcttggctcacagcaacctctgcctcccggtttcaagtgattctcctgcctcagcctcctaagtagctgggattacaggcatgcgccaccaagcctggctaattttgtatttttagtagagacggggtttctccatgttggtcaggctggtctcgaactcccaacctcatgggatccgcctgcctcggcctcccaaagtgctgggatgagccaccacaccctgcctggtttcaagggatttaactgtgataacaaatgattaggtatgctttatgctttttcttttctctctctttttttttttttgtttgtttgttttgagaccaagtctcgctctgtcacccaggctggagtgcagttgtgtaatctcggctcactgccacctccattttcaaggctgaagtaatcctcccacctcagactcctgagtagctgggaatacagccttgtgccaccatgccgggcaatttttgtacttttagtagagatggtgttttgtcatgttgcccaggctggtttcaaactcctgggctcaagtgatccatccaccttgaactcccaaaatgcaagtggtacaggagatagaaagaaattgtttaggcagatagcgagggtaaaagagtccctggcaaggtttcccttttaaccaaaagcagcctgaaaaatcgagcagcaaacatggataagcaaaccggaagcttgcactagtgaatgccagcagctagccaggtgtgttcaacatggaggctccatcctccctttcctcaccattgaacgttaaagaaataggcaacatggctgctggccaggcagagaatccatctgcataataaaaaattagggtgggggcggccagattttcacacctatgcaaatagcacaactagtcctaaccagttttttgcaccgtatacaaatggcacacctaatccaatcaatctttcataccctatgtacatcagacattaccttctcaagatcatctataaaacaccttgcatttcaccatgaaaccagcaacccacttctccaagaacactctctgtcacagagagctcttttctcttttgcctataaacttctgctctgaacctaactctgtgtgtgtccatgttctagttttccatgccacgaggattataggcatgagccaaggcaccaagctagtatgcctttatttatttttttttttttgtagagagagtcttgctctatctcccaggctggagtgcagtggctccatctcggctcattgcagcctctgcctcctgagttcaagcgattctcataccttagcctcccgagttgctgggactacaagcgcacgccatcacacctggctaatttttgtatttttagtagagatgaggttttaccatgttggccaggctggtctcgaactcctgacctcaggtgatctacctgcctcagcctcccaaagtgctgggattacaggcatgagctaccgtgcccggcgctggtatgctttttcacaataacttcaattctagaagggtacccactggtctttatggggtttctgtaacggatactgtaaccctatgccaccggaatggtgcagacatgctgattttattagaatgagttcagccttcttggtagactattggtatcccagaggctgaccattcactgcagcttattaaatgtagctccatgatgccaatgagtcctttcagccaggttgcctttttcttctcattgatgtagtcaggtcgtgatctcttttgcttgtcttatgctattccagatgataggtgattatttcttccgtaagtgagaccctcttttcttttctctgccatgggatcctcctatgatgtgtctctttctcttaaaagcacttgtaatcccagcactttgggaggccgaggcgggcggatcacatgaggttgggagttcgagaccagcctgaccaacatggagaaaggccgtctctactaaaaatacaaaattagccgggcacgatggcacatgccggtaatctcagctactcgggaggctgaggtgggagaatcgcttgaacccggaggtggaggttgcggtgagcccacattgtgcgagtgaaactccttctcaaaaagcaccgctgcttcgggcgcggtggctcacgcctgtaatcctagcactactttgggaggccaaggcgggcagatcacttgaggtcatgtataatattatacataatattatatattattatacatattttatattattatatacaataatatatattacatgaaaaattacatactgctcacatattaaaataatattttgaatattagaatatttgaattctagaactagaatatataacgatgaaattgttacaataaattccacctgtttcttccttttttttttaagtttggctactagaatatttaaaattcacatgtggcttacattttatttcagagaattaactccgttttaaaatctcaggctgcctgcttaaaggaccagaagctaggaaggtcgtaaaatcggatattaaataatgttattatattttttccatttgttaatagccatataattgtgaacctcaaatatctgagacagatctcagttaatttagaaagtttattctgaggccaggcgcggtggctcacgcctgtaatcccagcactttgggaagccgaggcgggtggatcacctgaggtcaggagttcaagaccagcctggacaaagtggtgaaaccccgtctttactaaaaatagaaaaattagccagctactctggaggctgaggcaggagaatcgcttgaaccccggagggaggtggaagttgcagtagcagagatcggatcgtgccactgcactccagcctggaagacagagcgagactccgaaagagacagagagagagaaagaaaaagaaagaaagaaaactggaagtggggaggcggcttccaggtcctaggtagataaaagacaaatggttgcattcttttgagttcctgattagcctgggaaaaggaggcaatcagatatgcaatcatctcagtgagcagaggggtgactttgaatagaatggaaggcaggtttgccctaagcagttcccagcttgacttttccctatagcttagtgattttggggccgcaaaatttattttcctttcacacactatactatttattaatataaatgcatatgaccttatacacaaggttaaatgcaaataccccgtgggtgggccgggctcagttcagggaggaagccctgactgaaaagcctgcagtttaggtttcattctatcttctttcagcccagcaactgagcacaccttctgtcattcagggcctgagggggcgggtccttaaacatcctccaatcagggacgctgggctgggacccgtccaatcaggcacgcagctggagcggacaggacggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatggtgagagtgccgggtcccagatcccgagagagggggagggcctggttggaactggtgggaagtggatgtggcgagactccggcctccctgcagtagactccaaaatccgcggccaggagttctccttggcgcagctcggccctcagtccccttcagtcataagatggctgctgggctggcagccgggatcccgggcgtcctgtctcctccctgcgcagtgaccgttccctggcctggagccctccctgggcagctctgctgccgcagcgccgcatctctcctcgatgactcgggatgcagggttcatgactaggaagagctttggtccatggggttcccagaccctccttttttctattaaaaatgtatggaagtcaccgcgaaaatattaaagaatttaatcagacagtcattcacaaattatagagcacccagctgtggtttgtagtttgtggtccatgggaagggcttgaaggaaagacttttataaggtgtgtgatgaagaaagccaataattggttaggtaccgttatgtagtttcttaatttgtaaattcagggtggacatttcctggttatgtcatcagaggttaattggcagtttatggttggttaagcctgaattttgtttccctcaatgttgtaatttacaaaaagtttgagttagatttttttttctttctttctgagacagagtctcacactgtcgctcaggctggagtgcaatggcagccatctcggctcactgcaaccaacgcctcccgggttcatgcaattctcctgcttcagcctcccaagtaactgggattacaggcgcacgccgccacgcccagctaacttttctgtattttagtagagtctgggtttcactgtgttgcccagcctggtctcgaactcctgagctcaggcaatccacccgcctccgcctcccaaagtgctaggactacaggcgtgagccaccgcgcccggccaatttgagttagatttttttaaaaaatggggaccctgggactggagctacctcagtctaattgcctgctacttaattgtgtacacactctacaggggatagattttcccctgaaattttcacatgtggcccaagcagagtctcaagactactccccacccccaattccttcagcctaactctggcttgcagtaaaataccaaatttccagttttttctgacattccgaaatgccaacttcctcatcctaattcacattattttagtgtacattttagatactgtattttaattaatcattttttgacacagcattggatagcactttagaaaaatttttttctgtttgaaaatatttcccaggagaagaaagcaaagaatcatcccctgacactgtattgtaaaaaaatctctgtgcctctttttaaaataatcttccctaggcacagagatcttaccaaaatgtttttgggtcaaggtttccctttggaaactttatggagtgctgtttcctcagccactcctcagtgttttcctggttttgagttttagtactgtctggggataaaccaagatacccacaatcgctatgtctgctacaatgtttagtgaatatcagctcctgggtcattttctcccataggacagtctcaggtatggagtgtagcttcttaaaagagcaggtggatgtcgtggggctgagaggcatctcctggtgcacttttttttttttttttttttttttttgagacagtctcattctgtcgcccaggctggagtgcaatggggcgatcgtggctcactgcaaactccgcctcccaggttcaagcgattctccagtctcagcctaccaagtagctgggattacaagtgcacgccgacacacctggctaatttttgtgttttttgtagagaggaggtttcaccatgttggctgtactggccttgaactcctggcctcaagtgatccgcccaccttggcgtcccagagtgctgagattacaggcgtgaggcaccccacgctggccacacttttttttttttttttttttttgaaaagctaacccgttgagacattaagattgtcttcacccaatccagctttcatttcttggagacagattgctggtcagccaatcagatgctggtattaaggggaaaacaaataatttcttccccctgaattctcttaacatttgtgaaagaaaaaatagtgtaccaaaaaaactaaaaaaaacttactccagtgagatggtgcaagaacttgcaaactaaaatgcatctggagcagtaactgaggtatagtgtctccgaagagggtggtcgttgagcacttaagtgagcaggatggggtgggagaatcaagggatcgtggcctgacttgacacgagtcaaacacatcagttttctaatcagcactgccactctctgggggtttatcatcttgaaaagatttcttcactttttttgacttcagttttttattgtaagttgcattttattagtaaaacttgaaaggtaaaaaatttacaaaaaggtgggtttcagggagagaaataatatctaattatatagtccatttgttaaaaattctcatttatctttttctttgccagaatgagtttaagaattttctcgggtgtgtcttttatgggtgagatcaaacagaattccaagtcttggcttttagaatgctaaccaaggaaaaaaatagggagaatctctttttaattttggctgtagaaaataaatacttttccacaagaatatgtagtagataattggtgagttacttagatttgtgaaaacatcagttcctctttatgcagagtacatttgtaacagtgaatatctctagtctatgtcctgttatcttgatttctgagtttaatgctgaattatatggtaaaacttggtacctcccagaagcgttcccatatgactgtttactacatgatttttaataaaaattataaaataatacgtttatcatctaaaaggaatggatacttttgcttttcttgttgaggtataaaatgtaaacaccttaaaatgtcttccccttatatgatcactgtgtttgagtaattttgctggattttttaaacacttactttcaaaaaccaagttaatacctctgacatggaaattaaagcttcagcccagtgactctaagctaaggctaatatggagcctgcaaaaggaggttattaaaggcccagttaggttctttttggggagcctcccctgcagatgtcccagcctgctcacaccagccatgaagaagcctttatactgagagaagctacagagcccaggaaagctggggacccacaggcagatgcagttaaagttaagatggaaggggattaggaaggtcttactggagatgaagttgttactgttttaaggcagtttctagacttacaaaataaaacaaagttatgtaaaaaaaaaaatttgaattccaaaagagtgttgcaacaggcaaagtaccaactataagatcttgaaggactgcaaagtttaggcagacaagattagaaagaaggtgggaggggatggcaaatagaaggtgggaaaattagattttatatcagagaatgttttaccctgaagtcagcatgttcttagctgggacataaaatggtgtatgttggttcagactgagggtagctcaaaattctgagcctgtgggaagaagataaacttaagtaaagtttgattaagaaatatttcctcttagccactgagaccagttcagctgttttttgtttgtttgttgtttgtttttaatgagaaaaggaaatgtggagtctgtgtttggttatgtgataggtaagaaaagagcaccatctaagtcataatgggagggtgtttctttccatcaactgttcctggagagcacaaaggatggataattttattaatcacagctatttaccaggattatctatgtgcttcatctttccccacctcttttcttggtcctatacatttcttccatttgagttttcctgcgttgtgtcttttataataaactggtcaacataactacagtgtttgctgagttctgtgagtagctctatcaaattattgaacttgagggaggttatgggagtcccaaatttttaaacagtaaccccagtgtatagatgggcctatggaatttgtgactggcatctgcagtgaggatagtgttgtgggactgagccctgaatcagggtctgtgctgaccctgggtggtgtcagaattcaaatgttagacaattagttggtgttagagaattgcttggtattccacaaactctagagatttggtaccagaggaaagatatcacagaagcctggcctggaatggaactctgggtgtctgggaatgggaggctctgctctcctgtacacagactgtcacactgcccgttgtcctgtgattccatgtctcctcccagggtgagcgagaactgacaacttagaggaaatgagctgtgataacagaccccttttttccacagctgccaccacaggattcccacccactctcaaacatacgcactagacattgatgtgtccacacccctcccaggactaggaaccaccctcaggaatttcaccacaacatttttgatcctggtattttttgccaaaaatccacaaaagtgtctacatgtctctggggatatccccacccccagacactgaatctgcagtagcaacctgcttcctctaccaacctgttcataatctcatctgcctgcatggacacaaatcagagtacagcccccctgggccactatctgatagcacaaacaaatccatccacttacattgcactattctccactcatggattttttttccttttaacttttatatttggttcgtggtacacgtgctgatttgttatatacataaaattgtgttgtgaggctttggtgtgcagattattttgtcactgaggtagtaagcatagcaccaaataggtactttttctgatcctctttgtcctctcaccctccaccctcaacttggcctctgtgtttgttgttccccgctttgagtccatgtgtttttgtttgtttgttttgagatggagtcttgctctgttactcaggctacagtgcagtggcatgatctcactgcaacctctgcctgccaggttcaagtgattctcctgcctcagcctcctgagtagctgaaattacaagcacctgtcaccacgcttggctaatttatttatttttaaaaatagtgacagggtttcaccatgttaaccaggctggtctcaaactcctgacctcaactgatctgctgggctctgcctcccagggtgccatgtgttattatttagcacttacttataaatgagaacatgtatttggttttccatttctgcattagttcactaaagatgatggtctccagctccaaccatgttgctgcagaggacataaccttattattatttttttagggccacacagtatttcatgatgtttatatatcatattttgtttttattaaatattttgttttattttggagacaggatattctattgcccaggctggagtacagtggggtgatcttggctgactgcagcctcaacatcctgggcttaagcaatcctcctacctcagcccccaaagtagctgggactacaggcatatgccaccacacctagctagtttttctttttgtattttttgtacgtacggggttttgccatgttgtcccaggctagtttcaaactgctgagctcaggcaatccaactgccttggcctcccaatgtgctgcgattacaggcgtgagccactgcacccaacaatatgttttcttctttttttttttttctgagacagtctccctctgtcgcccagactggagtgcagtggcacgatattggctcactgcagcctccaccacccaggctcgagcgactctcctgcctcagcctcccaagcagctgggattacaggcatgcaccaccatgcctggctaatttgttttgtattttttagtagagacggggtttcaacatggtgtccaggctggtctccaactcctgacctcaagtgatctgcctaccttggccccccaaagtgctgggattataggtgtgagccaccgcgcccagccataatgttttctttatccggtctactattgatagacatttaggttgcttccatgtctttgctcacaagtactattgtgtatagtgctgcaatgaacatgcatttgcatgtgtctttataatagaataatttatattttggggggtatatagagtatttttggggtattcaggttgctgaatcaaatggtaattttgattttagttctttgagaaatcatcacactgctttcacagtggttgaactaatttatactcccactaacagtgtataagtattcttttttttttgcagccttgcaagcatcgtttttttttgtttgtttgtttgtttttgtctttttattaatagccattctgactggtatgagattgtatctcactgtggtttttctttacgtttctctaatgattaataatgagcattttttaatatgcttgttagccacatgtgtgtcttctcttgaagaacatctgttcatgcttttttcctagttttttttttctggcaaacttgcttaagttctttattaattttggatattagacatttggcagaagcatagtttgcagatattttctattgttctgtaggttgtctttttactctgttgatagtttcctttggtgtgaagaagctctttagtttaattaggtcttatttgtccatttctgcttttgttgcaattgcttttggtatcctcaacatgaaatatttgccagttcctatatctagaatggtctttcctaggttatcttccagggcttttgtataattttaagtttcaaatttaagtctttaatttatcttgagttgacttttgtatgtagtgtaaggaaggggtccagtttcaatcttatacatagtactagctagttattccagcaccattaaacagggaattcttcccacattcctcttgtcagctttgtagaagatcagatggttgtaggtgtgtggcattatttctgggctctctgtcctgttgcattggtctatgagcctgttttttgttttgttttgttttgtaccagtaccatgctgctttggtaactgtagcctggtagtatagtttgaagtctggtaatgtaatgactccagctttgttctttttgcttaagattgccttggctattcaagttttgtttgtttttgtttcatatgaattttaaaatagtttttttttctgttaagaatctttttggtaatttgataaaatagcattaaatctgtaatttattttttttttttttttgagacgaagttttgtttttattgcccaggctggagtgcaatggtgcaatctcgactcactgcaacctccgcctcctaggttcaaacaattctccagcctcagcctcctaagtagctgggattacaagcatgcaccaccatgcctggctaatttttctatttttagtagagatggggtttcgtcgtgttggccaggttggtctcaaactcctgaccccaggtgatccacccacctcggcttcccaaagtgctgggattacaggcgtgagtgagccactgcactgggctaaagtgtgtacctttaatgcctagtttgttgaaggttttttacatgaagtatgttaaattttatcaaaagctttctctgcagctattgagataatcttgtgggttttgtctttagttttgtttatgtgataaatagcatttattgatttgtgtatggtgaaccaactttgcattttaaagacaaagcctacttgattatagtgaactagccttttttttttttttgagatggagtttcactctggttgcaatggcatgatctcagctcactgcagcctctgcctcctgggttcaagtgattctcctgctccagcctcccaaatagctgggattacaggcatgcgccaccatgcctggctaattttgtatttttagtggagacagggtttctccatgttggtcaggctggtttcgaactcccgacctgaggtgatccacccgccttagcctcccgaagtgctgggattacaggtgtgagccactgtgcctggccaagttatttgtatttttgtatgttcagtggtaatgttcattttgtcatttctaattgtatttatttgaatcgtcattaatctcgctattggtttattttattaattttttcaaagttttaacttctgaatttcttaatattttgtatagtttttttatgtctaaatctccttcagttcacatctgattttagttttttcttgtcttctgctagtttagggatttgctcttctcttattcttttatttgtgatattaggttgttaaatcgagatctttctaactttttgatgtgagcatttaatggcataaatttccctcttaacactgcctcagctgtgttccagggatactggtatgttgtatttttgctctcatttgtttcaaaaaacttcttgattcctgtctcaattccattatttacccaaatatcattcaagtgcaggttaagttccacgtaattgtatggctcaccgtaaactctgccttctgcgttcaagcgatttttgtgcctcagcctacctagtagctgggatcacaggtgcccgccaccatactcagctaatttttctaattttaatagagtcgacgtggtttcaccatgttggccaggctggtcttgaacagatctgaggtgattcgcccgcctcggcctcccaaagtatggggattacaggcgtgagccaccatgcctggccatttatgttgtttttagttggagagttctgtagatttctattaggattatttgatcaagtattgagtttaggtcctaatatctttgttaatttcctgcctcaataatctgtctaatagtgtctgtggggtgttgttttcttccactattactgtgctagaatcgaagtctcttcataggtttctaagaacttgctttattcatgtgcactcatgaataacacctcttttcttctgttccccccaccccataaacattctttaaagtgcacacagtgtgcccaaggctactccttagatgcctgaatccagttatctactgagttcagatgtccaagagttcaagagcatgtcctgagacctggctgttgtaggagaaaatataaattagaaataagaggctttatgattctgtttcctgaaaataagggagaatattttgctcttctctgttttcttaaagcatttagattatatgtagatatttttctgcttttttgaatatatgtaaatcatatgaacagctaaataaaccctttgtttttctttttgactcaggattcattttagttttttttttttttttttttgagattgagtttcgctctgtcatccaggctggagtgcagtggtgcgatcttggctcactgcaacctccgcctcttgggttcaagtgattctcttgttttagcctcccaagtagctgggactacaggtgtacaccaccatgtccagctaatatttgtatttttagtagagatgaggtttcgccatgttggccaggctggtctcgaactcctgacctcaggtgatctatccacctgccttgacctcccaaagtgctgggattacaggcctgagccactgcacccggccagcaacttattttctattcttgcagatccagtgattgtttcacaagtcacaaaaaagtaaatataaacacaataaaaattcctttaaactacattgaaattttcctttctgtgtctctctcatctgtctatattttgtttttattctatgcattttttaaaaaatcagtgacagagaaacagaagaagaagtaaaaatgctgggcccttcatttaaatcctgggaattattgaatgtttggtactagctcccagggtgttacgaggattcaatcacataatgtgttatttccagcgaagcgctgtgtaacatactcttgagagtgagaacacggtgaacacagtgtctgcttaataaacattgcagtagtacatgtgtacatgctgtttttcaaatgcagacttattcagacattgctgccttctgtttaatctgtaaactttaaagagacagcgaagaagatactttagggtggagatggattgtcttcacttgtgttatgacaagagtgctgagtgtaaggtacactttgctgtgcctgcttcctctaactagagctaataatgagcctaaggggagcaacatcagcattgacgaggacttgtttaaaacaccgattcatggaccctttgcaaacctgcagaataacattaaatagagttgggtcaaaattacgaagtgatttataagctcgttaaagtctgagaggcaatgcttagctaagtggttatcagctcaggcttctaatgaggattacatggccaatttgcagaaatctttttacttgtgccctttccacaagttctgtttaatgttcttggtggaagcatccatgttgttttaattattagattggtgcaaaagtaattgtcgttttcgcctttttttgtttttgagacagatttttgctctgtcacccaggctggagtgcaatggcttgatctcggctacttcagcctctgcctcctgggttcaagcgattctcccacctcagcctccccagtagctgggattacaggcatgcaccactacgtcctggtaatttttgtattttttttttttttttttttttttttagtacagatggggttatggggtttggccatgttggtcaggctggtcttgaactcctgacctcaggtgatccacccaccttggcctcccaaagtgctgggattataggcatgagccaccacacctggactgtttctgctatttaaaaaaaaaaaacactattattattacttattatttttatttcttttaccttgccattaaaaaaaaattggcaacagccacagttattttcacaccaacctaataagtgcctcatgtgattctagagtgagaacagaatcagctatgaggggttcaaaatacattcatgagagttaatttctgcctttgtactaaagggtggtcacagggccagttctgtttgagtttggtaggaacaggacagtacagcccatattgccattactgtagcagaaattgctggtgtctgtggcaagggagggcacctgaggatagataaagagaaactttatttttatctctgtggagtagctcattgttcctgaatctttgctgttataaagaacagaaacgggcgggctttatctgttttggagtttttcatgtcatctgcctgtgggtgtggtgctagcagataagcaggcggtgctgacacttcaaaggcacattctcaagatgcaggtgtgtaattagtccagagactctcatctgagaaggaatcccagagaaggaggagaaaaggggaaaaaatggccttttttttttttttttagctaaacatgtctcagatcaagagctgtgtccactctgcctcctggaatgccatgcgtttagtacttgtaaacctttgcttctctacttgcatttttcttccctattaagtttattttaactactttaaaaaattctcatgatagtcaagcatctctgaaaaatacttctttcctatataccagagcctactctactttctctacatcgtggcttcttatattccatgcagaattctcacatgactttgtgatgtgcaacattaaaaatgtttcctttgtggctgtggatactcaacattcctattggggaaaagctggtgccgagaccagctcggtcagggagaacctaacccagcggcgctagaggaattaaagacacacacagaaatatagaggtgtgaagtgggaaatcaggggtctcacagccttcagagcttagagcctcaaacagagatttacccacgtatttattgacagcaagccagtgataagcattgtttatgtagattatagattaaaagtagttcttatgggaaataaagggatgggttgaaataaagggatgggttgggctacttatctgcagcaggagcacgtcctgaaggcacagatcgcccatgctattgtttgtggtttaagaaagcctttaagcggttttccgccctgggtgggccaggtgttcattccggtaaacccacaaccttccagcgtgggcgtcatggccatcatgaacatgtcacagtgctgcagaggttttgtttatggccagttttggggccagtttatggccagattttggggggcctgtttccaacaagctggggtcctttgtaaatatggagaacatgtaatgttggggtttcatttgtgttctccattagctctatgcagaacagaattaacaaaatgcttatttaaacaggataacatttattacccaaaaagttctaaaaaataattactcagagatggccaggcatgatggttcatgcctgtaatcccagcactttgggaggttgaggtgggcaaatcacctgaggccaggagttcaagaccagcctggccaacatggtgaaacctcgtctatactaaaaatacaaaaattagctgggtgtggtggcacatgcttgtagtcccagctactagggagactgaggcaggagaatcgcttgagcctgagaggcagaggttgtagtgatcagagattgcatcactgtactccagcctgggcaacaagaaaaaaaattattaggagaaaactgctctctacggtgttgaagactacttaaaattactgttaaaaataacaacataagataggcacgtcgctcacgcctgtaatcccatacacttttggaggttgaggcggacaggagttcgagaccaggctggccaacatggtgaaaccccatctctactaaaaatgtaaaaaaaaaaaaaaaaaaattagctgggcatggcagcggcggcaggcgcctgtaatcccacctacttgggagactgaagcaggagaatcgcttgaattcgggaggcgaagattgcactgagccgagatcacaccattgcactctagcctgggcaagggagcaaaactgtctcaaaaaaaaaaaaaaaaaaaaaaaccatacacacaaaataacaacataagagttatctgtatcttgaagagggcataaaactgatgtttgtgtatggttaaattcagactataatttacttttgcgaggggcaatattgaagcagtgatgctgtgtttttctgtgtgcctcagcgcatcatacaaatctgtcctggttcagttgatgttaatgattcacttggtatacctatgtaacagaacatgtaacctatgttacatgttctgcacatgtaacccagaacttaaagtataataaaataaaagagctctctgacagatttatttttcttactatagagttaattatttttctcttctttattaagtatctttatgcagctgatgtgcataaaccatcacatttaatctggaagctgcccttctttcttaggtttcctttgtatatatttgtctttggaaaataaaggctctcatctttgtttacaggccagaaaaactgggaaaatcacaggctcttccacttactggatgtttgacaaaatattcttcttgggccaaaaacattggcattactggtgagcttgttaaaaatttggaaactcagactttattccagatcttctggaaagaaaatctgcataacaagatctccagtttattactgtacacattaaaattttaaagctagcttgtaacacagcatttcttttctatctgaaaaatatacacagctgattctgtatgatgtaaatatagcactcacaaatgtacgtgtttgtgttactaattttatactttattatctagaaaagtatcatatataaactgctattgtggatcttatgctactcttttctcagagttagagaacacatttgagaatatttctgttttgaaaattattttattggataattttagtcactcctataagtaaaaaccagttctctttactttcgcattccaccttgagtcaaattaaatattctgtccagagcaagttggtaaatatgtttttgtgtgtgtgtgtttttcagggaccactgacatttagggatgtggccatagaattctctctggaggagtggcaatgcctggacacttcacagcagaatttgtataggaatgtgatgttagataactacagaaacctggtcttcctgggtgaggataattttaatacataatttaaaggtttcacttctcctttctgtagaatgttttttggaaatttctgctttgcataaataaattttagatccctattttcaacaaaatcctggggatttgttcatttagaaatgaatttcttcaagatgtttcatcttgacttgaactttccacgttcttgagctactctgtatccttcactctagattaatggtaattccaaaaatttagtggcataaaagttgcccacaccgtaaaatctaattgccaccactaatttttcattccgtagtactgagtagtgaaattaagaacatacaaatttaaaatattttttaaatatttagaaatttacattactaattagatattttgggattaatttactagaatacttaattacatcctctttactgagcacattactggttgataattggagaatatgagcaagattcatgttactcatttttaataaaacaggtattgctgtctctaagccagacctgatcacttgtctggagcaaggaaaagagccctgcaatatgaagagacatgcgatggtagccaaacccccaggtaggtgagagtgatagcgaatataacagatgacacagatgacaggtctaaaggtcaaggagaaagtcagttcttaaaatgtgatttgggccaggcgcggtggctcacgtctgtaatcccagcactttgggaggccgaggcgggcggatcacgaggtcaagagatccagagcatcctgaccaacatggtgaaaccctgtctctactgaaaatacaaaaattagctgggcgtggtggcacatgcctgtagtcccagctacttggaaggctgaggcaggaaaatcacttgaaccagggaggcggaggttgcagtgagccaagattgtgccactgcactccagcctggagacagagtgagactccatctcaaaaaaaaaaaaaaaaaaaaaaaaaaaaatgtgatttgggaagctgcgttcaaaaaaagtagtttctggagagctggatttttttttttcctttgctctcacataggagcatattctgtcttatgcttttaaattctctaaggattctactttcccttcagtgattttccttcaagtttatggtgaaagctaaagtcctattcctggcatataggaaactgcacaatcttactgcttttccattgttttgggggacacacagatatctgcataattttgagaaactctgtgttaaactatttttcatgttctctttttgcatcacatctgaaatatgtgagagtagtttatattacattgggttttgttcatttttctgtacatttaatcctgtttttgttactatagtcttgaaatatagtttgaaattttaaagtatgatgtctttctactttgttctctttcctcaagattgctttggctattcaaaatttattgtagtttcatgtaaattttaggattatattttccattactgtgaataaaataccattgcaattttgatagggcgtttattgaatctgtaggtcactttggataaatggcactttaacaatatttattctttgaatccatatacgtaaaatatttttaagtttatttgcgtcttccttaattttcttcattgtaaagattttttaggctgggtatggctgctcacgtctgtaatctcagcatgttgggaggctgaggcgggtggatcacttgaggtcaggagttcgagaccagtcttgccaacatggaaatcccgtatttactaaaaatacaaaaaataagctggacgtggtggtgtacgccagctacttgggaggctgaggcaggacaatcacctgaacctgggaggcggaggttgcagtgagctgagatcaccccactgcatttcatcctgggcaacagagcaaaacggtcaaaaaagattttttacctgcttggttaaatttcttctcagaaatttatgatttaatgctaatgtaaataagattgttttcttcctctattttaccagatagtttaagtgtatgaaaccataacatacgcttgtatgttaattttatattttgctgatatactcagtgtatttattaaacaggttttcatgtactagttgtggtttttaaaagataagatcatgtgatctacaacagcaactttttacttatttgtcctcaatttcaatggctattttttcttttttttttttaaactaattcttctaatacatacttccagtgctatgttaaaatagaagcaattgacaatggcacaatatagttttgcattggtgtctgtgaatttgaagaaacaaacacatcttcaagtttttataacctggtttcagcaggtaaagatctttttatgttgggcccccagagtgatggtttgccctctgggtttgtagtggagaggggttgtagcttgctcacaaggatgctgggtctgcactagggtccacctttagttggcttgttacaaggagcttgggtagttgtaattcccattatatttttggacagactgaatctttcaggactttgctttgtagggcagacaccagggcaggtttttgcagttgggtctatatatggtgggccttttattaggatatggatgagtgtggatttcactgagtaccagagaggattttcccaggtcactgtgtggatttctatgtaggcagaaccggccatgaactgtagctcagggagctggaactgagtcattgaactgcttcagggaccatagtaaagcccaaggtctgcaggtctgtccgcatggctataaatgcatgtctttctctaagcctctggaagggcaggacctctcccagactgtggctgggaggagtttgggatggttacagagtaagttcagaattctcagtgagaccaagttgggtgggccatttcatggtctgcagcaaagaacaggggtcctgtagtttgcctcccgaatgagggcctgcctcctggaaagaacacccctcaatcttgagctttagcagagtttcataactccctccctggatctcaaagattctttaaaggcacttattttgaagatggggtgttgctgcataatccaggctggtcttaaaattcctccgtgaggcgattctccaaccttaaagtaccatgtagctgtccttacaggtatgagccatgatgcctgattctctcatagaggcatttttgtcagggatggctgacaaattttcttgttgtgaggggataaatgaatagggcaccttttatttttgcatcttactgatgtcactctccctacatagttttactttctatttgctagttcaaatttttctgttactttattttatatttatttttcttttttttttctttgagatagaatttttagctcttgtgtcccaggctggagtgcaatggcatgatctcagctcactgcaacctccacttcctgggtttaagtgattctcctgcctcagcctcccaagtagctaagattcaggcacgtgccaccatgcccagttaatttttgtatttttagtagagacgaggtttcaccatgttggtcaggctggtctcgaactcctgacctcgtgatccgcccacctcagcctcacaaagtgctgggattacaggcgtgagccaccacacctagccttaagttttctttgttttattaatttatttgaattttctatttttgaaaatggggtcttgatgtctactattattatgttggtatgtatttcctgcttcacttttgtcagtaattgctatgtatatattggagccctgatgttatacatacatacacagatagatacatataatagttatggattcctggtaaattgacctattttaccattatataatatcaatctttgcttcatgctaatgcttttttttttttttttttttttttttttttttgtgtgtgagacagagtcttgctctcttgcccaggctggagtacaatggcacgatctcggctcactgcaatctccgcctcccaggttcaagtgattcttctgcctcagcctcccaagtaactgggattacaggcactcccccaccaacatgcctggctaatttttgtatttttgtagagatgaggtttcaccatgttggccaggctggtctcgaactcctgacctcaggtgacccacccacctcggcctcccaaagtgctgggattacaggtgagagctaccatgcccagccactaatacttaaagcatactgtgtcagatatgattatgaccacctcacccaattgcggttactattttcacggaacatagatattttccaataggttactttcagcctatttgactcaatgctaaaatgagtctcttgtaggcagcatattttatgcttttttcttaagccactctggcattctatttcctttttttttttttttaataattgtatttatttatttattttcgagataggatctcattccatcaaccacgctggtttgcagtggtgtgatcacagctcactgcagcctcaaccttccaaactcagatgattctatcatttcagtccctcaagtatctgggttacaagtatgtaccattatacccagttagtttctttgtttttgtttttttgttttttttttcccccggagacagagtctccctctgtcacccagactggagtgcagtggcatgatctcggctcactgcaacctctgcctcccaggttcaagtgattctccttcctcagcctcctgagtagctgggattacagcgactaatttttgcatttttagtagagatggggtttcatcatgttggccgggctggtcttgaactcctgacctcaagtgatcctcctgcctcagcctcccaaagtgctgggattacaggtgtgagccactgtgcctgactagtttctttgtattttttgtagagacagagctttgccatgttacccaggctggtctcaaactcctgggatcaggttattagtccatgtcacacctgtaatcccagcactttgggatgccgaggcgagtagattacatgaggtcaggggtttgaggccagcctggccaacatggtgaaaccctgtctctactaaaaatacgaaacattagccaggtgtggtggtgcatgcctgtaatcccagctttaccggaggctgaggcatgagaatcgcttgagctgaggatgtggaggctgcagtgagccaagatggtgctgctgcactccagcctaggtggaagagcaagactctgtctcaaaattaaaaaaaaagaaaaaaagaaaatcgcaaaatttacaataaatattcttaaatattcagtttagtcatactaattatattatgcaacattttactaagtgtttttatcttacaaagctagtctcaacacatattaaacaactaccattttttcccgttttcatggcacttttcaaacactactcttttttttctaggagtgtaactgcatcatatatctcatacaaactctgtctttttgtggcagctcattttattttgcataatgtcatcaagatttatcgttatagttgttagaatatcttccgctttttgaaaactgagtgacagtccagttttattgttgttgtttgttttgtgtgtgtgtgtgtttttttatttttattttttatacagattctcattctttcacccaggttggagtgcagtggcgtgatcttgggttactgcaacctctgcccctcgggattcaagtgattctactgcctcagcctcccgagtagctgggattataggcgagtgccatcatgcccggctaatttttgtatttttagtagagtgagggtttcaccatgttggccaggctggtctcgaacgcctgacctcgtgtgatccgccctcctcagcctcccaaagtgctgggattacaggcatgagccacagtgcccggccaagtatttttatatttcagatcatatctactgaatgatttggtgacagaaatttgcattgcttttacctattggctttcagtaacaatggtataataattatgggtatgaaaatgactcttcatatgaccacatatgtgaaagtatatatatgtgctgcattctattttactagtctcctttttttttttacctttatacttgtagcaaattgttttaattctgtagctttgtaatatgttttaaaatcagaaactataatgcttccaacattgttcctttttttgaagattgttaggtactttattgtctcttgagattccatatactttaggggttgctgtttttatgtcttcaaaaatgcaatgagaaattgagaaaacattgcattaaatcttgtagattacattgagcagtatagacatcttcccaatatttcaacttttgaacaaaagcatgctaaagaatgtggtttaatttactatatatttgtaaacttgttagcttttaatattgttttatattgtcattccatttttgttatagaaagtaatccataaaatttcagttctaaaatactttttaagactcttttgacttatttggtggtctgtcaagaagaaagttgtataagctattgataagggtgtgtatcttaatgttgttgagttttgtatacctatgttaggaatatttgttttatactgccttcaggtcctctgttctcttactaatgttctgtcttgttttattcttactatagaaaatgggatattaaaatagtctataattatattgttctctatgtgtttcaattctgttgatatttgctttatatatttggaacactaatgtgagacacacactcacacatacacacacacacacacacacgcgcgcgcgcaaatttgtcatagtttctcatgaatctattattgtttaatgtccgtacttgtctctttggagttttgacttaaagtacattttataaaatacgacagttacttaagatgtagcttgtgtaatactattttgacgtctgctgctctcgttttgttaatatttgcatggaatattacttccatcttgccactttcagtctttttattattagatctttgctgagtcttgtagaaaggcaacttggatctggatttttcaaatttttttttttttttagggggagtctcattctgtcacccaggctagagtagtgcagtggcaccatctcagctcactgcaacttccgcctcccaggttcaagcgcttctcctgtctcagcctcccaagtagctgggattacaggcacccgccaccatgcctggctaatttttgtatttttagaagagatggggtttcaccatgttggtcaggctggtctcaaactcctgacctaaggtgatccaccgcctcggtctcccaaagtgctgggattacaggcatgagccaccgtgcctggccgatttttcaattttttaaataaatccctttattaaatgtatgtctcttgatcggaaagttaattatatatattcaaataattttctgaaggagaaagtcttactaatatcattttattagttttatttgattcttgtatctttgtctctcattttctttatcttctgtgtgtctttgcgatttttgtatcgatatgctttcatttctttcttatttgtgtatccatacagatattttttggggtaccttggggattacataaaacctctaaaagataaaacaatatagtttaacctggtaaaaaaaattaacttcagttgcatacaaagtttttttgtttgtttttgtttttttgagacagagtctcgctctgttgccaaggctggagtgcagtgacacaatcttggctcaccacaacctctgtttcccaggttcaaacaattctcctgcctcagcctcctgagtagctgggactacaggcgcgcgccaccatgcctggctaatttttgtatttttttagtagagacagggtttcacaatgttggccaggttggtctcgaactcttgaccttgcgattcacccgccttggcctcccaaagtgctggaattacaggcatgagctaccatgcccggctgcatacaaagttttttcctcattacatctgccctcaaccttgttattgatggtgctaattatctttttatgttgtatgtctattaacagttgtttataacaatttctatgcttttatctttcaagttctagagaataattaaaaatgtgtactgcaccattatgataatgctaaggaatagtatttttgtgtatgtgcatgtctctcccagaaagttatgtattttcatatgattatgtgttgttttcttgcatcatgttattttcagtggaaataactccttttcaccatctttgatatgtagggcaaatggagtgccaatatactttttcaggatttggttattttggaagatcttttcctttttatctggtaggacagttttgctgatggtattattctcacttggcagctttttttttttttttaaggactttgactatatcacacagttttttctctggcctgcaaaattttcttgactaattcactggttttctcataagactatccttgtaaatgacacatcactttcatcttacagttcccaagattgtcttgcctgtgactgttgaaatcgtgcttatatatgtgtgtgttataaatatctttgtttgtatcctagtttgttgagcatcttcatttttacatcagattttcctacttttaaaattttttagtttttttgtcattttaccttaacaatttgtttttgatatttttaacacttgtttttatcctcatatttctgattttcagtagttgtctgtgttcctatttaattcattgagtattattcaatttattttaaatttttaaaattaatttttacagcttcattctttaatagttgctttcagaaaattttataatgtttttgatgaggccatgttgccttcctattttgtatgcattataattttttattgagatttggacattaaaaacaagctacccatcacaatctttataacgtatctttgtcttggcttagtctgaaaccaactgtcttggctagagattttggtagtctctcaaacatgttcttaaaatgtgtcttttctgaaattttttgggttttttagttaaaggagtttgttcatgtttcttcttaatagtcagtaatcacttgctacacctgttccttgtctgtggtactgcagtttctctgctgctgcaacattcaccttgggtctcagctgactcaaactgttattccatagtatatcaccatttcttttgcatttgtcaggagagacagaaaccagtgtctggaaaggcccctagaagtctgaaatgaatatgtgtgtgccactgtttttcttctcttttcaaaaagaaaccaagagttggcaatttactccttttttttgagacagagtctcactctcatcacccaggctgaagtccaatggcgtagtctcagctcactgcagcctctaccttgtgggttcaagggattctcctgcctcagcctcctgagtagctgggattacaggcatgtgccacacccggctaatttttgtggttttaccagagacaaggtttcaccatgttggtcaggctggtcttgaactcctgaccttgtgatctgcctgcctcggcctcccaaaatgctgggattacaggcatgagccactgcacccgacctgcaatagacttttccttctatatggctctttgcattgtgcttacctggggcactgcacacacttaactcatttataaattttccacaaatgtatcttggtcagtatgtttttgttacattgatatgtctgtgaaggaattagggcctgtggtattttgctataccatcttccttatgtagtttgtatatttttataggttagatttgtaaagtatattcatctgagtctagtaagtggggtaattgttacttttatttctttcagttgtgtgttctcattttgcccaagacctttggccaaagcagggcttaaaagattcttttcaaaaagtgatactgagaagatatggaaaatatggacatgagaatttacaattaagaaaaggctgtaaaagtgcggatgagcataaggtgcacaaaagaggttataatggacttaaccaatgtttgacaactacccagagcaaaatatttcaatgtgataaatatgttaaagtccttcataaattctcaaattcaaatatacataagaaaagacaaactggaaagaaacctttcaaatgtaaagaatgtggcaaatcatgttgcatactttcacaactaactcagcataagaaaactgctactagagtgaatttctacaaatgtaagacatgtggaaaagcctttaaccagttctcaaatcttactaaacataagataattcatcctgaagtgaatccctacaaatgtgaagaatgtggcaaagcctttaaccagtccttaactcttactaaacataaaaaaattcatactgaagagaaaccttacaaatgtgaagattgtggcaaagtctttagtgtattttcagtccttactaaacataagataattcatacaggaacaaaaccctacaattgtgaagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactcttactaaacataagagaatttatactaaagagaaaccatacaaatgtgaagaatgtggaaaagcctttagtgtattctcaacccttactaaacataagataattcatactggagcaaaaccttacaaatgtgaagaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtggagttttccttattgcacaggaaagcatttatacttgagaaaaattgtataaagaatggaaaagtcattaatatctgctcatatcttaacatcagcgagttggtatttaataaaagcattatcaatgaaattactgtcaaaagatctttcagacaatataagcctgcaaagtgcagcagagtatttattttgaagagaaacattaaaagtacaaagaggtttgtagtacctttgtttgtatcatagatcttattgtacacattttgtaccagagaaaaaccctgaagcagttgttcaaactttgttcaataccaggaaatttatattggagaaaaaccctatgagtgtaatgaatttggaaaaatatttttttcaacaacagcttagaaaacatgggaggaattacactaaaatatatttttgcaaatgcagcagtaaatatgaaagaaatgatccaaagttaggtttatataaatatcagagaattcacaatacagatatctaagatactgacacttcagacattacacaaaatcagagtgctgagtacagaaagttatccaaaacaaaagttggtagataactaatagtgaacaagtttttggcagaggtatatttacattcagagtacacttttctttggaaaaaattacaggttttttgaaaagtgaataatgtaattcaactctcaaattcatggtttttttttttttggttttggttttgggttttttgtttgtttgtttgtttgtttttgagacggagtttcactcttgttgcccaggctggagtgcaatggcgtgatctcagctcaccgcaacctctgcctcccagattcaagcaattctcctgcctcagcctccctagtagctgggattacaggcatgtgccacacctggctaatttttgtggttttagtagagacagggtttctccatgttggtcagtctggtctcaaactcccaacctcaggtgatatgcccgcctcggcctcccaaaatgttgggattacaggcatgagccactgcacccggcgcatgttttttcttcattcctattgtattcacatgtgaaagcatgtgatcaacttgctgcatcaaagatatgagatttttttttttattaggtgggcattatttatgaccttttctgtggaagagtaagaacattaaaatgaaagatgcatgatgaaaatctaagtagagaggctcttgtggttaactgataatattgagtgatgcatgaggtaggtgttcagagtaatattctgcattatagtgaaaaatttttaatattaaaattcaattatatcattttatgaattgtgcttttcataatgcagtacatttcaaaatttttagattatgtatgaacttagatttttaaacatgttttaacatgttaagacttgtgcattcagtgaagcgttattatgccacaaactaacctacctcaccttactcaatggtgtaggtaaaagatgatagcaatatattatttggttacatagtggactaacatttttagtaatctcttttgccagtggctttaaactgcagataagttaaatattcccataggttttacatttatattttttcttatttaaatttattgttcttatttttcatgggtacatagtatgtttttatgctgtatatggcatgttttgatacaggtatataatatgtaataatcacatcagggtaaatgaggtatcccttactagcatttatcctttgtattttattttaaaatgtacaactaaattgttatggactacagggttatttttatggtcataataaaaattacaaaagtatgaataaaatacatacatttctgagtcctgaatatttttaaaaatttgttatatatttttcttctaacatgtggcctctttgcctgcaaacatataaagactcagttttgatttacatagagttaaatatacatatattttactttaaagataaatcttaagtgtaagaaaattgtagagtaagtgtgcttgtgtgagtatgtttgtacctgttttcaaaagaaaacagcaatattggaacaaaacaaatcattttaataaggtgactaatttattagaaaactaacaacctcaaaaatgctgaaagcaaatctatactctctctgctttgtactgaattcattactgtaaaatattatggcttatggttcagaatctccccatgcagatgttctgtttttacttgcctggtactcatggtagagccatacatttcttttttcttacaatttcttttacagtttatgaagtattatatgagctggtcagggattacaacaattattttttttataaaatttagtagtgcacaaaaagtaatttttagatgtaattttactattagtctattaagttatattttatttatttagttaaaacattgccctttgttcttttaattggagaaccctatgtaagccgacttttttaaagttattctttctttcacttttcataattttcataagtaaatttatttatttattgaatttgttcaggtaagtactagggaggcttcctgagtcatgaggatgctgttctatataaacatagcagacaaacatgacagtgcttgatctataacagatgctccatagtaagacataaatattcctgttgaagttagtttgtaacttcaagtcagaaatggaatatatcaatggtgaaacagtaacattgatttttcatgtggagaggacattttttttccaggctgcgaagctgaattctgccgaatttaaagagaaatgctggttattttctaattatattcagttttgtttgtcttatgtgtattccaacaatgtgtgcatcacagctcttctttttctgtgttatggctacagttttcttgctgttgtctttatgccatgtcatttcacatggtaatttagtaagttttgatgagaaatttgatatttttagtgcactgaaaaattggttttaattggtgagtttgcttaccaatataactgtcagattgttaagataaaaggcatacgctgtccacaggtgagaggattaaatcacttagcattgtttttaactgtttgtaaaaaaaaaaaaaaatatcttactagattcttatacaaagtgtggcaaatataaaatttgctagaaaatatgttagaaatttatttatttatttatttatttagagatgaggtttcactcttgttgcccaggctggagtgcaatggcgcgatcttggctcaccacaacctccacctcctgggtttgattctcctgtcacagcctccctagtaacttagattacaggcatgtgccaccacgcctggctaattttgtatttttagtagacagggtttctccatgttggtgaggctggtcgtgaactcctgaccttaggtgatccgcccacctccgcctcccagagtgctgggattacaggcgcgagccactgcgcccggccagaaattaaatttttaagagagctaatggtaaatctgactcggcacggtggctcatgcctgtaatcctagcactttgggagcctgagctgggtggattacttaaggccaggagtgcgaaaccagcccggccaacatggtgaaaccctgtctttactaaaaatacaaaaattagccagctgtggtcgtgtgcatctgtagtcccagctactttgaaggctgaggcaggagaatcatttgaacgcgggagtaacgttttcacacagaatctatttttaagtgtgactgtaaaacattgcaaaataataaaatgacttctgttgacttgaaatttggaatagtatttcttttccctattaatattacaatttggaggaattccttttttagatgcagtctcactcttgtcacccaagctggagtgcagtggcgccatctcggctcactgcaaccttcgcctcccaggttcaagctgttctcctgcctcagcctcctgagtagctaggattacaggcacctgccaccacgcctggctaatttttgtactttttagtagagacagcgttttgccatgttggccaggctggtctcgaactcctgacctcagatgatccacccacctcagcctcctgaagtgttgggattacaggcgtgaaccactgcgcccggtctcacttttcttaatatatatttttttggttggtgaagttcagtctacagcttttattcttagtcacctatctgtagccaactccttggtcattttctctggaaaacttttggagatcagggcaacttttggattaaaacgttttctatttttttgcatgcaaatttgtgttctgccttcacagaatggtgtcatgggaccataagcaacacctgcccttttagtgtctttcataccattaccatctgtaccagaaactccaggtaccccaagcttaaagtaaaaaccctaaagtacattggcttttcccacagactgtactgggtccagaacatgctgttaaatatcagagtttctgtgattatgacagatgacaaaagccacacaagaactaagtatttttgatactattcagccaagtttatgaaacagacacagtatttgaaacattattatctttctataatgttttaaaaatgaattttttgatgtgacataaaatgcatttttttctgtaaaacatgatgttttgaagtatatatacaatgtcaaatgcttaattccaagttaatgctttacctcacatagttaacattttatggtgagagcacttcacattttcttagcatttttcttagcacttttcattttttcagtattagcatatacaaatacattattatgaaccatagtcaccgtgctgtacagaaaaatcttttgaacttattcctcttatttaactataattatgtacctgggattacaggcacccacaactatgcctggctaatttttgtatttttagtagagatggggtttcaccatgttggccaggctggtctctaactcctgacttcaagtgatctgcccgcattggtctcccatagtgctggaactacaggcatgagcctgcagcctggccaagtttcttacatttttttttatattaaagtcttgtcacatgtatggtttgcaaatattttgtcccattttttacttttcttgtcctgtttgttgtatcagatttttttcaacagctttttattaataatttgaagtaatctgacatcaattttgcctttgattctctgggattttgaggttaaatcaaaagaattactgcctagaccaatgtaatggggcttttactctatattttttgtagtagtttcagagattcaggacttacatttaagtaattaaactatttgaatagatttttatatatggtgtgaaatgagggcctcattgctctgcatgttgctataattttcttagcaccatttattgaagataatgccctttccctaagaaagtgttacctatatttaaattgagttagctgtaaatacgtggatatattcctggtttgtctttactgctccactggcatatgtgtctgtttttattcaagtaccatactgttttgagtactatagcttggtagtatatttcaaagtcaggtagggtaataactttagtgtttttttttcttgattgctttggctatacaggatcttttgtggggtatcatataaattttagatatatttaatttttattaagtatgtcactggtattttgataaaggttgtgttatatctgcagattattttctgtaatatggatatttaacaatattaatgccaattcatgaattagtactatttaattggtttagtatttaatttcttcctttaatgttctttagattataatgtaaggtgttttaactttttggttaaactgatttcaaagtgtagttattacatttattgtagatgagattgcttttaatttcattttgagatagttaattgttcttgtgtagaaatgctactgactcgtgtgttgattttgtattttgcaagtttaataaatttgtttattagttctaagtgaagtcttaggcttttctatacctaagagtatgtcatctgtaaacagggataatttaactttttttccaagctggatgcctttgattttattctctaaattttctgacttggacatttaatactatgtttaataagactgatcgaagtgggccttcttgtcttgttctagcttttagagtaaaagcttacaacatttccttgcttaatatgttgttagctgtgcattttttttggtatatctggtgtatattggcttgaggtgcatttgtcctatacctgttttattcagagatttatcatgtatttatcatgtatgttgaattttgccagcgcttattctccacctattatttatttatttatttattgaaacagagtctcactctgtcacctatgctggagtgcagtggtgtgatctcagctcactgcaacttctgcctcccgggtgcaagctattctcctgcctcagcctcccaagtaactgggattacaggtgcacgccactatgcccagctaatttttacattttagtagaaatggggtttcgccatattgacgaggctggtctggaactcctgacctccagtaatccactcacctcagcctcccaaagtgttgggattacaggggtgaatgcataaacagttatgtagatagtttctcttagtttaacaagataaaagtaacagttaaaacatttgaaatgggataaaattaatcaaaaattgataaaaaatcaatagctttgcataattgccatgctttttgaaatgaccagattactaaaaagaagcaaagacaagatttttgctttgctcaattattaagttatggatattttgaaatctaaaatcctggctaaacaacttgaagggagaattcttcaggtagcttcctagggtttccaaggcaatacaagaagaattttgataggcaggaaaatgcatgctacatacacatattattattctctgatttcctttcacatgtaaaaattgaaaattgcaaatctggtctttcaattagcaaaagatttatttttcagcaaagcaaataactgtagaaaactgatgggggaacaaatgccattagctgccaaaaacagtatgaccagattcagtaagtatctagtcatgcaaatcacagcccaattaaattaagaccccataggtgcatgtggacagcatttccatgcaatgtggtgcacctccactgggcaccttcttctgcctgcttacagagataccaatttcccctgagtgactcaaggtgaatactgggaactgagaattctgtgttcagagggattactgggaacatggttaacacacttttaccatattataataaaatttgatgtatcctactctgcctcagaaaggcttttggtaaaagattgtttatttatagtactcaacctggattcatgaaaaattataatatattccaggtaagtcagagacacttaaatgtcaaacaaattttataaaacacacttgaatgagataaaagtcttcttagctaaaaattttttcagtaaatttagggaaaaatagaaaaccggtactttgtgttaaataacagtgttttgcacacaagtgctactcaaatgagtgctcttcattgtcattaaaatggcaatagcaccatgtgctttcctggcaccagctggcttgttttttattggtgtaaagtgaagaaggcattgaaatagagaagaaaggtgacagaaattgaatacttgtataaaatgcaatttttaataaaaagcatttgatgttgtacagctacaggtaagactatgaagtcatgttctattgacagaataactttattcacaatattcttatttcaaatgatattacttttttggctatacatttgctagcctttggtgaaatattacctggcgcaatagaaatcaacaaaatgaatctttattttaccagaagcattttactatgattcatatgcttattttgcctaaaatacattagctttttatgaaagacttatacttttctttcagtgatttctatattgctaagaagtggctgtcctgccaggaaactgctattctcagctctacccacattgactaatagtgagtgaaagtgatgtgtggataagaagcaaatgtgtcttctctgcatctctttttaaatgtagtcactgaagaaaaagaatgcggaagatagtagataaaatataatgtgattcctgaaagatcacgaagaagtcctcttaaccagaaagaaagaaagaaaaagaaaaaggaaagaaaaaccacaggggatggtgatgtgagcagaagatatgttatttttctaagcctctgaaatttcagtatacaacctgcattgctttaacaaatacataactccttcagttttgcttttcaggatataattccattccctggtgaatcaaaacagagaagaatagcttatatgttaaggtaagagacataaggaagacccattactttggaccaacatctcctccacccccaattccaggcaatcatcattctactctctgcttctatggtttaaattttttgtacactctacatagaaaataatattatgtggccgggcaggtggctgtcacctggaatcccaacactttgggaaacccaggcgggcagatcacctgaggtcaggagttcgagaccagcctgaccaacatggagaaaccttgtctactgaaaatgaagaattagccagatatggtggcgcatgcctgtaatcccagctactctggaggctgaggcaggagaattgcttgaatccgggaggtggaggttgcgttgagccaagatcacgccattgtactccagcctaggcaacaagagaaaaactccgtctcaaaaagaaaagaaaagaaaagaaaaataatattaagtgggttcttttctctgctgacttattttacttagcataatgtcctccaggttcattgatgttgcaaataatgagagttgcttcttttgaagggcagaatagcatttcgttgtgtaaatataccacattttctatattcattcacctgttgattaacacttaggtttaatccataccttaggagtaattgtgaggaatccacttcctttttttaatttgtttttgtttttataactctccttttatttttatttctagaagtattttaatttaataatataacttatgactgttacatatcttcatttgagcttgatttgggacatgagctatgtgcccaggagaaattagtttacatccttggagcttcaatctacattattaataaaagatactatttttccaagggctgttttaatttatacatagtagctataagcatttttcactgaaaggctcttctaaatatagcaaatatttaagaataagaatttatatttcaaagatttttaataactgggtatattttgtcatatttagtgtattcttttgaaaaatgccaaaataagaattttattatttttcctggaataacagcctaagggattctgcattgtggctttgctaattttagcatatggttttgactgctacaattgaaattaggttgaattttaaactcactattgtttagcttgtgtggtttttggttcatttgcagaaccaaatatattggacatgaagtgcgtggggtgacttggtttcatttctactctcttttgttattacatttggaactttagaaatgattgggttcaaataaggttggttttgaatcaagcaacagaaaatcccagaaatcactgagagaaatagctactgcacagtgcttttcaatgagatttatacatgaaacagagtttattgaaagtttgttgaaattagaaactaattacctgtaggcacatattaggcacttgtcttagtttgtctatggcatccctagcttggggaagctgacattacagaaaagaatattgctgcggtaataagatttggaacaaatacttatgtgtttgtaaacctttgccttaataatccttagataaatgtcattctgactcaatccttttggcacaactgcttaaaattctacagtctccttcccaccaaagtcaactcatggaattttcagctttttatgttttgattttttttttaacccagtaagctttatagttgacatcattatattgagattccccaggcaattcctgagccttaagagctgaccatcttacctcatccttcttgtttcacattgtctgttgctgggtccctctcactccatatttgagccttaatgaggcctcagtttggaggaaccaaaggaaagcgttgccatatatgttgggttgagaatcaggatcctcttgaggaaaaagacttttcattattcatagtacaaggctgtatttttgagatgtggacatgaatcactcaaataattttatcaggatgccaatatgctcaaaataaatatcaagttcaccaaatgttttgctttggactcccacagcacaaagatcactatataagcattgactagttttttttggtgtaggtttttgtttttaagatattttcctactttatgctgatgtcaagctacacaaagcttaccaaaagctttattttaccaaattttttatatcaaaagttcaaatacttaaatatcgaaagttaaattctggattaccattttccatgtgatgtagtttgcatttattagtactacctttcagcttttagttatgtggtgcaaggttataaaaatgccttccagttgatttattttatttttttctcccgagacagagttttgctcttgttgcccaggctggagtgcaatggcgcaatctctgcttactgcaacctccgcctcccaggttcaggtgattctcctgcctcagcctcctgagtagctgggattgcaggcatgtgccaccacacccagctaatttttgtatttttagtagaaaccgggtttcactgtgttggtcaggctgttctcgaactcctgacctcaggcgatccacctgccctggccccccaaagtgctgggattacaggcatgagccacagcgcccggccggccttctggttgactacctaggtaacagcagagtctgttttctcagacagtagcataagaattcttgatataccacctttagaggtactgaacacaactggatatatgtgctgaaatatagatttatctataaactcattagagactaagtcatggcaacctgttacagttcaatatttttgtctaaattcttgttgagccacatccatctgtatacgtaatactgagttgctaacagcttctttatactaagtcataactcattttaccttgtagtttcatttgaaacatatgagctgtattatataacattcaaagaagtaacacaaatttaattcaaagactatggaaagaagagtcatacaggcacagacagtgatttggaatctggcaggagacaatgattaacaggttgagcatattcaactaggcctaaatccctgaaacaatactgaaagacattttttaattaaaaatatattgacactttaatagatctatgaaatttgaaagaaaatgatttgtttactcatcaatcaataaaatttttgaacaccccataagaaaacaaaataaaattagtcaactatccccagacttactaaaacaagacttcagcatgtttgaaaacacaaattattaattaaatatccatttttaggccaggtgcggtggctcacaccggtaatcccaacactttgggaggctgaggcaggcagatcacctg

SEQ ID NO: 1208 - DNA, 28592 bp, Homo sapiens
aggtcttgttatgttgcccaggcaggtcttgaactcctaggctcattctatcctcctgcctctgccctcctaagtgctaggattgcaagcatgagccatcatgttcagtcctattaatttttcttaaaaaagataatgaagtaaactttgcattcagtaatctcctgttaagaatatttttggtgaattttgatgaatacatgattttgtgatcacaaaccaccattaaagctgtgaaatatttccatcacaagaaaatattccttgatatagtcaaactgtctcccaaactccagctataaggcccattcatttaggtttttctctttttgccttttttagaatgtgaagtgaatggaatcatataatatgtggttttcagatattttcacttggcatatgattttgggatttattcattttatttcatattgtttcttatatagagtagtttattttgtggatatgctacaatttgttcatctgttcacctgttcgtgaacaattttccaagtttttggctgtcgtgaataggacgttcatgaatatttgctacagatatttggatggaaacattttaacttgtcttttgtaaataactaagagtagaattggtatatcatatggtatgtttatatttacctatataggaagctgtcaagttgttttccaaaatgactatcattttgcattctcatcaaaaatgtatgagagtccagtgctgcatctttgtcatcacttggtatttattgtcactttgaaacattttactaatttcagcaggtgtgttgcagtattttatttgggttttaagttgcattgctaaaatgactcatgatattgaatatcttttcatgtgttcattgttgatttgtatatctttagttatttgtccaaatcttttttttttttttttttttttgagacagaatcttgctctatctcccaggctagagtgcaatggtgcaatcttagctcactgaaacctctgtctcccaagttcaactgattctcatgcctcggcctcttgagtagctcggattacaggcacgcaccaccacgcccagctggtccaaatcttttttcaatttttaattgcttttttcttcttaacacgaaattacataactttgctttaattttctcctttttaaatgttctatattatagtcatttctcagttatatgttttgcaaattgttttttttttcagtctttgacttgccttttaattttcttagcagtgtttttggaagagtagatgtcttaaattctgatgtaataaaaatattttgtctttatgtttttttgtgtgtgtcctgtctaattagactttgcctactgcaatgttgcaaagctttgacttatgttttcttctaggcattttatatttttagatcttttatgtggtctgagacccttttttttttttttttttaacggaatctcgctctgccacacagactggagtgcaaaatgatacaatcttggctcactgcaacctctgcctcccaggttcaagcgattctcgtacctcagcctcctaagtagctgggactacaggcacatgccactatgcccagctaattttcgtatttttagtagagatggggttttgtcttattggtgaggctggtctccaactcctgacctcaaggtgatccacccacctcggcctcccaaagtgctgggattacaggcgtgagccactgagcccggcctgagttaacgtttatatatgatctgaggtaagggtttcacattaaattaaatgtgttttataacccaacaaatcactctggggacataaccattaggaatgagggctttcttacaccaaaatacatgtacacaaagatttataacaatttcacaataatcaacaactataaataattcaaatgacagtcatctgtaagatatttaagtaaattgtgaaacagtcataaagtggaagaaaacacacagattaaaactgttacttttgtccaacaagatgaatgaattttccaggaaggaatacttgagttggggcttgtggaagccccaacctgtttgtagtttggggttgccatctgcctcacagagcaaagtgaagggtttggatttggggaacacaaaattgtgttctcctatgaaaaacctttctgtaatatagttggccgtggtatttgccaggaatgaaaggtcagggttggagacctcatgagtctgggttttcatttgaggttaagagaaaaggtagtgattataatcagaaaatctagagtgggtgtaattacctccagaactcactactgttagcctgggttttatggtagttatggaagtggattaactactaatgataaaaaatatagtctcctccacctcagaaaatctcgagtggcagtgacacgccaaacacacagtagcaaatacagtagaattttattgatacttttttaaccagacaaacctcataaatggtgattttttaaaaaaacagaataatgttcacatttttgcagcattaactgagagaaggcaaatttgtgcctgagagggaggaaatgttctcttcatttgcagttctaggaattacatgggaaacacatgtaggtagtcttcaagctataaatttaagatttgtttacttaatctataggtttatacatgtatgagaaatgggaaaaaagaataaatgtaatacattaaaaccaatacagtgaatctccacaccctccaatgaaaatatggaacaaaatctcagcatgcccagcatgagtctgccagattgcaaattccatccaacgcttcagaggatgctattatcaagatttcttcatagtttgacactttaaatatgtgtcaataatgatagctattatattatggcctgattttgaaatttatattaatggaatcatgcttgtagagatgttttttcatattaccgggatatatttttctgttatttttaaagatgtttgaaatgaatgtatatctttctaattatcatcctttgttgataacatgtacattaaatgggattgctttaaaattcattgaatctcatgagaatatgtagaaatgacattagttttggtacattgtaaagcaaaacttcaggttgaatatcctatgataatttaaaaccacaaaattatactattaataatagagcttgagcactttaagggaccatagagactcctttaatgtaatggtgagaatacagaggtacagagaagtcaggtgactagccgaagcccacactctaagataaaggccgaccccatctatttttcctaacttgtcagaatactgtaaattatactgcttttaaaagacctatgaaattggtgttggagatgccatcttgcaaataaaatattctcaaattttgattatctttgttttctttatgcatgggttacttagcgttttgtgacttgatatgcaaccacagcttaaaaaatttccagttatcttctatttttgatctgtaccctgattgaattattttatttcattttacacaagtttaaagagatttttaattgtcctagctattctcagttttgtttgtactctgtgctaaaacatgctgcaattggtgtctgttatgttatatggatttatcaggccaaatgtgttcatcatggtatgtgaatccaacagaactgtaccaatgttatgcctgcctttttgatattattactgagataacgaatatcaaagcagactggtttgtttagagatttaaccctttattctcattatactaaaattgttttatgtaatttgaattcatgtttaaaattgtaaagtatgttttcctgttgatattttctcccttatttctatttgtccgatacaaatgtgcatttttttgtgtgtgtttgtgtttaataattacaggtatgtattttctagacctcgatttaatatatttctatgacattataccttagatgtgtaagctatgaactaattattactggatatttttaactcatcaaaaattactgcctacttattcaataatttattccatgttcttttcttgtgatagctaatatatttgggcttaaatgcatcttcttattttgtgcttatcttttcttcagttttgtttcttgtgctttcttttaaaaacatgtatagattattaatattcttaattttccttttagtttggaatgtatatactcattttgttagtctttaagctgaaaattataacacatgtatttaacacatcagggtatagagttattaatacctttaccctcctcttggataatataaggcatgttatcatgtagtggtattgaggcatcgttaattctattgttctactcaacaaggggatattgttcatgttttatacagataatgaataattgtattgatccgcagatgcattccttatatcacgcagatctctcacctggaatcactttttttttgccttaaatataaccttttgggttacctttttaactaaaattttcattttttacctcatatggtcttattttatactgcttcttgaaaaacactattgttgtgaatagaaatctaggtttgcacttatttcttcagtaacttcactgtatccttccactacatccatgagtcactatatactggatgtgagtggagacaatttatattgtgactatagtcttcctgtgctacagaaacaaaatttgatggcggtggtgttttgttttgttttgtttttgtttttgcttttgttttgcttttgagacagagttttgctcttgtcgcccaggctggaatgcaatggcagaatctcggctcactgcaacttccacctcccaggttcaagcgattctcctgcctcagcctcccaagtagctgggattacaggcacccaacaccatgccctgctaatttttgtatttttagtagagacggggtttcaccatgttggccaggctggtcttgaactcctgacctcaagtgatccacccacctcggcctctcaaagtgctgggattacaggcatgagccactgtactcagcggtgatggtggtttttttgtgttttgtttttgtttttggagatggagtttcgttcttattgcccaggctggagtgcaatggtgcgatctccgctcaacgaaacctccgcctcccgggtccaagcaattctcccgcctcagcttcccgactagcttgggttacaggcatatgccaccaggcctggctaattttgtatttctagacacggggtttctccatgttggtcaggctggtcttgaactcccaacctcaggtgatctgcccgcctcggcctcccaaagtgctgggattacaggcgtgagccgccacgcccagctggtgatgttttgatgaggacaggacctgacttatgtctcttagtttcaggcaggaccctctcataatcaagtttgtgattggatctacctgccttgagtgccagaagggagaacgagaggtagagaggcaggtttcggttactgtgaatgaaagatgaataaggaagtgtcctctaaagtcacaaacttgaaacgggatgaattctactctccacttaggtctgagagcaattagtcctgctatttccaaaattagaatcttctttttaaaattttagttttagagacagggtctcgctctgttgctcgggctagagtacagtggcgggatcatagcacatagcagctttgaactcctagactcaagccattctcctgtctcagcctcccgaataactgggactacagtccaaaaatttgaatcttgtggcctgtaataacgagtctcttgagcagcatgcctacctatggttttaggcacactttttctgaactgttgaagaaataacccaaatgtgtgctttcatgtaaaatctttaatcatacctatgaggctagctgctgagttagggtgttattgtattttatgttttgataaatgccaaagatcctgctgaggcttagcctcccacagagtatatttacttcttttcatattttccatgtatctcttttattgattcatatcttgatagcatcatgtgtcttatttcactctatgtgaattgaagatagttttcagtcatctatattgatagttctgtaaatattcagttgtactaaatataagcaccccatatttgtatttattagaccagaattatcaatcttggcatgagaattcactagaactttaacaattttatattgtttctactaattgctgagataatggacataaaaatgctcagcatattcatagatttatgtctttatccttttacaaattgttgctttatgtaatacaagtcagcattatacattacatagagttcaaaatataatttcttggtgatcatttctttctttttttgttttctttctttctttctttctttttttttttgtttttgagatggagtttagctcttgtcgcccaggctggagtgctatggcgtgatctctcggctcactgcaacctccgcctgccgggttcaagcgattctctcacctcagcctcctgagtagctgggactacaggtgcccgccaccacgcccagctaattttgtatttttagtagagacggggtttcaccatgttggccaggctggtcttgaactcctgattcacctgccttgacctgccaaagtgctgggattacaggcatgagccactgcacttggccagtgatcgtttctttaatactgatattttctgatataaattttcattttcatgtgttaattctttgttgtattaaatatatttttcccaaagctgtttcatatagttttctaatattatactctacaagtgtttcttgtacccatactactgttttttgtttttgttctttatgagagacggtcttactgtctctcccaggccggagtgctgtgacaccatcagaactctgtgcagccttggctcaagtcatcatcctggctcagcctcctgagtagctgggattacaggcttgtgccaccacaccctgctattactttttttttttttttttttttttttttggtagagatggggccttgttacgtggctcaggctgatctattaatagaattcctgacctcaagcagttctcttgcttcagcctcccacattgcaggaattataggcatgagcctctgtgcctggccttttggaaatttttaacacatcaaaacttactaagtgctaatttaagaatttattccatactcatttcatgagatagctgatatatttgggtttatatacatcctctggttgtgtgtgtgcttttctttgccttacttattgtgtgtactttattttttgtaatgttttctttacatttacattttctttaaatttgtaagatatatactctgattcagttaatgtttaagctttaaaacagttatttaatacattatagagttaatgtatttgctctcctcaagaaatataagaaacttatatgttagttaatttgcccatatgagtttatatactattgaggatatgcatggtaattccaccattctgtttccagaagtattaatattttattttattttttattttaatttttatttatttatttattttgagatgcagtctcactctgttgcctaggctggagtgcagtggcacagtcttggctcactgcaacctccgcttcccgggttcaagtgattctcctgcctcagccttctgagtagctgggattacaggcgcccaccaccacgcctggctaatttttgtatttttagtagaaacagggtttcaccatgttggacaggctggtctcgaactcctgagctcgtgatccgcctgccttggcctcccaaagtgctgagattacaggcgtgagccaccgcgcccaacagtattaatattttatacagataatgagtggtctcattaatccatagatgcactcctctctcagatcctcatttcttctatcatcacagaccatcacctgggatcactttccttcaaccttaagaaggatcttaaaagtgttattttatgccagttatttttatccattaaatttctcattttgggcttcaaatagtcttatttcagtttttcttagccagtgcatttgtcgtgcatagaaatctgctggcagttatatctgtaactgactccgtatgttattccatgtgttcctgacacctaaatttatattggctttgagtggagacagataatttatattatacatatatataattatgtatgtgtgtatataaactacatgtgtatatatatataaatgctgtgtgtatgtgtgtatatatattttttctcaaagatatgaattatttctatgtcatctcataaaataaaccaggttataaaattttaactacagtgactcttaagtggacagtggagttaaaaattatgaagagcaattagtcttgatagttctgtgttttgaatcatacagcctataagaatgtgtcttctggacgatagacctacctgtagtttatgaaaccctcttgcatgtgatttttttcaattaaatgagtctattgatatattggtgtgcttttgtgcaaaaattataaccattaggggctcccacctgtaatcccagcactttggaagactgaggcagttggatcacctgaggtcaggagttcgagaccagcctgaccaacacggagaaaccccatctctactaaaaatacaaaattagccgggcatggtggcggatgcttgtaatcccagctactcgggaggccgaggcaggagaatcgcttgaacctgggagggagaggttgcagtgagctgagatcgtgccattgcacttaagcctgggcaacaagagtgaaactctgtctcaaaaaaaaattataactattatctatgatgctatttgatgagtgagggaataattgtacttttttctttttttttcaaaatcacactgatcctgaaaaggtggatctttgatttatcttcctaaagcagtgtatgtgagaaccttgtgttgaggaagactgataacagcttgtatgtatttagcacgatgtgccaggcctggtgttaagtactttttacctcacttcccatattcctaatgaggttggttgtagtgtttttcatcttactgatttttttttgtttgtttttgttttgttttgtttttggctaatgactttaaaagacctccagttcttgaacttcagctagggtcccatccccagagtttatcagaaggtataggttgggtccaagaattcacaggttttttaagttcatagtgaagctgatgctgtaaaactacatatcaaattgggaagcaatgaattagaagaggctcatgttttcgtcatgttacatgtaagttcctccttcacttttcgccatgaataaaagttccctgtggcctcaccagaagcagatacgggcaccatgcttcctgtacagccagcagaaaggtagctaattacatctcttttctttatatgttagaaaaattagaaggacattcaatgttttacaaaaaggcccacaaacgaaatacagacaacgttcaatttattaatacgtttcaatccccaaatctgagagaggtgaagcaggtttcccagggcctcagaagcaggattgaagaatgggtcccttgctggcgacttcagtggcgtggcattgtcccaggtggccatggaaatcagggtgcataccctttaaaagcagctgtggcctccgagatatcgttttcccagtcttttctccccctccctgcacgacgcctcttggcagacatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgacgtatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggtgagtgggggcatccctcaagcgcaccccggcctggttggtgtgtcctgggatgttcgctctcatcgcgcacttcagggtgctcactccgtcgcattatgtggaggggttccgctcccctcatcagtggcataaggtgtggaacggactcgaaggcgcaggggcagttcgtacaaatgcatgcatggagaggagaatgagtttggggagttccgggaactctctgtgcctggtgagaacagggactagggggtcagaggtaggcctggaatggccgcccgaggagctggtcctctcttctgagggtgctgggagtcatgcaaggtttggtacagagaagggaggtcctctgacgcagttcttaaaaggctccctctggctgcagagtgggtagactagggattatagggtagacggggagatcaagatgaagtctactgaaatagtccaggtgagcgttgatggtctgggccagagtggtggcagcagaggttagagaatgtatgggttttgggttttgtatgtattttataaggaaggctgaccagattctctgatgagacatagtgatgatatcctgggattcttcacatgactgtcttcacttgagacagggggcagtgaatggaggtcatttctagtttagtgtcctgaatccaggccatgagttgtatggagttatgtggagaagtccccacctggcgaccaatgggatgagtactgcaaaagtatatcagacctaggaacaggtacgctcaaatgcttgtaggattgagtttggagcgctcagggaatctcaggtcttaattacctttgttggaaacaggtatcagaggaaggagttaggcaggaatggctggccgaggtgtcttgagtgtggtaaaagtcgtgggagatttggagcagaggagggagatgatctgactcagattttaacatgctctctctggctttcaggttgagaacagactgtgagcatgagggagcagctactgcagtagtgttgatggtgtctggtctagaggtgtggctgtggaggtgagagaagttggtaaattttctgttttttaaagtagggtgattggattttttgatgcgaaaggtgaaagagaggagagtcgtggatgaccctaaggttggtttgtttttgctgtagctggtaaaattatgaaaatgccatcaactgagatagagaagttggcagcaggtatgatttttagtggttatatcaggagttaggctttggtcatgtttaggttaagaggtctcagttgtcatcttagttgaggcctcaggaaaacacacaggtttttagttctggggaagggttctgttgaagaagttgaaaaaaatggtggccagtgtgtggagtgggatggggtatcttcaaatcatggtggtaatgctgttattcagtaagaaagttgaaactggacactgagagaaaactgggtctgttgcttaggcacctggacggcagtggtggatagtgtgaagacgcgagcgcttcctggacactgcttgcagagtggcatgggggatgagggatgtcatggaggtgcatatggcatgggccagtggcggtggggatctcagatgtgaggaaggtgtagtccaaagagtaatgagcacgttgggaggagtgtgaactgatgcccttaagactctagtattggcagctcatgggagaagatggagctgaagtttggttgtgtttagaggcatcgtctggacaacaccaggagaactggttggtaggcgagtatttgggacccttcatgccagacccagagttgagacagcatctgtctgcacacttgcctggttctgctctgggctggacacagtggtgagagggacatgaggagagagcagacactagtggtgccaaggtctgttatctcctcttagttgggaggctggggaggcgagggactagagagtgggtgtgtgagtgtgtagactggggaggagggggttctggggagagatgctgactgtggactcagctgtacttatcatggcagagttgtgtgaccttcgaggatgtgttcgtgtacttctctcgggaggagtgggaactccttgaggaggcacagagattcctgtaccgtgatgtgatgctggagaactttgcacttgtggctacactaggtaagtctgtgttttagttatctaatgctacatggcaaattatcccaaagcttagtaactgcaaacaataaaaatcaattatctctccagtttcagtgcattggtaatctggttagagcattttttgttgtttattattttgagggttttttttttgttttttgttttttgttttttcagagagtcttactctgtcacccaggctacagtgcagtgttgtgatcatggttcactgcagcctcaaattcttgggctcaagtgatcccccccacctcaccctcctgagtagctgggactataggtgcatgccaccacgcccggctattttactttttgtagagataaggtcttgctacgttgcccaggctggtctagagctcctgacctcaagcgatccttcctccttggcctcccaaagtgctgggattacaggcttgagccagtgtgcccagcctgatcacaccttcttatgcaggtgcttttggctctcatgaagttttaatcaagctctcagccagtgttgtggtcttacctgagaagaatccacttacaagctcactcacattgctttttgcaagatttagtttcttgtggcttgttggactgtgagcactgttccttgctggctgttggccaaagtcctccctcaggtggcctgtctgtattgtaccttatgacacagaagctaacttctctttgagcaagtgaccaaaagaatgttcaagatggaagcccaggattgtaacctaatcttgaaagtgtcatttcattatttttgccatattctattccttggaaataagtaagtccatccagcttacaatcaagtgaggaggcttacacaggggcaagagtaccaagaggtagggatcactgggaccatctcagaggctgtgttccacaggcctttacacccactccggtgtccttggtggggtttgagtcttcttctcttccccatgggccactctttctgtccatccagatccatgactcttctccttcccttctttgtttcccagagtaggtgctgtgggttctagggctggctgtgttcagtgtttctgccttcactgggtaatctgaacatctgttgccctagagctttgcaggaaaaggttaggattcgggagtttttcagtctgctaagcagattctacacagctcaggtgcccactgcctgagtccgtgtcatgatctttgcacctctttgtcctagattctgccctcatcctctggctgacatttcctggggcctgactgtgccaggaatttcaggggctgacacagtcacttcttgtggtgattacagggctgtcctggtacatccgccttggagagtattttttctaaacattctattttctctgtggagtgggtctacctgcgccactcacctgccctttgtttgcgttacagctttcattttcccagtcccatgcagttgcgcagttggagggggcagaaaaccttgggtgcctgacagggcagacatcactgcagccacagtaaaggagacctacagagggcatggccctgctgaatgggagctggaagagggtatctgttatggttgggttcaaatcgaaccttcaacttgttttgtgtttgtcagtgttttgttgccaaggcccatagtgattcttcacatctactttactttcctcattcttggcactttttccatttgtcatttctcacgtgtcttccatcctttgggtgttttcccacttttctggcctccgtgtttcaattgctctcttcaacactagcttactttaatgtgtcatgagttctgcacattaaatagtccgtgagaatgagctacttatttggagtcagattttcgtgggcatggacatacccatctgcacagagctcacctgacaccagcggccaaggccctgctgaaactctcttgcagaggaatcaggtagaggcttcacctatactccctatactctatgccattgtttttaggtctttacctcatagtcagggttcctccattctgtgaggccctatactgacaaccagcccttctttacactgatcctggccctcttgtcctgccaacaagccagtggactcgcactggtgttagacacacatttgtgatggggctgctgcctcccaccaaagtcagcatgcacttcaccagctcttttttgctttcaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaattatggctgaatgatattccattctataaatacacctcagtttctttatccatttacttattgaaggacggttgctttcaagttttggcagttatgaataaacctactacatatttgtatagtttttctgtggagatgttttcaactcatttggatatgtgccaaggagtgcaattttctctgtcatatagcatgtttagtcttgtaagaaactgccaagctgtcttccaaagcggctgcaccatttattttatttatatatattttttgagacagagtctccactctgtcacccaggctggagtgcagtggtatgatcttggttcactgcaacctccacctattttagtagacatgggtttttaccatgttggccaggctggtctcaaactcctgacctcaagtgatcaccctcctcggcctcccaaagtgctgggataacgggggtgagccactgcaacgggctgtggctgtaccatttttgcatccaactaacaatgattgaacattcctcttgcatctcatcctaatcagcatttggcattttcagtattttggattttaaaatgccattcaaataggtgtgtagtggtatgccattgttgcttttatttgcaattccctaataacacacaataagtatcttttttaaaggcagggttgttttgttttgttttgaaatggagtcttgctctgttgcccaggctggagtacagtggcatgatttcggctcactgcaacctccacctcccgggttcaagcgattctcccaccttagccttccaagcagctgggactacaggcacccgccaccatgcccagctaatttttgtatttttagcagaaatggggtttcgccatgttggccaggctggtctcgaactcctgacctcaggtgatctgtctgcctcggcctcccaaggtgctgggattacaggtgtgagtcactgcgcccagcctggctggggtttttttatgtgagtttcacacacctctgagtaagtggcttgcagacagagaagttaacaactttggctgttagcttgaacctgtgatttatgaataccaaaaagacaaatacagaatctaaggaaacacataacagtcctgtatacacacagcagctggcagccctattcccggtgtgtcccatatacctaccattgacctgaaacccagtttgtacgtgctcattgaacattttgtagagcagtaaatacacatcatcacacagattgcctactcatttttatttttatttttcgagacggagtcttgcactgtcacccaggctggagtgcagtggcgcgatctctgctcactgcaacttccacctcctgggttcaagcgattctcctgcctcagcctcccaagtagcttggattacaggcacccgccaccatgcccagataatttttgtatttttagtagagacagggtttcactatgttggccaggctggtcttgagctcctgacctcgtgatccgcccacctcggcctcccaaattgctgggattgcaggcgtgagccaccgcacccggccttcatttttattttttgacaagtgtttccatttgttatctctatccctccaaacagttaataagcgatgttttcaagtatgaaataagaaatacatataggagacagaagcataatgtgtccaggttccagcacagccagtctcaacttcattctttgacttctcagactcttgctcaaactctactgtaaccttgctttttccccccttcacatgtcacagagagatttctgtaggactatttctgccactagttttgaaataacataatcactgttagtccaaactgcaccatcctgtaagccccctgccatctcacagaccttggtcagagtgaagcattccacggagtgagggccttgagaaacatcctgcccaactgcctgactttcttatcacatcgttctgggaaaagatccaaggaaggtcactatcacatcctgccggataaaaggccaaactgcctcaggaacatcttacgcacatcctttggccgggtgctgtggctcacgcctgtaatcccagcaatttgggaggccgaggcgggcggatcacctgaggtcaggaattccagactggcctgaccaacatggtgaaaccctgtccctactaaaaatacaaaaaaattagccgggcgtggtggcacgcgcctgtaaagccaactactcgggaggcggagttcaagaatcgcttgaactccgggaggcggaggttgcagtgggccgagatcacgccattgcactcaaggctgggcgacaagagcgagactcctccaaaaacaaaaaaaaacccaccatcctcctgggcagcaagtcataccctcccgccgcgccccctgccccccacccctgacccctctcatccaggcctataattgccccagcctgtaagcagtgaggggttctggcactaagctagttctccccatcacaggtctcgtgctggacataaaacctgcattgctgtagagctgccaactctgcctttctttaaccctcgccttcccttcaaaacctaacagttattattaatagatttctgtaattttcatttcacaagtattttcacagataatttcaactccctgtaaaatgataactcacttctcaggaaggagataagatcatgaaagttcacagtttttattggggataatacgttccctgtgtacatatactccaactatggaatggcacaaaatgtcctgtcaggaaatggcatgtatcagtcactctcattttcagacaggattgagacttttaaaataaatgtaaaatatttcagacatgaagtaataagtattattagaataaaagcattgcactcttggtaggaacacaatcactgactctacagacagtaatgatgttttcttctggatccagaggcacagcgtcaccctttcaatctacgtcggtatctcctgtcttcttttgtgcaaattcccagccatgtagtctttctttgttctcttggaccaaccatattgaagcttaataaatagaagtcaaagtttaactgtatgtgtatttgaaaagcaacatatggctgagaggcatgagtagagacagagtgcctttgtggtatagtgtgtccctttggcggtgtagccgttgagaacttgctgtgcttcacaatccgatatcataggtccctcacatttctgtgagtatcctagaccttacttcaagaaaatctggttatgtcgcctttaagagcaacccaagccccgtcctgtccgtggagtccggcactctgtttaccagctcccctgacggtgccactgagcctctatccgccatataaggactgaccaacgctctaaggcaagtccagaagcggtgtcgaaacttcataacccagaagacactgcggttctcggcagcgcgactgacccaatgaatgtgcaggaaggaacctttgcgtgcgtgcgtgcgtgcgtgcgtccgtcctcgtgctcgcgcatcgtaggagggcgggacttccggcgtcctcttgccgtggttgatttgattttctctggtgttttcactagttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggtgggtgccccgtcccaggcccccccccacctccgcccgacccctccttccagtgctgaagcccatagaaggggccctgcaggtcaggccccttgtctcgaagagaggggcgttcctgtgtggggtccccgtatcagctggtttgatgcagcctcagagctcccttcggggatctcaggttcagagcatggaggtgctgccaagtgggccgcgtcggggagcccggagtgtgggttgtttctgcgggaaagagagggttttgtgaattttctcttggaatggcagcctgagcagccggtataaccatggaaggttgtcaagggaagaccagtgggaggggcaggtccagagttagaacgagcaggatggggaattgacacagagagacccagaagaggccactgcagtggatcccagaggctgcaccagagccgtggtataagagggacaatgtgatgggattctggatagacctggaagatagagccaacaggttttcctgccgtatcagatatgtctgtgagcaaaaatagggagtgaagggtcatttttttttttttgcccgaacatctgaaagaatgaagttggggaagtcagcagcatgagaagtaggtttcatggagaagatcatgggttggagtttggccagtgtgattctcaggcgtctcaagttgaaaatgtcacatgggtagggggacagaaaggtgtggagtctacagaggagaactggtgtagattcttcaaaagaatagagggtggccgggcgtggtggctcacgccggtaatcccagcactttgggaggccaaggcgagcggatcacaaggtcaggcgttcaagaccagcctgaccaacatggtgaaaccccgtctttagtaaaaatacaaaaattagccgggggtggtgacgcgcgcctgtaatcccagctattcgggaggctgaggcaggagaattgcctgaacccaggaggtggagattgcagtgagccaagatcgcgccattgcactccagcctgggcgacagagcgagattccgtgtcaaaaaaaggtgcggagcgcgggtctcttccgcggaaactgacattgcgtttccgttgtcggcctcccgctgcaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttttgtgtattctcagcttatctaaacttaatgaaatttcttttatatttaaaaatagtacattctgtctcatgtcacatatcagtagatcaattagtatttccttgtgaacaatgttatttataaagaactcattatcaataataattaatttctttcttttttttttttttttgagacggagttttgctcttgttgcccaggctggagtgcagtggcacagtctcgtctcactgcaccctccgcctcccaggttcaagcaattctgcctcagcctcccgagtagctgggattacaggctcccaccaccatgcctgcctaattttttttgtatttttagtagagacggagtttcgccatgttggtcaggctggtcttgaactcctgacctcgtgatctgcctgcctcggcctcccaaagtgctgggattacaggcatgagccaccactcccggccatgaaatatttttacttaaaaattgggaataagctttctttttctttctttctttcttttttttttttcttttgagatggagtctggctcctgttgtgcaggggctggagtgcagtggcacgatcttggctcactgcaacctccacctcccgggttcaagcaattctccttcttcagcctcccaagtagctaggattacaggcatgcaccaccacgcctggctaatttttgtatttttagtaaagacgggatttcaccatattggtcaggctggtcttgaactcctgacctcgtgatccgctcgcctcggcctcccaaagtgctgggattacaggtgtgagccactgcgcctggccatgaaatattttttacttaaaaattgggaataagcttttttgtgtgtgtgtgtatgtttttgtttttttgtttttgagatggagtcttgctcctgtcatgcaggctggagtgcagtggcacgatcttggctcactgcagcctctgcctcccgggttcaagcagttctccttccgcctccagagtagctgggattacaggcatacgcctggctaatttttgtatttttagtagagacagggtttcgccattttggccaggctggtcttgaactcctgacctcaggttatctgcctgcctcggcctcccggagtgctgggattacaggtgtgagccactgcgcctggctgggaataagctttcgacttgcccaattcagataaattgttttttttttttttttttttgacgtggagttttgctctgtcgtccaggctggagtgcagtggcgcttggctcactgcaacctctgcctcctgacttcaagcgattctcctgcctcagcctcccaaagtgctgggattacaggtgtgagccaccatacccggcccagataggttgatcttataacaatccagaaacaaatgtcatagtcaagatttggtagatagatttaaaactaaaatattctgccattggaagtgaaatgtcatagcacatacgtggacgttatgcatttagagatgttataaaaatgtattggcagtatacatagcactactcaagaagccaaagaaacacttgtgcagtgctaagtgtcacatgtctgcttctgccagaggctaggaatagtgatcttgctataatgtgagaacctgaatcatgtttgtaaaataggaggctgggagcagttccaggccacagtgaagtgtgttgcttctgtcactttatattcttatatttcctttccctcagacaatcaactgttgatgcctgtacttgtgaaaagttgtaaggcaatttttagggttgttgtcaaagaaaagcttggattacattaacatttgtactcagccttttaggcaatacaccagagggggctgggaattgtctgtttgttcctatgataagtagatcttactgtaaaatagtaaatgtccattgaaaagcaagtaacacaacctgtgctaactgggagcacttgaacaattttgttccattctgaataacttttcagcaagtaattctaagctttgtcttatatccttgtgtaaaattgctaccttcatttttaccctatttgatttcttaaatggtttgttcaagaaaaaaaaaaaaaaaaaaaagaatagagggtgtagattggaccgggtcctgaggatccaatttggtagggaagtctaaaggtcattgcctgcaagctatgtggtgagggaggagagagctgatacttggggttcacaccataggtggagccataagccagatgcttactttagaaaggcgcagacctgccataggaaggattttgtcctctgcctagaaaaagggaggcgtgggtgggataaggaatgggcttgggatggagactaaggtttgagatggtttatattctgcacctacaggcttggctgaccctcagggccactctttgtgggaaaagaaaaaagttatccaggctagtggagcagctgggttctaaactagggcactgctttttccccttctccacatatcaaggcaagattggatgatctactgccccagtcaaggtctgccagcaagctcccctcagagccttatgtaacaggcaggcctggttgcagaggaccagtagctgacctacctgctcagcccttccctacaactcattaagaatatatgaaacacttattggtataagcactaaccagtgtccttctaaatgtgtacacataggcagttagaagtgaagctattcattgagttaaattcctgcaaacactacataattgatttgacccaaatttgcctataattatcaacataccatggaaaattttagtatcctctaaaattttaaaagctaaaaatatacacctcagtttttgaaattctactacatcatttatactgaaaacatatagtaaaccattaatccaagaacagtaatagctgatatatatgatgagcaacgagtgtttgacaccggtaagagtcctatgaggtgggagccattcttacaacctatttacagatgagagcactgaagctccagcaggttcagttcttttctagagtcacagtgctgctaagagccaacagtgaagtcggaggagctgagtttatacaatcaacttgagatcagtttgctttagggtaaggaagaagagatggtggtccaactctgcctgtaagatcttcccatcgttgcccatttctcacggtttccctcttccttcagggtcccctggcgatggcagaaatgaaccctgcacaggtgagtggagtgttttctacctttcacctaccagttatctcatagatggttttggcacctccatgtaaagaaaagtggtgtccagagactctctttctgtctttctccctctcttatgtctgaaaagtgagtgattccaccagttctagtatcttaaattaggtctgggatttttgtttgattgttttaagtttactgtgacaccttacctggatggccctggattatgtggagtggctcccatttttgacagttgacgtggtaacatctgtcagagtgtcatgggcacaagattaagaatgtttcagtgtttagaggagagactgaactggatttttagggaactgcaagtgtctgttatatcggataggaatagggagcagagtgggaggtggctagagacacacaaacatcaggcctggaatgacagcctaggtcctgggtctctaatctaagggaggtggtagatggggaagatttgaagcagaagagggcagtgataggaccctagcttaaggaactttctttggcgtctgagtggaggacagactgtggaggtgagggtaatggcagggagatctgagaggatgttcctgcagcagtctaggtggatgttggtggtgacttgtcaagagtagcggtggcttcaggatgtgttttgaactggagctgcccacattttatgatgtagagagtgaggcagctgggggggtgggatagaaggggaatcaggagtggccccatggtttttgtttggaagcatagatgctccatcagctaagatgggagaagtcagcagtattaggaattttcagagtgagtgtgaggagtcagtgtttgttcaagccacagatgtctcagagactcctggtggaggagttcaggttggagacgtccacactatggtggctgtcgtatggaccaggatgaagccatggattcagtttaggtgacagcatctctaggttatggtggcagtgctgttcgaagacagagaattggaatggggcatgagaactgggtctcttactgggtagctgtgcagtggtggaggagtcactagacaaatgagggaatggagtgtttgtggggatgagtgtatgtgagatggtggggtataggagtgagaaagacttctgaaggagagtggacatgatggggttgctgaggagggtaatagggtgaggtcggagagttgctaagcatcagttggaatgagatgaggatgggaattctattagtctgttttcatattgctacaaagaactacctgagactgggtactttatgaagaaaagaagtttaattgactcacagtt

SEQ ID NO: 1209 - DNA, 56401 bp, Homo sapiens
tgatacatagaatataataagaattctttgaaaccaacaggaaaaagatagacaaccgactaagtttagccaagaaacttaaacaggcatgtcacagaacacacacatcagaataactaaaattaaagggcctggcaataataactggtaagaatgtaagaatgcagagcaatagtaaccttcatactgctagtagaactgcaaattggtataactactttggaaaattggtatatttactaaagttgaacacacacatatcctattgctcagtaattccactcctatgtatatacctaaaagaaatgtgtacatacatttaccaaaagttatacacaggaacgttcacagcagcattatgtttaatagctaaaaactgcaaacaaaccaactgtcaacagaaggacacttatagtaattaataatatataaagcataatttaaaaaatattcatagaatgaagcaggacacagtgggttacgcctgtaatcccagcactttgggaggctgaggcgggtggatcacctgaagtcagcagtttgaaaccagcctggccaacatgttgaaaccctgtctctactaaaaatacaaaaaattagctgggcgtggtggcgcaggcctgtagttccagctactcgggaggctgagacaggagaatcgcttgaacccaggaggcagaggttgcagtgagctgagatcacaccactgcactccagcctgggcaacagagcaagactccatctcaaaaaaaaaaaaaaaaaaaaaaaatgtatatatatatatatatgtatatattcatagaatgaaatataacatagccaataagaatgaactaacaccagatatatgcagcaccatagatatgtcacataaacataatgttgagcaaaaaaagccaaaggcaaaagactaaatactgtgtgattgcgtctatacaaagttcaaaaataggcaaaacgaatccatggtgccaaatgtcaggatggtatttattttgagagaggaaaaagaggctggtgattgggaaggggcagagaaggggttctgaggtgctagtaatgttctatttatcgtcctagtagtggtttcaccattctcaatttcaccatactatgcaatcatagtcatgcagttttatgtgtgtatgttatacttcaattttgttttcaagtaagaaataatcaaatgtttgataaatgaaagaatgagcttttaaatccagaacaaactggtcaaagatgttaaatagctgaaagtagataaaatgaaaacaagcacagggaaagaaaaagacacacatgcacttacatctatttctcagggtgggaatgtctactgttatacaaatctaaacgtagcgtatcataggaaggaatgaaactaaaatgtgactagaataattatagcataattgtagccagggaggtacttgctatattggactagggaaaaagtatgagaaaaaaaaaaaaagtgggatagcttatatggaagaggcttcaggcctttaaagggagcttcctgataacatctcagaagtatatctctttatagccctgctcctgagccatcatctcttacttacctgaacacaggcctctagtcagctctctatcaaccatccagggctcttttccttgttccaataaggagatcacagctggcttagaattggaaagtcctgttcacaagaaaagacatgggacatggttatgctgtggggtccccagaaatcagatccagtcccttagtgatcaaaggagagatgccactacaagaaggaccggagaaagatggagaagatgaagcttcagccacagcccattggagctgcccacttccaactcttccattctattttaactcaaaccattccttagggaacagggagcagaaattcagctggttacatgaagcaaataattcacaatggagaaaggagacacttccaagggcacactctgaattttggggaatagttatccttacccactgaaaccaggttgctgaaattctccaacatcacttctttgtataaattcatctgatcagcgtccaggcattcccattcctcttgagagaagtctatggaaacatccctgaacatcaccggcccctgaaacaacaaacatgctttcacaatgaaaggagaaaagaaaaagatggcggtagaggtggcaagaaaggacagagtaagcaaaattaaagggggtgaatcctatcatatcagaagatatacgtcctgtgtacaaagggatatacaaatagactggacttttccagtgatatgaaatagcatgcattcagctcaattagtgagtttcttccccctccccgctttccctttatgccccaagagaggggaaaatgggaggggctttcaaacacaccttataatacatggagtaaaaattcagaatatcaggggaaaacaaaaatgaaagtttctaaaagcttccagaagaaaacacagatcacataagttttcagaaatcagaatggcaatagacttctcaatagcatcatttgaaataagaaaaaaccaagcaattcctttaatattataaaggaaaataaattctgacctagaattctatagccagtcagattactaagccactatgaagattaaatcaagacaattttaaatctgcagggaatgataaaagtacttccaatgtggcttttcttaggaagctactaggctacatgttccatcaaaactaggtagtaaattaggaaaaagaaaaggtactatattaagaaactgtaaaactaacatgaaaatggtgatgaaagtgccagtataattataaaaggcaaatcctagaacatcatccggcagcagactgagagaacagcatctaggaacagaagaagtgaggactataggaaagacatctccaaagaaaactaaggagctagtatgtttcatcatgtagaaaatattgacaggcaactgacagcaatgttagagaatttgaaaaaaatagtgacacatacataaaaccgggcaaaagaagaaacaaggcaatttcctctgagaaaaatacaaattgtattagaaagaatccagaatctggtgttttacttggctcacattgtctgcaaggtcctaatgtctgcaacaatgtctgcaaggtcctaatcacagggatagcaatgattgaaagaaaaattatgagccgagcatggtggctcatgcctgtaatcccagcactttgggaggccgaggcaggaggatcaccaggtcaggagttcgagaccagcctggccaacatgatgaaaccccgtgtctacttaaaatacaaaaattagctgggcgtggtggtgcacgcctgtaatcctagctactcgggaggctgaggtaggagaatcacttgaacctgggaggcggaggttgcagtgagccaagattgcgccactgcactccagcctgggcaacagagtgagactctgtctcaaaaaaaaaaaaaagaaagaaagaaaagaaaaattgtgatataattctattgcatggacaaaaaatgaagactgtggtatgggaaatctcaatccatagttacctgcctagaaatcactggaaaatatgtatcaaaaaatagcaatataggaatattaattagaaatataggaaaaatgctaagagaaacagcaaaaagagtagccacctaaggggagtaggattgggttagtgggacaatgccctgccatttttcatgtcttttaacatttcttgaaaaattttttttttttttgagacggagtttcgctcttgttgcccaggttggagtgcagtggcacaatctcggctcactgcaacctccacctcccgggttcaagcgattctcctccttcagcctcccgagtagctgggattacaggcgccggtcaccacacccagctaatttttgtatttttagtagagacagggtttcaccatgctggtcaggctggtctcaaactcctgacctcaagtgatccacctgcctcagcctcccaaagtgctgggatgacaggcgtgagccaccacgcctggcccatttcttgaatttttaaaatgcgaaatgggttaaacataaatttaaagtatcacttagacaacagcatactttaagtttcttggaaattacaattcttataagactgtcataattattccctattaacataaacaaattcaacttttatacccttatggtagcagaaatttccacaatataaatactactgaatgaatctttcatttcagacattttcttaggcaaaaatacttttaagaccttttccagatatgcaggcccttccccataccttgccctatgcatctcttccattttgctgttccttagttgtatcctttgtaataaaactataatcaggccgggtgcggtagctcatgcctgtaattccagcactttgggaagccaaggggggtggatcacctgaggtcaggagtttgtgaccagcctagccaacatggagaaaccccatctttactaaaaatacaaaaaatagccaggtgtcgtggcgcatgcctgtaatcccagctactcagaaggccaaggcaggagaattgcttgaacccgggaggcggaggttgcagtgagccgagattgtgccgttgcactccagcctggacaacagagtgaaacgccatctcaaaaccaacaaacaaagaaaccaacaaaaaagtaaaactatcatcataagtatagtgctttcctgagttctatatgttattctaatgaattattgaacctgaaggagagttacgggaacctctaaatttttggctggctaggcagaagtgcagtgccttagacttgtggctggtgtctgaagcaggtacagtcttgtgggactgagtcttttttttttttctttgagactgagtctactccatcacccaggctggagtgcagtggtgcgatctcagctccctgcaacctctgcctcccaggtttaagcaatgcttctgcctcagcctcctgagtagctgggaccacaggcacacaccaccacatccagctaatttttgtatttttagtagagatgtgggttcaccatgttgtccaggctgttctcaaactcctgacctcaagtgatcctcccatctcggcctcccaaagtcctgggattataggcatgaccagctgggactgagcctcttaagcaatggggtctatgttaactctgggtagtgtcagaattcagttaaactataggacactcagttagtgtcccaaaaattttgtttataaaaggacacacattcccaattgataggagaaatgagggtacttctccctcaccttaggacaagcaagggggcccctttagactccagggtccaaagtggaatgatgagatactttggaataatttttgctgtattctctggagcttagggggcacaaagattagtacctatttccctctttggactagatgtggacccaataaagggacaaagtgacctcaacaaaggaatggatcacagaatgcagaagtgtatgacagatgtcataagtagccatttcaagaagacatgctgtgcatatcccaggaaatgcaattagaggtttccagcaggggcttctctgagagactcttaatagtgtctcctaacaaaggagtgttgaacatccatcaaggcaaaagagatcaacaccaaaacaagtcaagaaagacttttcttttccttacctcctcttccctacccctgctctaatctcataggatccagagactgacttaggcaggagaaatagaagctcagggcgaggaaatcaagaagcttaattatgtcccttttcatactttgcaagcttgaagcaattctcagctcagagaagaggctttaaatgaaactcacatattattacagtgaactagaggttgtaattagtaaaatgagactagattttgactgaaaacaatcaaaggacatcaaagagtgataaaaattatagtctataccagttcttatccagggcaacaaaaaaattaacccacagagagggttgagagtagaaattatgaggaaaaagtttttcttttgcttgcttcatatggaatcctgcttatttcaaaatgctgatcacaagcagatttggtttttcagttacacagtcacatcatctataaagcgataatcttatgccctcttttgtaatttttaacctaattttttttcttatgtaagtgttttggttaatatctataaaacaatgttaaataacattggtaatgtggtatatccttgttttacttctaattttcaaatattttgatgtttcaaatatttcctgattaaacattagattaagttctgaaaacaaattttatttcttttaaaatttattgtcccccgggcacagtggctcatgcctgtaatcccagcactttgggaggccgagatgggcagatcacctgaggttgggagttcaagaccagcctgaccagcatggagaaacaccgtctctactaaaaatacaaaaattagccgggcgtagtggcgcatgcctgtaatcccagctactcgggaggctgaggcaggagaatcgcttgaacccaggaggtggaggttgtggtgagccgagatcatgccattgtgctccagcctgggaaacaagagtgaaactctgtcccaaaaaaaataaaaatttattgtctactacagtatactacatgtccctagttattcccgttaatactgggcaacaatcttctctatagaaatgagaagtgtaactagagactgatgcaagaggggaagcagatattctatttgggctttggcacaggagagggaagactcagtcctctttaaaagaaattcagatagaaaggccttacacaaaatacttagttagacttattcttatcctgattttctctgcatctgtaccaaacacatacaatttaaaaattgagagtaggcccactcagagttccaaatttacaccttgagaaaacattgtcactattctgagtcctctatcctagtatgtatcctctaattttcagataaaatgattacctggtgaatggataaccttacaatttagtgagttccccaagattagaagtgttgaaacacaaactgaataaagatatttttattattacttggaggaagaatccaaaaactctgtaattgcctgccatgcccactgccccctcctgagatgaggcaaggttcttttgtttgctttgatttcagctataagtatcaactctaaaaaccaaaaagagataagacacagaaaagaagaagaaattctaacatatgtttagttagaacctgagaaggaaagggggagagaatgatacgggggctttttgaaggtataatgactgaagattttcctgaactaataatagatatccatccataaattttaaaactctacaaatcccaagcagacaaataaaacacatttatatatcttacactaaaattacagaaagccaaaaacaaaacagtcagaggaagacaaggcagattaccatcaagggagacgagctaatcaagactgtatgatactggcacaggaatataaaaaatcagtggaagagaataaagagttcataaacatacccatacacatatagacactaggtatatttgaagaccaatgagaacacaatagaccttccaatatatggtattgataaactgggtattaataaggaggggggaatctgactcttacctcataacatatacaaaaaccagttgcaactatataaaatatctaaacatgaaagtgaaacttatggctttaagcataaatataggagagtatctgcatgaccttgggacagggaaggatttatttaaaaagatacaaaaagcactaaccataaagaaaaaatattgataaactcagctttttaaaaattagaacttatcataaaatcatcttacaggaaatgatgaaatagtccaaatagtaggaaaacaatcaataaaggactgagatccagattacataaataactcatacgaatcaataagagctattccaagagaaaaatgagtaaagatttgaactgacatgtcacaaaagatgactaaaaaccaataaacatatggaatatgttcaattttattattaatcacggaaacccaaattcaaacctgtgggggtgggcgggtataagtacagatatatattcaaatgaggatttaaaagtctggcatgtctgatttgtatatcatagtttttgcaaacatcaaaaatgtatttcccaagaccatttgatgacatgggagaatatttctgacacttctttttgcaaaaatgtagaacatcaaatggtaaatgaaataaaatttggtttttgacaaataatgaaaatacattaaaatattaaccctagttatctgagtggctaaattttattttttcttggtaatgctgtgtttttgagatctctaaattaatcatccttttatttttaaatcagaataaatatttgagaagaaaattcagcaagcataagtggagcaaccatccttttctgtgatgggaaaattatagggacctataattaaatgacattcctttaagcaagaattttcagaagaaaaagaggaaaccccaacacaccttggatactgcttgtagaagttcatcatgcattctttcctcctcttctgggtgacacctggagaaaggtaaaattgggagagggaagagtaactgtgagacaccaggtttttcttggtacccagattagtcaagtaagagttcttccccagccccattacccaccacacatgaggaatggagatcagaggagaatggggcattctgtccaattccagtggctcaggggaaaggttgtgttcactgctgtccagggttggaatctgaccagacctcagagaggtttcctagagacagagttctggagtcacaatcgcatagttgacaggaccccatactcatacacagaatgccacatacatttagggacagtcacacttaaggcgacatgcacgtctcacctgcccacaaggagccacacacggcaacacagttacaatcacatacacaccataggaaacacacaattacagctgcacaatcgtaggcaccccacactgtcgcagagtcacaatcacacatcaccacgggaacacacagccacaacccccacagtgacaggtatcccatatccgcacataagccgcagtgttattatctcccagacaatttcacaacctcccctctttttttgggggggtggggtggggtggggacagagtcttgccctgtcgccaggctggagtgcagtggtgcgatctcggctcactgcaacctccgcctcccgggttcaagtgattctcctgcctcagcctgcgagtagctgggattacaggcgcgcgccaccatgcctagctaatttttgtatttttagtagagatggggtttcaccatgttggccaggatggtctcgatctcttgacctcgtgatcctcctgcctcggcctcccaaacacaacctccacctttcaggccgctccgcccgcaggggcccaaggcgccagctccccatcggtcttcggtatcctcacctaagccctttccagtcatcccggatgggaacttgcagacctgagccagttctcctggggaccaaaatatctcacctcccagatctaagggtcccgccaggagtgacgaaacgttcgaattcctgcgagaaaagtggcaggccaccaggccctctgggaaatgtagtccagagcgggacccacgccgattcctgtcagctcctcgcctgggcccacccgaaacggctgctccctcaactctcaacatccagccgagcctcggagttgcgggtcgccgtagcgctgcgcaatggagatgagcctcccggggaacccggcccaagcctcaccctcacacaggaaagcagatgtgttctggccggaagttgagtggggccgcggggcctgctgggaggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatggggtgattgtgatatttggttgcgcgggattatgatgaaatgtgtgatatgtgtgtgattatgattaaggctgtagcgagtgtgaacgtggcgaagtgtgcgtgattgtaatatgtctagtagttcttgtcttgagctggcttttctgtagcatttggcacagttggtaacggcttgaaaaacacttatttgttttctactgatcctccctccttgttggccactcctctgtagtcttctttgctgtcttttttaccctagtagcccttggccctttgtaattttccactattccttggcgaacttttcaggttcattattatcttatgacttgctgcttttatgtatgttagttagctattgccatgataataattatgtctaaaaaccacccctgaactcaatgccatacaacagcaagtccttactctcctgttcacaggcttgcgcattgactgtgttcagctgatctaggtggggcttggctgagtggataggctgcgtgacgagttaagatctgcgccgcatgtgttctttcagggtctcaggccaaaaggacatttgttgccagggcatgctctgctcctgatgggtcaccagagcgcaagagagattgcctcaaccagagcaagtcacatggctaagcctaaaatcaattatgcccacagttggagagcaaagttacctcgcaaagagtatgaataataatctattagagggtgtgaggaattggactaaaattccagtctaccaccttaagaaacatacctctttatcctggtgaatgccttttagtccgggttctcttttgtctgataatattgcttttcaagttttattgtatttcttaagaatttcattttctaacccccttgtgtctttatgtttcagatctgtgtcttgtaaagagcatattgctgggcttacatccgtttatcttgtttgactgttattttaataggtgagtatagttcagtggcatttatcatgattgctcataaaaaatgttttattttctattacgccttaaacatttttgattgacatataatagttgcacatatatctttttttattgtgcaaattcaccttatccctttttctcccctaggttggtttctgctattatccttttttaatatgcatgcttaacaaaactcaaccttaagactttaaaatacttgaactccaaaatatccaccaatttctgtgttattcttgtctcatatattattttcttctagtttttgttgttgttgttgttttgttttgtttttttgagacggagtctcgctctgtcacccaggctggagtgcagtggcacggtctcggctcactgcaaactccgcctcccgagttcaagcgattctcctgcctcagcctcccgagtagctgggactacagacgcgccaccacgcccggctgattttttgtatttttagcagagacagggtttcaccatgttagccaccatggtagatctcctgacctcgtgatttgccgacctcagcctcccaaagtgctgggattacaggcgtaagccaccatgcccagcctattctcttctagttttaaatccccaaattagtagtagtagctcatttattctatatacagttcgtatccaggaggggttggtttcaagaccccccatggataccagaatccacagatgctcaagtccctacatccttctttatacattaaatcatctctagattatttgtaatacctaatataatgtaaatgctgtgtaaatcattgttacacgttattgtttagggaataatgagaaaaaaatctgtactgtacgtgttcagtacagacacaactgtagtaggcctaactgtattttttatctgaggctgattgaatctgaggatgcagaacctgtggataaggaggaccaactatgtatacacacatgtatatttaattgtggtaaaatacacaacatagaatttaccatctaaaccatatataagtgtacagttcagtggcatgaagtacattcacattgttatggtaccgtcaccaccatccagccagagaactcttcttcttgcaaaacagaaacccagtacctatcaaacaataactctgtacccccctttcccccggcctatggcatctaccattctactttctgtctctgaatttgactattctaaatacttcatataagcagaatcatatgttgtttgtgcttttgtgaccctgatttaacttagcataacgtcctcaagattcatccatgttagcatgtattggaatttcctccttttttaaggccgaatgataagtatgtcatatatggataaatattttgtttatcaatttattcatcattggacacttgggctgcttctaccttttggcaattgcaagtgacactgctacaaacatgggtatacaactatctgagtccctgctttcagttttttatatatacatgtggtaatgtctgtttttaatctttgattgtcatagtgttttcgataatgactgaaccattttatcagcatatttttgagcacctactatgaatatcaaaaacagacaaaaataagtccttgttttcatggagtttatgttgaggggggtgggtggacagtatatataactaaattatagtcatgtgccatatatgtatggactatatacatacatgacagtggtcctgtaagacagtggtccccagcctttttggcaccagggagtggttttgtggaagacaatttttccagggactgggggatgggagggttatggtttcaggatgaaactgttgtccctcaaatcatgaggcattagattcctataaggagcaagcaacctatatccctcgcatgcacagttcagaagagggttcacactcctgtaaggctgtaatgccaccactaatctgatagaaggtggagctcaggcggtaatgctcactcacctgctgctcacttcctgctgtgtggcctggttcctaaccaggaaccagtactgtaccagtaccggtacgtggcccaggggttgaggacccctgctgtaagattataatggagctgaaaaattcctgtcacctagtgactttctagccaatataacactgtagcacaataccattactcatgtgtttgcagtgatgctgctgtaaacaaacctactctgctgccagtcatataaaagtataacataaaattatgtacagtacataatacttggtaatgataataaatatgttactggttcatgtgcctactatactatactttttatcattactttggagcatatgcctatttatttaaaaaaagttaactgtaaaacagcctcaggtccttcaggaggtattccagaagaaggcattgttatcatagaatgtgatagctctgtgtgtgttattgtccctgaagatcttccagtggggccagatgtggaggtgaaagccagcaccaatgatcctggacactgtgtaggcctaggctaatgggtgtttgtgtcttaatttttaacaagaaagtttaaaaagttaaaaaatttttaagaagatagcttatagaataaggatataaagaaaaaatatttttgtacagctgtacaatgcattttaagctatgtgctactacaagagtcaaaaagttttaaaaaattgaaaagctggctggacacagtggctcacccctataatcccagcactttgggaggccgaggcgggtggattacaggaggtcaagagttagagaccaggctgaccaacatggtgaaaccccgtctctactaaaaatacaaaaattagccgggtgtggtggcagacacctgtaatcccagctacttgggaggctgaggcaggagaatcacttgaacccaggaggcttaggttgcagttagccaagatggtgccattactccagcctgggtgacagagtgagactccatctaaaaaaaaaaaaaaatgaaaagcttataaagtaacaaagttatagtaagctaaggctaattcaacaatttgaagaaataaaaattttataaatttagtgtagcctaagtgtacagtgtttataaagtctacagtagtgtacagtagtgtcctaggcctttgcgttcactcgccactcactcagagcaacttccagttctgcaagtttcattcatggtaagtgccctttaccagtgtaccattttttatcttttatattatatttttaccatttctctcctgtgtttaggtatgtttagatatacaaacacctacctttgtattgcagttgtctacagtattcagtacagtaacatgccatacaggttcgtagcctaggagcaataggctataccatatagcataggtgggtagtaggctataccatccacatttgtgtaagtacacttatatttgcacaatgatgaaattgcctaatgacacatttctcagagcatatctctgttgcaaagtgatgcgtgactgtatatattaatagtttgttagaaagtgatcactgtcggccaagcatggtggcttatgcctgtaatcccagcactttgagaggctgaggccagcagatcacctgaggtcaggagttcaagaacagcctgaccaacatggagaaatcccatctctactaaaaatacaaaattagccgggcgtggtggcgcatgcctgtaatcccagctactcaggaggctaagccaggagaatcacttaaacccaggaggcggaggttgcagtgaactgagattgtgccattgcactccagcctgggcaacaagagcgaaactccatccaaaaaaaaaaaagaaagaaagtgatcactgtcatgaaaaaaagtgagtgtgtgaggggtattaggaggatatctcaagcatagcacttctcaaaacttattataactgaatgttttctgttttatttgttctatcatacagggcaaaaattagtctattttgttacatatattttttttttaccctttacctaataaagactcatagcagctgctaaattaatatattttaatagtcatttcgtatattcatccaatattattgtgacatgagtataattgtcatttcagatgaagaatcttggaattctaaattgcaattctcccttaattcagttgccaagataatacagaaatggaatggaatagctggtctttgaatgaaactctcttttatgccaaatttggggttgctgcaaatctgggtgttttttgactcaggtttacatctgtcacctcatcgagcatacacctttagacacagaagatatctgaagaacagataggtaaacatcacttggtttatgcctctggtcagtgtgtccagagtgtatgaattacaaataaggaagattagtgtttgaggctatattatctattagtgtgtaacaaattacctcaaaaactagtggcttaaacaacaataaacattatctcacaatttctgtgggaagtgtcttcactgcgtatttgggcttgggtatctcatgaagttgcagtcaagttgtcagccgggctgcagtcatcagaaggctgggctggggctggagggttcacttccaagatagctggcttccaagttagtgttagctgtcaacaggaggcctctccctagggctggttgagtgttgtcatggtatggcagctggcttccctcaacatccatgatccaaatgtgcaagacagaagccctaatgtcttttataacctaaccttagaagtcacacaccatcatttctgcaatatcctattggttatgcaggtcaaaggtactcatggtgggagggatctacaaaggcatgaataccagaagacggtggtcactgggggccatcttggaagctggttatcacagggagccagtgagaaggcaccaggtaaattagatttatatcctaatccacaggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaaggtgaggtggctcataggtggacagagcttaggagagaaaggctctacatttggggacagtgaaaagaaattcattactcctactgagaaaggtcacgtatgttaattgactaggcaggggagacatttgtttttaatcatattcatttgactatttgattttttaaaataaattttgaaatgcaatttttatttcttaagagtatgtttaagtatatctttaaatgctgtactataacataaacaaaagcttcctattccatccatcctggttccctgtccccattcctgaaaggcaaccactttgaacatttttgtctcaatattctggtattcacctccttttttctaaataacattcttacactgctaatgcttcatttctcagttttagatatttcctgttgatttttgataatgaagttaaggatttagctctctttcactacctaaccccttccgtttcatctccaccccaacacactcttctccttgcccttctttctaatatggtattattttttggaggttgaaggttgaccagatgtcagcatctgtaagcattttcttttgggctagtcagtttccccagcaagaagtcctagattttgcttgagaagtacaagccagaactcctgctttttgggagacgaaggaagtgagcatgttggacacctcatcttgcaatatgagaactttaattcttttctctctgcattgcttcaaccccacctttatctgcatctggtatgcctgaaattcagagcttgtctcattcagtttatctagagaaataatctttaatttttttctgttgccaatgtgagggaaatgtgactatgccatgttgggtgaaagaaaacatcaggtggttttaacatctttttatgacatcttacattcggttttatgtttttcagccctactcccaaactctagtccacagaagtaattagtagctccattcctgaacctttctagggtcttgtcatggcttccccaccctcctcccaccttcacttaagcttcagctttctctggttaagttagataccactcatttgtctgctctttagcttcccacattttgttgacagctcttatctgtggaaatcttctatattctttgtccttatgagttttagcctccttttttcctttattaacattatgattggtttgggagagagtggaaatattaataaatgcaggtattcaggcttttatttttaaccaaaaggccctgaattttttagggtaaaaaataaatcaagttttttaaaaatgtcattagaaacatgactgtattgcatcctatcttatcaatgttccacattacctatagccagtctctgatgaaggtttttttctaaattattttttttgagggggagacagagtctcgctctgtcgcccaggctggagtgcagtggtgtgatctcggctcactgcaacctgcactttccgggttcaagcgattctcctgcctcagcctcccaagtagctgggactacaggcgcacgccactacgcccagcgaatttttgtatttttagtagagacagggtttcgccatattggccaagctggtctcgaactcctgacctcgtgatccgcccgccttggcctcccaaagtgctgggattacaggcgtgacgaccgcgcctggccctaaattttttatggttaaaaaataacattttaggccaggcgcggcgtcacgcctgtaatcccagcactttgggaggccgaggcaaatggatcccttgaggtcaggagttcgaaaccagcctggccaacatggtgaaaccccttctctactaaaaatacaaaaaagttagccaggcatggtggtggatgcctataatcccagctacgtgggaggctgaggcaggagaatcgcttgaacctgggaggcagaggttgcagtaagcagagatcaggccactgcactccagcctggacggcagagtgagactccatctcaaaaaaaaaaagaaaaaaaaattttaaagatcatcccaatctttaaatttttggggtaactattattatgtacttaagataaacttcctgttagaaataaaacagcaagattctagggagataaaatattgccaatagattcattgggcactgcatacttagccctccataaatccccatcagaccccatatgattaaattagccatctgtgtccatttcagtgtctatagctagatggcagttaacatttcttattgcttcaaggatcattcatctgtagagggtcttctagccacctggtactgaagatttctatattcctttgtctgaaactttgaagcaaatctgtttcatttctcttccctcagcttggtgttctcaagagtctgccctttccgaggaagaagaggatacaaccaggcctcttgtacgtcttaagcatttatttgtttcctgcattattttgcagtgcagttacggtgggttcttgtaacctaccaatgtgttggaaaaaataaattgatgaaaataaaagtgagaaaaaatacagatagaaaatcagaacctggggaaatttgagatatggctatgcagaagcaggtacatacagaattattaaagttgagttcaaatttaaatatgatctggacagtcaaagcaaactgggacacttaagtttattccgtaagtccataagttgcaccatttatgaggaaaaacttacaattatttaagtaaaaggcttttaactggcaccttgttcaaaaagaaactctaaaatatagttggacttctgtatctgtagattctgcatccatagattgaaccaactgcaaatcaaaaatacttgaaaaaaaaatgggtggttgtatctgtactgaacatgtacagacttttttcttgtcgttttctaaacaacatagtgtaacaactatttacatagaaatcacattatattaggttttataagtaatctagggacgatttaaagtatacgggaggacgtacattggttacgtacaaatcctacaccattttatataagggacttgagcatcagtggattttggtatccgtggggggtcctggaaccaattctacatggtttcctagggacgactgtaattccttaattcttacaatttttagcttagcttttagaagttggtcttggccaaacttcaaaaattcaaattacctggaagagtaagtggaacacatatctttcaaatgatcctacgtatatattttcttcaattgagtttttaatccaagttgagctaaattatactaatattctatggcagaatcttatagttctgatatccatagcttttcacatcttttttatggtctcagaagatatagtcttcatcctcatcttacaaaattacgtattctctgctcttgattctttttgtttccacctctgaagtcactcacacacctatattttgaatgttttctgcttaactgcctctttttcttcagcttatgtctttcacatcatgaaatatacacacatacttcttttgaccatatgatcatatggctcatccagttacttctgttggcgcggtggccctagcaaacctctctggccctcgacaggcttgagtttaaatcttggctcagtgacttatgaagtgcatgactgtggacaagtttcttaatctttttgtgactcagttacatcatctgtaagtctataaatggggatgataatggtatttatcccacaggaatgttgggagggttaaatacatgtaacaagtaccccataaatgataggcattgttatttttttctcaaatatttttggtctgccattggttgaatccatggatattgaacccacagatatggagaaccaactgttacagctttattgagttcttactatgtgccagatgtattgtgctttacatagcttatttcatgtaattattatcagacgtctatgaagtacatattatttaaattttttaagataagggaaatgaagcacagaggttaagcttacataacatcgtgcatcaatgtgtcataaacccaggattcaaatccatacagtctgactctagggcccacactctacgatactgtacagatggaggctcattatgagtgaagaaatacaaaagccaattacccattcatattgtttgtctattttgtaataatagttttttctgtattcgaaattagaatattttaagaatgtctatttcagtattaggacttaggatttatgcagctaccttctcccaatctgtcatttttatgttatttattttttgttgtatagacattgaagtttggatagttacatttagtgtatgataaatatgtatacataatagaattcagtcaaaatatgcaactattaatatttagtagtcttttctcatgagttgccaatgttaatcttttctaagatatctttcctaattaatattagatcatagagataatctctgttcaaagcattgttttccatatttagtctttaatccaactggattataatattgtaattggtttgagataggaatttactgataattctattagtagaattatctttgcatgtagaagaccagttgttccaacaccgtttattaagtagatctttcctttgtgatgccacctttactgtatacatacatgatggtttctaggcttttactttttctgtaatctatttgtctacatttatatcagtactgtactttgtgtgtgtgtgttttacattggtttaattacaattactttatatgggcaatgatttcaccacttctttatgcacacacattattcttagtttttcaaaaatttttcagctactttgggacctctgggcttccatttgaattttagaattagtttatctagttctaggaagaaatcctattggggatttccattgaattgcacaactagttggagaagaattaagcaaaaaatacatatatataaaaaatatataaatatatatatatataaagatatatgtgtgtgtgtgtgtgtatatatatatatatatatatatatattatatatatatatatattttttttttttttttttttttttttttggtgatgaagtcttgctttgttgcccaggcttgagtgcagtgacacgatcttggctcactgcaacctccacctcccgggtttaagtgattctcatgcctcagcctcccaagcagctgggattacaggggtacaccaccatgcctggctaagtttttgcatttttagtagagatagggtttcgccatgttggccaggctgacctcaagtgattctgacctcaagtgatccacctgcctcagcctcccaaagtactaggattgcaggcatgagccattgcacctgtcccgaaagatattttctgtcacaattaaagatgtttccatttaagggaatctattaatataaattattatattcaagagaaaaacaatcagatctatagagctgaaaatttttttaactcagaacctgtgatttcaaaaggacctatttataaagtaaaagtaaaagaacattttcttatgatattttaagaaattattcacacgcatacaacacatatatatgtgcagataataagctacaagctagtaccatgtttacttgtaaaaattaggcactttcctactagtcaggaacacaaccagcttgccagtgctactactacgattttgtatgcctagacataagtaaggggagggaaatgaagtaaaaagcaggatggtgcattcaaaattatgatatctaagtgatacaattatgtttttaggcaacagaagagaaacacaagaatgattgaaatatggacacaaaattaatatacaaaaatcaataccatttttctctataaaccacaccatcaaaaatgaaatggaagaatgatgctcagactagaaaaaaacccgaaagaaaaaaataaaatgtatgtggtgtacatgggagaatgaaaccttcaaattattactgagatagaggatttgaacaaattttttaaatacccttttttggataagagccatcattattaaattaatataaattgtctttaacctacatagattgatcagaatctcaataacaattctaaattatttttcttagaattagacaagtttatttgagccgagtctagaatacatttgaaaaataaaaacatgcagaatggccaggaaaagtataaaagaatgtcatgtgccatgctctaagtttttaaaagaagaatatttgtttaatgcttacataactttagggaaaaaaaaattttataaaaagttgccagtcaacatatacacccagaactgacttgtagttatctttattccctcactgtaaactttgttattttaaacaattatattctattatgtatcttaaaagtgaagaaagcgaggcatggtggctcacacctgtaatcccagcattttaggaggccacagctggaggatcacttgaggccaggagtttgagaccagctggatcaatacagcaagacccagtctttacaaaaaattttaaaaaattagctgggtgtggccaggcgtggtggctcacgcctgtaatcccagcactttgggaggctgaggcgggtgaatcatgaggtcagaagatcgagagcattctggctgacatggtgaaaccccgtttctactaaaaatacaaaaaattagccgggtgtggtcgtacacacctgtagtcccagctacttgggaggctgaggcaggagaatcacttgtacccaggaggcagaggttgcagtgagccgagatcgcaccattgcactccagcctgggcgacagagcaagactccgtctcaaaaaaaaaaaaaaaaaaattagctaggtttggtggctcacatgtgtagtcccagctactcaggaggctgaggcaggaggattgcttgagctcagcagtgagtcttcagtgagctatgattgtggcactgctccagcttaggtgacagagcgagacccagtttcaaagaaaaaaaaaagtgaaggagaggaaggtgctgtggtaccagcaagaacattggaaatattattgcctcttgccaggggcagaagcgtgttcatgtttttttttttttttggttctgtttgacaggagaaggaataaaacttaatgacatgaactgtgaatttatgttttttaaggttcgaacccctatgtttcttgctattaatactgaatttcttaacatttgtatgtgaagagaatcaacatcttgggaaaatagaccctattgtaaagactgactcatcattttatacagtcaaaaattaaagcatattttacttcttggtattttgttacttatggcttttgtcagggatgcaatttcttttttttttttttgagacagagtctcgctctgtcgcccaggctggagtgcaatggcacaatcttggctgactgcaagctccgcctcccaggttcacgccattctcctgcctcagcctcccgagtcgctgggactacagacgctcgccaccacacccggctaattttttgtatctttagtagagatggggtttcaccatgttagccaggatggtctcgatctcctgacctcgtgatccgcccgcctcggcctcccaaagtgctgggattacaagcatgagccaccgcgcctggccaggggtgcaatctttttatatgagatttatgctaagttactagagttggtgggaaaatgtttttgtgctgatttgttagcactaatttaaaaaatgttttctctttttgtagttttcccctatctttgttgtggtgtatattccagagggattatctatttctgaaacattcatcagttgattattgtgtcaagctctgttctgagtcacatttactgtgttatttagtcttcacatcaaccctttaaggagaattccactttatagatgaggaaactgagactcaagtttggctatttgtcaaggtaacacaattagtaaattttgaagccagagtttgaacccatgacattggataccacagcctattaactggtaaaaaatatctaaacccagctccgttttgaaagtttagtatttcagcattttttttcagtcagaaatgtgtcagtcacatgtctgttcagcctttctgctgcttttgtgaatagaaaacaggcgttcattcttatccttggggtctgcaggttaactatgtgggcatctctgctttgggctgcagatcagctggccttggcttaggctccacagtgggcttgtgtctgctctgcatatattcattctgagtttcagctgaaatggcacagcttcctgggccaaggtcttcatttgctgtctcactggagcacatgagccaaggtaaagggtgtaagcaaatttcaggcctttgctcacatcatgtttactgacattccttttgccccaacaaagggctcagacaaggcccacattagtagatgggacattagtacaggcaggaagtgaagactcgctgaataatcaatttatcacagtaatattttctaatggaattattttttgttgagtttgtttttgagaccaggacttgctgtgttgcccaggctggagtacagtggcatgaacttggctcaggtgatcctcccgcctcagcctcccgagtagctagatgataggcatgtgccatcatgcctggctaatttttttattttttatttttcgtagagatggagtctcactatgttaccaaggctgttctcgaactcctggcctcaagcagtcctcctgcctcagcctcccaaagtgctacgattataggtgtgagctactattcccagcttcactgagattttttaaactttaaacatattgaaatatagtcttataacttaaaaaaactttattaacatataagtcacatactataaaattagcccatttaaagtatacaagtgagtggtttttagtgtattcacagagttgtgcaaccatcaccataatcaatgttagaacattttcatcaccctgaaaagaaaccctttacctgttagctttcacttcctgttttcccttaaggctctgatgtaggcaagaataaatgatttctagctctatggatttgcctattttggacatttaatgtaaattgagtcatatgataaactgttatcctttgtgttgcctttcgcttagcattatgttttcaagtttcatgcattttgtagcttgtacgagtactttttatttctgaataatattctcttgtagggatataccacattttctttattcattgattaatggaaatttgattcatttccccttttaggctattatgaataatgctgataagaacattgatgtacaagtttttatgtggtcatatgttttcacttctctgaagtttgtacatagaaatgaaattgctagatcatatggcaactctatgcttaaccttttaaagaattgccccactgttagccgagtgcaatggctcatgcctgtaatcccacactttgggaggctgagatgggcagatcacctgaagtcaggagttcaagacccacctgaccaacatggtgaaaccctgtctgtactaaaaataaaaaacaagtagccgtgcctggtggcacatgcctgtaatcctagctacttgggaagctgaggcaggagaatcacttgaacctggtaggcagaggttgcagtgacccaagaccacacaccattgcactccagcctgggcaacaagagcgaaactccgtccccagaaaaaaaaaacagaattgccctactgttttccatagcagttgtgctagtttacattcccaccagctgtgtatgaggattccagtttctccatcagcacttgttcttatctgtcctttggttatagctgtcctagtgggtgtgaagtaaagctcatgagattttgatttacacgtactgtataacttgtgatgttgaacaccatttcctatgtttgttggccatttttattaatatatcttctttgaagaattgtctattcagagcctttgcccacttctaattggtttgtcttttgattattgaacttttaagaggtctgtacatattcaagtgtcatcagataaatgatttggaaatattttatcctatcctctgggttgtcttttcactttcttgatgatgtccttagaagcacaaaaatttttagttgttctgatgtccatttttatttaattttcttttgttgcttgtgcttttggtgtcatatctaataaaccattgcctaattcaattgaaggtcataatttacaactatgtattctgagaccttttttttttttttttaagctcttacagctagatctttgatccattttgagttaacctttgtatacggcatgatccaccttcattcccttgcatgcagacagtccagttgttgtcccagcatcatttgttgaaaagactattctcttccctggtgaagttttttatcaccatttattatgatgtgggggttttgtagttgccctatatcatgttgaggaagttcccttcttttgcttatttgctaatttgttggatgttgggttttttggttgttgttgtttgtttgttttcaatgataaaagggtgttggattttgttgactactttttctgcatttacggagatgatcttatggtttttgacctttattatattggtatgatgtattacattaattatcagatgttaaattaatattgcattctgctggggtaaatcctacttggttatggtccataatactttttatatgttgttggattaggtttgttagcattgaggatttttacctctctattaataagagagagtgggctctagtgtttttttggggggtggtgcgtgtgtgtgtgtgtatgttctttgtcaggttttagtattagggtaatacttgcctcataaaagatgtgtcccctccttttattcatcctctttgttttggaagagtttgtaaataagttagtattaatttttttgttgtttgttaaaattcaccagtgaagccatctaggcctgagtttttcttttgggtaggtttttttttttgttttgtttttttgttttttttttttttttttagtaattcagtctcttgttacaagtcttttcatcttttctttttgttgcagtttaatcagtttgtgtctttctagaaattcattcatttcatctactctagtttgttggcatatatttattcataatatttctttgtattcctgtttatttctgtaagattagtagtaatgtttcttctttcattcctgatttttgtattttgagtcttcttgtcagtgatatttgtccattttgtcaatttttagttttattgattctctctaatgtttttctagtctaaatttctttgatttccattctgatgtttgcttatttccttttagttactttggatttagtttgatcatcttcttctagtatcttttttttttttttttttaattgaggcagagtctcactctgtcacccaggctgaagtgcagtggcatgatcatggctcagtgcagccttgatctcccaggctcaggtgatcctgccacttcagcccggtcccctaagctcccagtagccgagactactggcatacaccaccacgccctactaagtttttgtattttttgtagagatggggttttaccatgttgctcaggctggtcttgaactcctgggctcaagcaatccgcctgcctcggccttccagagtgccagattatgggcacgcccagccctcttctagtattttaaggtagaaagttagtttattgatttgaaatctttcttcttttttaataaagtgtgtacagctataggtttccctctaaaacttgctttaatggcattccataagttttggtatgttgcaccctcattttcttttacctcaaagtattttgtaatttccattgtgattttgttgatccattggttatttcagaatattgtttaatttttacatatttttgaatttcacaaatttctttctgttagtgatttctaatttttgcccattgtgatcaaggaacatactttacacaattctcttaaaatttattgaggctttttttttttttaagagacaggtctggctgtgtttccctggctgaaattcagtagctgttcacaaacataattatagttcactatagccttaacctcctgggctcaagtgatcctcttgcctcagcctcctgtgtagctgggcctattgaggcttcttttatagactaacatattttctatcttggagagtgctctatacacttgagaagaatgtatattctgttgagtggtgtgttctataggtgtctgttagatctggttggtatatggtgtttgagtcttctattttcttgcttataatctgcctagttgtatccattattaaaagtggtgtttgggctgggttcgggggctcacgtctgtaatcccagcactttgggaggctgaggcgggtggatcacgaggtcaggagttaaagaccagcctggccaagatggtgaaaccccatctctactaaaaatacaaaaattagccgggtgcggtggcaggcgcctgtaatcccagctactcaggaggctgaggcaggagaattgcttgaacttgggcggcagaggttgcagtgagccgagatcgtgccactgtactccagcctaggcgacagactgagactctgtatcaaaaaaaaaaaaaaaaaagtagtgtttggagtctccaaaaattattgttaaattgccagtttctgccttcaattctgtatttttgctttaggtattttaagactgttagatgcatatataattgttatatctttctgccagattgacccttttatcattataaaatgtcctttagtaacagttttgttttaaattctattttgtctgatattagtatatccactctagctttctatggttgttcgcatgctgtgttttttccatcactttattttcaagctatttgtatatttgaacctaaaatgtatttcctgtagacagcatgtagttgaattctgtttttctatccaatctgacaatctgtccttttttttggcctgtttaatccattcagagttaatggtaacactaaaattattgggctatgtctgccattttcctttttgttttccatatgtctcatgtcattttttgtttctcctttactgctttcttttcactaagcaaatattttccagtataaaattataatttctttaatgatttttcactatattttcttagtggttgctctaggacttggatactatgtatcttatcagaacctacttcagatttatactaagttccattaagatatggaaatgttggtcttatgtagctctattccctcttcccttgttttgtactattattgttatatatgttacagactcaacccattattataattactactgcatataatgttgcatcacttaaagaagctgagaaaagagagcaaatatgtattatgtttattatattaaccttatttaccatttgtttgtgttgattcaagttctagtaaatcttgtgtcattgcttactctattccaaatttgctctgaagattctctctttatctctggttttcaacatttttgctatggtatatctgactgtgggcctcttacatttattttacctggagttcattgagcttcttgaatgtataatgttttttgtcagatttgggaaatgtccaaccattatttctttgaatgttttttctgcacctttctctcttcttcttctagtactcctacctctgacccctgagtaccagctaaacaagttcttgtatgttgtgatcacaatgcctaattttgatgacttcaaattaattagcattatgtttttacaggaaacagtgacatttaaggatgtggctgttgaccttacccaggaggagtgggagcaaatgaaacctgctcaaagaaacttgtatcgagatgtgatgctggagaactacagcaacctagtcacagtgggtaaggtggcttggtagccttgcaatttaacagagaattcttttccatttctgaaatgtgtgaagactgtaacttgccagatgaatctagcctttcctttctccatgtgactatatgtgctccactcttcagtgttaaaggctgattactttgtgtcattgtgtaagttcattcatcctcatcttttataagccctcaagcttggacttagcctaagatctgaatggttgtctccagcattgacatccacatcctttgctatttcttgtaataggctgtcaagtcaccaaaccggatgtgatattcaagttggagcaagaagaggagccctgggtgatggaggaagaaatgtttgggaggcactgtccaggtgaataagtgaaaagcagctctgaatgagaaagccacatgagagttgttcagtgaagggttgatatcatttcacaatttccaagattttcttaaaggccttattcttctagagtgacaaatgggatggagtgctttagattactgtgacatttctaggtattattcttcctattttgcagatattttcctcttttaaattgtagagggccagtagccctatccaatttcataataccaaccttccctaattcattcacagcttcactttcaggattattgttcctctctctatgatcctcgggcactctctttcctttatgtttatggtttcattttcttatgcattcagtatttcatggttgtgtagtaattttaaaacatgtttcacacttaggtttcttttcatttctttccttctttcttttttaaaaagccttagatttgtgtttggttaacaatagtttcacttcccattgtgcttcacaaccctcacaatcccatggcttagaaatgtaaaagtttctggcttagaaatcccatggcatctcctttctgcttattcctgccttccattcctttaatttttttgaaactacatgaggtccatccttggttgaaaagatataaccaatgtaaccaatattatacctataataccaatattataccttttgtgcaaaagtaaatcttcctcttatcctggacatggtcccttcctttccacagttgcatacacttcttttttggagttatcctggctatttttgattatttattttaccatatgaattttagactaaactgtctatttccagagaaaaacctgttggaatttttattgggattgtgctaaatatataaattaactttcagaaatttaacatccttttaatgccaatgttttctgtctaagaacacacactgtctttgttcagattttcatatctacttctgtgtcctttagaaatggagctttccaagttttcccattgttgcttttatacatttcactataataatgggtaagaaagctataaaaccatccttatttacagataatgagattgtatccctagaaaacacaagcaaaccaattgagaaagtacaacaaatagtaacagaactcagtgaggtggtaggatatcaaattaacaaagaaaaatcaatagctttcatatatacttcaacaaccaagtagaagatactaaggaaagaaaactacatttatagtagtaagaacaaagatgaaatactcttctgggcatggatatataacagtataccaaacaaaatcctgtctttatgagcttataatttaatggaaactagagtccctgaggttttgcatatgggaaaatatctttttaacctttacatttggttgatagttggctgtgtgtaaaattcttgaaccatactttcttttccaaagagttttacagacagttacctgagggatttagacaattctctgttgtttcctagattcaaatgttgcttggagaagtctgaagcctgattatttcccctcataggtgacttattttccaggatgcctataggtttctttttctttaaagcttaagtggctttatgaggctatgccttggaattgatcaatcagtatcagtttttcctttcagcttgtggattcatgatttttgttccttgaaatgtcgtcatatagatttcatgctcgtttcttttgtggttatcattgtcatctttcgatgaaggtatttcctgctgtagccactgtttacagaaggatagtgttgaagactgtccagaaaaatactctgagttggtaagaagtctctatacctcacactgacctcctttatcatacaaggttttgtgttgagagttggtttaccctttcattctcccaagttaaagagagattattatttgcatacttcctctagaactcagtgtctcttccatcttcctatgctaacaaactgcttatataagaatactggctgtttgcatctctttgttcagccctgcctttgtaccatttgtcagggccagatgaagtccattctgtacctgccacaatttcaagacatctggcaaaaaaatgactcattcattctgcccacaagggggtgcctctgttttagagaactctgttccctgtactttttgttggagataagaaacaggaactgctatctctgggtttcttccctgcctaatccagtctattttctgttctttcctcctattctggggatggagtttagctatctttaaggttcattgaagatgtattttctttctttttttttttttttttttttttttgagacggagtctcactctgtcatccaggctggagtgcagtggtgcagtctcagctcactgcaacctccgcctcctgggtttaagcgattcttctgcctcagcctcccaagtagctgggactacaggcacgcgtgaccatgcctggctaatttttgtatcttttagtagagacggggtttcaccatgttggccaggctggtctcgaattcctgacctcgtgatccgcccacctcggcctcccaaagtgctgggattacaggcaagagccactgcatctggccagaagatatattttctttttctgtttcttcttcatgtttgcagagtgaagaggagacagagatgtttaattctaccatattgaaacaggaagtcctctatgctgtatttgatccatttcacccttcttggaaatgtctttcttctttgtgcttctctaaaggattcaaattcttccttggttctggtttattgtttatttcttcttcccttgtgaaatatcttttacatgacttctttctcatctctcactggacatcacccaaagtagttctgaattacaatagacttctttttcctcagagtaccttcatgctatatctgtgttcatgctattaaataggtatttaactctagaaatgacagcattggaatatgtatctttaatgcctccagaattttgaaactcttcatatctctgccattaattatgagtgctcttacctaagttctagcagttatttaactttaatatcattttctaataaatggtcctcaatatttccagcctacattggtcttgcccatctctcaactaacattctattacacgtctaccagagtggttggaatctgaaaacatatactatcttctacatgttttcatattttgatgtctaacacttgtttattagtccacctggagaaagaaaacttttattcttcctataaatgagtcatgattgatgtagagctatatttgggaagatttttcttatttttggttgttttaaaatatttacctacagatttcaaaataaacgtggaagaaatcaggctagagttagaaagacagggcatagtcacatgagatagtgttgaatgttaaattgcatgtgaagtgtctatttagtaaatgagtaaaccagacaacacctagaaagttttaagagaagggctgtagaaggagtaacaagattgaggctttctttttctttttgataagagcttggcattgaagccattttcctgtaagatctatagcttatttagacttattaaaaattagaaaacataacaaaatgtttggaaagtaaaattagcgtgtctgtttggggggtaaaattagaaacatggcctgattagaggagagaagattgtaagagattagtgaaatcaaggatgagttttccattgtagagtcagaaagttctgaattttgctagcattcatgttctcttttgctgtcttttatttttaaaattttgttgtcaatttagtttattttttcccctctttaatcactgaagctatagttttgccctgtgcatggtggcagcaaggttacaatggtcaattataagcaggggtttataagataaacagaatatgaaggttaaaacacatctagttatctgaattttaagttacccacagctgatggaactccaggggcgtggaaaaccattgtagaactaatgatgtaggaatgttatcattttgggtgatggtatgaaagaaaaaagtcaaaacacaatggaatttgatataaaggcagtttcagtgtggagaaataaacataggataagatgataggacctgctgttaacacactgtggtgaatcaaagatggcttgcctcctgatcagctttatactttttattcaataaaattagaccttcctatttctaatatgccttgttctttaagcacatataaaaatgaatcacaattagatggaaagttggagctctctccatatttattaccaattttggatcgtatttagtttggacagactaatcttcaagtatgtttagatagaaataaaggaatttgaactttatgaaaattaatttgcctgtggtatgcagactgcacaaaagatagacttgtcaggatcatgacagttaatctaggcaaaagtaatgagaacttgggttatcatttgtttctcttaacctaatgtagctgttattatttctcatgccatttctttcccttttaatatgcatttttagttttttcaaagtataccttatacattacttgttttagagagccagtagaaatgtcagattatagcagtgctgtgctctgacctcacatttcacctcctttagtcaattatttttgactttttttaactatctcttttgttgtcgacctacgtattttgaaacaaatgtttatactgctctgtaaatttttttttttttttttgagacagagtcttgctgttgttgcccaggctggagtgcaatggcgtgatctttgctcactgcagctctgcctcctgggttcaagtgattctcctgcctcagcctgccaagtaactgggatcacaggcatacaccaccacgcccggctaattttttgtatttagtagagatggggtttcaccatgttagtcaggctagtctcgaactcctgactcacctcggtctcccaaagtgctgggattacaggcgtgcaccaccgcacccagtctgtaaatgtttctgtagtcattttcaaacataagaatagagagataaaggagctggtcgcggcagctcacgcctgtaatcctagcactttgggaggccaaggtgggcagattatgaggtcaggagatcgagaccatcctggctaacatggtgaaaccccatctctattaaaagtacaaaaaactagccaggcgtggtggcgggtgcctgtagtcccagctactcgggaggctgagacaggagaatggcgtgaacccaggaggcagagcttgcagtgagccgagatcacgccactgcactccagcctgggtgacaggaccagactccgtctcaaaaaaaaaaaaaaaaaaagaagaatagagagataatataaggaatcctcatgtattcatcactcagcttcaacagttaccgacattttcttagatttgtttactctgtttctctcttacccccactccagttttgttttgtttttttgctgaactactttaccttttcttttaaatactaccatatgtattgccaagagatttgtttaatcctgcaatatttctaacacacctaacaacattagtaataatttcttactatcatcttctacttagtctctgttatatatttcattgtgtcaagaatgttgtttatggttggtttatttgaatcaggatccaaataaaatctgcacattcttagttcacagactatacaaaagcaggctgtgggtatagtttgccaacccctgctctagatgtaccttattctggatttgccatttgacctccttgtggtggtgtttgacatgcttctttatcccatttttcctataatctggctttattcaatgcagattcaaatctttggcaagtatacctcataggtgatgctgtgtacatcctattgcatcttatgtcagtttgtcccacttacagacataattgagattgatcagtagattcatgtattgtcaggccaaatcctcctatttcagtgatctctgtcaacctttcacttaagggttttagcacctattgaccatcatagcctagatccattattttattgagcgtctttcacttttattagctgaaattctcccaaagagaaaaactctctcattaactatttgattgcactgaaatacagtttctcaggccaggaaaaagaaatactctttctcttcaaaagcttttagaataatgattggtgtcctagaggtttccaaaatttgtcaagttaaatcattataaatttatgtaatttgagcatcagaatatattataggcatataaatatttttcatatattattattattataatattgaagacagagtcttgctctgtcgcccaggctggagagcagtggtgtgatcttagctcactgcaacatccgcctcccgggttcaagcgagtctcgtgcctccacctcccgagtactgggattaaaggtgtgcgccaccacacctgtaatttttgtatttttaagtagagattgggtttcgccatgttggccaggctggtctcgaactcttggcctcaagtgatcagcccgctttggcctcacaaagtgctgggattacagtcatgagccaccacaccaggcccatatattaatactcaaattgtctcatcttgagcaagagggatctttagttaatcttgtaagtttcccgctccagacatggaaatagccatttctttaaaaacttttgcctcttttagcaggaaatgatattgtggagactgcagtctgaggattatggttgctctttaatactgagttattggttctatagcttttaagtggacagagctaggaaaaatgcatcttttaaaaagaaaaaaataggccagtcacggtggctcatgactgtaatcccagcacttggggaggttgaagcaggcgaatcacctgaggttgggagtttgagaccagcctgaccaacatggagaaaccccgtctctactaaaaatacaaaattagttgggcgtggtggtgcatgcctgtaattccagctactcgggaggctgaggcaggagaattgcttgaacctgggaggtggaggttttggtgagccgagatcatgccattgcactccagcctggacaacaagagcaaaactccatctcaaaaaaaaaacaaaaaagaaaaagaaaaatatatatgaattttagatacatccaattaaaattaaaaagtatagtgcccttttaccttttatgctgaaaatcttggctcctcattacatgtttatttccttaattcatatatatttctcacccttgacactattgacattttgggccagataattctttgctctgggggactgccttgtgtgttgggggacgtttagcagcatgcctgcttctactcactggataacagtagcgccatccctctttctccccatcatcttcccagttgtggaaaccaaaaatgtctgtagaccttccagacattgcccagtgacccttaaggagtaacactgattaatctatcttctttctttatatattaatttcaaattaacagtaatgctaatattactaataataaaaagacaactaaacgtaatttaagatgtcttttgagttttcttccttagaatatattctaatagggatatatagtcaaactactatgtttaaggttacttgaagtaattttctatgtgattatgaccctcatttgataagtaggcttgtttccaatttttttctatttttagggattgctttggcttttttcttttttgatttaatttttattttttcatatgtaaaatatgtacatgattttattgtcagaactctaaagttacagtcagagaagtcatggtttcagtacatgtaagtgaaaaaaactcagcgtagagaacattgtttagaatatactctcttttatgtgcaaatggatgggaagagagacagagagagaagtgtgtgtgtgtgtgtgtgtgtgtgtgtgtgtgtgtgtgtgtataaaatatatattaaaaatacaattggccctcggacaacatgggtttaaactgcacgagtccacttacatgctgattttcttacacctctgccacccaagacagcaagaccgacctcctcctcagcctactcagtgtgaagataatgaggatgaagatgtttaggattatccacttccacttaatgaatagtaaatgtattttccttatgattattgtaataacattttattttctctaagttattttattgtaaaaatgcagcatataatacatatacaaaatatgtgttaatcaactatgttttcaataaggcttctggtcaacagtaggctattactggttaagttttgggagagtcaaaagttagaaacatttgcaattatgtggaggattagcacctcatccccatgttgttcaagggccaactgtacatatgatatatgcgtgtatatgtactatatataaggaaatgtgtgattatatgtgtgtgtgtgtgtgtgtgtgtgtatgtatgtgtgtgtgtttttttaaatagtggaagaataatccaagaactggctgggcgtggtgtctcatacctgtaatcccagcactttggaaggctggggcgggcggatcatgaggtcagaagataaagaccatcctggccaacatggtgaaaccctgtttcaactaaaaaaacgcaaaaaattagccgggcgtggtggtgtgcgcctgtagttccagctattggggaggctgaggcaggggaatcgcttgaacccgggaggcggaggttgcagtgagccgagattgcgccactgcactccagcctggcgacagagtgagactctgtctcaaaataataataatgataacaataataataatccaagaactaataaaaatggttatctatagggcaaagcaggaattggtgtttcagggacagggtggaatctggacttccgctgctgtttggtaatttgtcagtttttatcaacttgatataaatagaagatgaggtttagtagcattaccacaatcacttctcctttccttttcttctggaatatagatacatcacaatttttagctaattcaatttcaccacttactttgttatgattgttgacatattgtttactatgaggcaagaaatgactcttaattaatatacttatataactttttgtcactcctagaattactacttgccttatttttctattttctatgtattattaatttaaatgataccctcaaaattctttgtttaaataaggaatccatcgttgttattagtttacctcattttgatgcatgaagggataaaagggaaattctaaacatcttccaaaattctaaattttaaagaggataaaagaaattttttagtttttttttttgtttccttttttttttttttttttttgagatggagtttcgctcttgttgcccaggctggagtgcaaagttgcaatctcggctcaccacaacctccgcctcccaggttcacgcgattctcctgcctcagcctcccaagtagctgggattataggcatgctccaccacacccaactaattttgtatttttagtagagatggggtttctccatgttagtcaggctgaactcccaacctctggtgatccgcctaccttggcctcccaaagtgctgggattacaggcttgagccactgcaccctgcctgtgttttttttaactagtggactatactgtagaatggttggatcagaacctagaagattttttgtttgtttgtttgtttgtttgtttgagactgagtctcactctgttgcccaggctggagtgcagcggcacgatctcggctcactgcaacctctgcctcccaggttcaagcaattctcctgcctcagcctcctgtctagctgggattacaggcacgtaccaccacgcccagctaatttttgtatttttagtagagacggggtttcatcatgttggtcaggctggtcttgaactcccgacctcgtgatccacctgcctcggcctcccaaagtgcggggattacaggtgtaagccaccatgccctggctgaacctggaagttttgtgtggggccccaaatgccagcatctgttgttccttttaatctttttatctcctatgtgtaggtacatgccagcattcatgaggctaaataacagaaagggattgttgatctcattcatgttagagtgtatggtgaatctaaatcacatgggaactctacatgcagttatgtctaggaaatgtagttttaactgcctcagcctttacgggatggaaaagcatggtgggagactggaatacatgttacttaagcagatccataactcttgccttggtgtgtaactgctccctactcagactttaatcctcttctttttagtcccactcttatcctacccactccacttttttttgagatgaggtcttgctatgtttcccagactagtctcaaattcctgggctttagcaacccttccaagtagctgggaatataggtacagcccactgcatctggttttttaaattaataaacttcatcttttaggctggttttaggttcacaacaaaactgagtggtgtacagagctcatgaaaaagtaccaagtatatggatacccactgcccaggcacacacagccttccccactgtcaacatcttgcaccacagtggtatatttgttaccatcaatgaaccttcattactgttattattatacacattattattacacaaagtccataatttacattagggtcactcctggtgttgtacattctatgggttttggtaaatgtataatgactcagatccattatagtatcttacagaatactttcactgtcctaaaactcctctctcttcctcctgtttattccttcctctcccataagctctggcaaccactgatacctttactagtcatcattttgccttttccagtttggaatcatatagtaggtggccttttccaatgggtttcttttacttagcaacatgcatttaaggttcctccatgtcttttcataacttgatagcacatctgtttttatcattgatgaatatttcattgtctagatgtagcacagtttatccgttcacctagtaaagggcatcttccaagtgttggcaattaggaataaagctgctgtaaatatccatgtgcagatttttgtatggacatatgttttcaactcattggggtaaataccaagcatgattgctgaataatatggtaatagtatggctaattttgtaagaaactgccagactgtcttccaaagtggctgtaccattttgcagtcccaccagcaatgagtgagaggtcctattgctctgcaaacttgtcagcctttgacttagtagttgcagcaggggttttttgttgttgatttttttttttttttttttttttttcagatttcctacatagatgatcacatcacctgtgaacaaagacagttgttgtttcgtttttccttcctaatctgaatagcttttatttccttttcttgttattgcattaggtaggacttctagtacaatgttaaaaagcagtaatgcgagggaacatccttgccttgtgcttgtttatccctaccttttgagcgcctagattctccaattcttgagcctttccagtgatttctggccaaatctctttgttgcttattgtcatttgcatcttcatgatactttgtagctttgctattcagtttatcctaaatgcttctcatcctgcagtattatgttaaaatctcttgttcatctttttttacactcacgtctcctttttcttatggatttaaccctttattccttcactatcattttaatggcattttaggaaggaggaaaaatacatgcattcaagcctgtgtgtttagtcacaaatgttcattttgttctctagccgtttgactccctatcagtcatttttgtgttcaccctttcattttaattattctattcattttgctgatttctgcactatacgtggacgctttaaaaatcagtcaaggctacttggacctacagatgtcagtttttgtctccatatgttttatgtagtagttaacttctcaaaccttaggaactaggaacatttactcttagctttcttttgtattggttgactaggccaacatcaaagattaaaccccacattagcctatttctgatatgttattaatagtctagtggtagaataattcacaagtaataatttctggtcctccattttagaagtttgggaagttgatgaacagatcaagaagcaacaggaaacacttgtgaggaaagtcacatccatctccaagaaaattctgataaaggaaaaagtcattgaatgtaaaaaagttgcgaaaatatttcctctgagttcagacattgttacttcaagacaaagcttctatgactgtgactcacttgataagggtttggaacataatttagacttacttagatatgagaaaggctgtgtaagagagaaacagagtaatgagtttgggaaaccattttaccattgtgcatcctatgttgtaaccccctttaagtgtaatcagtgtggacaagacttcagtcataaatttgacctcattagacatgagcgaattcatgctggagagaaaccttacgaatgtaaagaatgtggaaaagccttcagtaggaaggaaaatcttattacacatcagaaaattcatactggggaaaaaccgtataagtgtaatgaatgtggaaaagctttcattcagatgtcaaaccttattagacaccacagaattcatactggggagaaaccttatgcatgtaaggattgttggaaagccttcagtcagaaatcaaatctcattgaacatgagcgaattcacactggagagaaaccctatgaatgtaaggaatgtgggaaatccttcagccagaagcaaaatcttattgagcacgagaaaattcatactggggagaaaccttatgcatgtaatgaatgtggtagagctttttctcgaatgtcatctgttacgctacatatgagaagtcacacaggggagaaaccctataaatgtaataaatgtggaaaagctttctctcaatgctcagtatttattatacatatgagaagtcacactggtgagaaaccctatgtatgtagtgaatgtgggaaagccttctctcagagttcatccctaaccgtacatatgcgaaatcatacagctgagaaaccctatgaatgtaaggaatgtggaaaagccttcagcaggaaagaaaatctcattacacatcagaaaattcacactggagagaaaccttatgaatgcagtgaatgtgggaaagcttttattcagatgtcaaacctcattcgacaccagagaattcatacgggtgagaaaccctatgcatgtacagtatgtggaaaagcctttagtcagaaatcaaacctcactgaacatgagaaaattcatactggagagaaaccttatcattgtaatcaatgtgggaaagctttcagtcagagacaaaatcttcttgagcatgaaaaaattcatactggagagaaaccattcaaatgtaatgaatgtggtaaagccttctctcgaatctcatccctcactcttcatgtgagaagtcacacaggggagaaaccctatgaatgtaataaatgtgggaaagccttttctcagtgctcattacttattatacatatgagaagtcatactggtgagaaaccctttgaatgtaatgaatgtgggaaagcattctctcaaagagcatccctttctatacataagagaggtcatacaggtgagagacaccaagtatattaaatgaaagaaggcctcttaaattcaacccatgttttacttaaaatatcttggcataagctcaaaaaagccaggatctttatggaaaaattttaatactttgttaaaaggtgtaagactggaataaatggaaagaaataccatatacatagatggaaaaacccagtattataaaaacctcaattctgaaaatctatagactgaatgcagttccaaacaaaatcaactaagaattttctaggatctttcaaaaatgattataaaattcatgtgaaatagaagtgtatgaattgctgcgacaattttgaaaagaatagaggaaacaccctcactgtatgatataaagttatagtcatttaaaaatgtgtgatattagtacattagtaggtaaatgagcagattttaaagaatagaatatccagaagcagattcatgaatatatgtgaactcagtgtatgttagacctgacatcatgaattagtagggaaatgatgacctagtcaataaaattgctgggaatatttgactctccgtattggagaaaataaaattacaacattacgacatactaaaaaatcaatattcttttttttttttttttttttttgagacaagcgtctcactctgtcgcccaggctggagtacggtggtgcaatctcagctcactgcagcctctgctttccgggtttttttgttttgttttgttttgttttttgtatttttagtagagacggggtttcaccatgttggccagggtagtcttgaactcctgacttcaaaagtgatcgccctctttggcctcccaaagtgctggggtttacaggcttgagccactgcacctggccaaaaaattaacattctaaaggatttaaatactggaatttgaaaagccaaactgtgaaaccattgggagaaaatagatgatattgtctatgacgttgaggccaaggagctttttttttttttttttcaagacaaaaggactctgtaattccacttctaggtatatatacatcctatagaaactcacaaataatgcataagaaatatatatataatatatgtatgtatgtatagccagatgcagtggcacatgcctgtaatcccagctacttgggaggctgatagaagaagataacttgaggtcaggagttcaagaccagcctgggaaacatagcaagaccccatctcttaaaaaaaaagaaatatatagacatatatctgcattgaaaacaacctaaatattcatcagtggggtaatggatgaataaaatatgatatattcaaatgatagaatagtatacagcacttaaaagcagtgaaccagatccatattgtgtaacatggatagttaaaacaatgttgaatgaaaaaaatcaaaatacaaatgaaacattgtgtaataatatttatgtaaattggaatgaaatcatttataaagaacaactgtttctattattgaaaattgtatgtaaaactatttaaaatagaatagaaggatacacacccaattattgatagcattgtctctggagattgaatttgaggctgttgattaaaaggagactttagctttgcttgtagtttttataccttaaaaagactggtagcatataaaataaatcttaaaagctaattatacacaatgacaatatgaatgtttacttgtaatagtgtttttcttgttctttctcacaacaggccaagggaagcctgtgcccatagaaggaaatgttataatggattcatatgccctatcagatgctcaactattttatgaaaaatctctctagaaaattagtaattagaatattcttgtttattatataatgtgaaattagcacattttagcaacttgatgatgctgtgtttttatattttaacatttctgaaattggactcctttcaactgatgatatcttagattcaagtaaatatttaattattaaaaatttgaaaatcagatgccagtataacaaatgaaatgtgtttttatttactagctccgggcatcatgtctactactcacggtgcctgtcctttcagtggagccagtattattagacagcaaatttattaggttcatagctaactaattaccaatatatttagagtattgtggagagattaagatttttcctgggaaagtgactttgcaatatttgttttcttgccctgtaattttccatacaaccagcataggcattaatatcattgttaattataacaatattttgaaatgagaaatcatttatttcctgaggtggccataagcaattgtgtaaaagtgtgttggttttaatctagagaccattttattctttttacaactcttgacttacacagcccatccggttttggttggaaatggtggtgaacttagaccctgagcactaatagtagagttcctcttgaagagtctcattctctgtaataatacatgaaccaacccttacagaggtgatgtttttattatgccatctctacaatattagttgatatacattacagaaagctgctaatgcctttttaaaaaggagatagggccagacgcagtagctcaagcctgtaaacccagcgctttgggaggccgaggcgggtggatcacctgaggtcaggaattcaagaccagtctggtcaacaggatgaaaccccgtctctactaaaaatacaaaaattagccaggcatggggcgggtgcctgtaatcccaactactcagaaggctgaggcaggagaattgcttgaatgcgggaggcagaggttgcagtgagccaagattgtgccactgcactccagtctgcgtgacagagtaagaccctttctcaaaaaaataaaaaataaataaaaaggagataggctgggtgtggtggctcacgcctgtaatcccagcactttgggaggcctaggcgggccgattacttgaggtcaggagttcgagaccagcctggccaatatggtgaaagcccacctctactaaaaatacaaaaattagctgggcgtggtggtgcatgcctgtaatcctagctactcaggaggctgaggcaggagaattgcttgaacctagaggggcggaggttgcagtgagccaagatcacgccagtgcacttcagcctgggcgacacagcaagactctgcctcaaaaaaataaaaacaatacaaaggagataaaaatagggggtgtttgtgaaaagggatctttagcttttatgattgaacattaactacatttgtttgaagttgatttcacaaaagtaaatctcagactaaagatgtgaagtacaaccatgactatcagttttgattgttattaggtatttttgaagactgatggtgacttaacaacagcagggactgacttcagtgaaaacaatgacaacttacccaaactgaaatatctaaatgagtattatcatttcgtagtcccttcttcaataagttttatactaaatccagttttgctagcatacccaatatttatgtgtaaactttttttttttttttgagacaaagtcttgctctgtcacccaggctgcagagcaatggcgtgatcttggctcactgcaacctctgcctccgggttcaagtgattctcctgccttagcctcccaagcagctgggaccacaggtgcgtgccaccatgcctggctaattttttttttttttgtatttttaatggagctggggtttcaccatgttggccaggctggtctcgaatcctgacctcaggtgatccacccaccttggcctcccaaagtgctgggattacaggtgtgagccactgtaccagcctgtaaacctttttctttttttggagagggggtctccctctgttgcccaggctggaatgcagcagcatgatctcggttcactgcaacctgcgcctcctgggttcaagtgattctcctgcctcagcctcctgagtagctggggctacaagctcccgccaccatgcccggctaatttttgtattttcatagagacagggtttcactacgtaggtcaagctggtctgtgagccaccatgcccagcctgtaaacctttttttaaaaaatggttttcgcatttcgtgtatccacacaagtaaccctgtataaatatttgtgagactttttttttttgtctaaacagttgtttttatctgtgattttctttttaatgttttttgtttgtttgtttgtttgtttttggcctgtactttatatgccttaaatcctctgcccctttctttacatagctttagagtcaacagagaaatgtaaaattccacttaaggcccataaggacaaccttagatttctcttttggcctctctcaccccagtaagactggctgaacctatcaggtgaggtaaagtgcctcagagtaggtctaaaagggcgttttactgatcttgtgtcagcaagcagatgatctggtctctgtaaattcattttttccttctgtcctaaggggtagaaataataagatagatataagtgactgagacagactttgaaaaaaatcattaattaaatcatggtgaattcttcttttcctggacacacatgagttactgcctagagagtttccattctagagttcaaacttcataagaggttcagttcctgtgaatggcctcaaaacacacagaataaaacatactaatagtggcttggactagacacagcagtagaaattgatagatttcagatacattttggaggtgattcaacataatgagttcatatgaaagatgaggagtaaagagataaaggataactcctatgtttttatggaaagaaactggctggccggtggaccatttgataaaaatgcagcaggctggggagaaatattttagagtaaaggttggggatggactcaagatgtgtgatggactttcttttcagctgtttcccagaagcaggctttgagatgaggattcctatgcaagtgatttattaaggaagtgctttcagtaagaggggtaagagaatggaggaagcagaataagaaaaagaagtaagtcaagggtgtgatcgcaggcacagtcctgccatggatggtgtcatcctgatccctgtgggaactcgagtgtaagctatgcctcagacttttcaagattccaccttcaggactgaggcacttgtgctgccaacttctgagaatcttggctgctgacaactcacagctaaattcctctaaggaattgctgttggacgaaaggagctgccttatgcaaggttacactgtctcccttcaggcagcttggcccacgttgcctcagtttagagcaactctgaagagcaatcccagctctagagctccccagggaacaaatttcaactgcatcagtttaatttctctttccatccagttctgctttattcatttccttactgctgatgttcccaagagatctccccaataaaccctatcatagatttccatctcagattctcttttcctgggaaactgacttaaaacagtagacattttgcaacagtagtcctcaaattgaaatttaaaaaaaacttttttttttttttgagacagggtgtcactctgctgcccaggctggagtatgtgatgcaatcttggctcactgaaacctctgcctcccaggctcaagcgattctcatgcctcagccttctgagtagctgggattacaggtgtgcaccaccatgctcagctaattttttgtatttttggtagagatggggtttcactatgttggctaggctggtcttgaactcctggcctcaagtgatctgcccaccttggtctcccaaattgctgaaattacaggtgttagccacagcacccaaccaaaaaatatttttgattcatttgaaactaataaactcattacatgttaatacaagcaataaatttttatgaaattattttatgaaaaagaattatttccaaaaccaaaaaacataataagagcgtcattgttacacaactttcaaatactttaaattacttaaaagtagacagctgggttctcatatctgcttctacattcagtcacatgtcatgtaagactgggaaactccattcttactcatgagcaaatgagatcaaaagaaggaaaaatatgaaaatagtttcaatctcaaggccccctagggatttccagactgttctttttttttttttttttttttttttttttttaaatggagtcctgctctgtcgcccaggctggagtgcagtggcgcgatctcggctcactgcaatctctgcctcccgggttaagcgattctccctgcctcagcctcccaagtagctgggattacaggcgcctgccaccatggctggctaacttttgtatttttagtaaagatgaggtttggccatgttggccaggctggtcttgaactcctgacctcaggtgatccgcctcagcctcccagagtgctgggattacaggcataagcccacacgcctggctcaaactgttctttaactgctgttgtgacatttggtgtggtttcttcaaaaacttgatgtcatgggctaaagaggtgtataaacaggaggctaaagggaagcatgggcaagctctctagaagtggtctcagatggaggacttgagaaacaaagaagatggataaggaaaatgttaaatatgtgggtaaatagaaacaaatattggcaggtggaaaagaagagcaagattgatttacagggttttcaaaggccatgaaagtactgggaaacaatggtatataattcagtggattggagtgggtttgatttaaagtatttcaagtctctttactattaaatataaagctaatttttaagattcagattttgaaggattgtaagagacccaaaagattgccttattgagttgaggaagttccctttattcctaagtttgctgactgtttttattgtgattgggtgttggatttttgtcaagtgatttttctgcatctattgacatgattatatgatttttcttctttagcctcttgatgttatgaatgagattaatagattttcaaaggttgaatcaatcttgcatttctgggataaatcccacttgattgtggtgtataattctttttatatattattggatttgatttgctaatattttattgagtatttttgcatctgtattcatgagagatattgttctgtagttttcttttcttgtaatatgtttctcctggttttggtattaggataatgctggcctcatagactgagttagggaatatttcctttttctagaagagagggtagagaattgataaactttcttatatgtttgggagcattaatcagtaaacccatctgggcctgatgctttctattttggaaggttaatagttattgattccatttatttaatagatacaggcctgtttggattgtctgtttattcttggtgagttttgacagattgtgtctttcaaggaattagtctgtttcatgtagattatcaaatttgtgggcataatatgctttatacgcttttattcttgttcataatattctttctttttttcttttttctttttctttcttttttttttttttttttttttgagacagggtctctctttcgcccaggctggagtactgtggcacaatcttggctcactgcaacctccacctcccgggttcaagcaattctcttgcctcagcctcccaagtagctgggattacaggcgtgcaccaccaagcccagctaatttttttgtattgttagtagagacagggtttcgccatgttggccagactggtctcaaactcctgacctcaagtgatcgaacctcctcggcctcccaaagtgctgagattacaggcgtgagccaccacgcccagccaggtggagtctttagattttcctagatataggattatatcatcaacaaaaaggcacaatttgacttcctcttttccaatttggataccttttatttctttctcttgcctgattggtctggctaggatttccattactatgttgaataggagtggtgaaagtcggcattgttccaattcttagtggaaatgctttcagattttccctattcactatggtgttagctgtgggtttgttatatataacctttattattctgaggtatgtaccttctgtgcctagcttgttgaagtttttattgtgaaagcatgttgaattttatcagatgctttttctgcatctattgagatgattatatggtttttgtcctttattctgatgtgatgtatcatgttaactgatttgcatacattgacccatctttgcatccctggtgcaaatctcacttgattgtggtgtattatcattttgctgtgctattggatttggtttgttagtgcttttttgaggatttttgcatctacctttgtcagatatcagcctttagttttctttttatgttgtgtccttctctggttttggtaataggatgatcctggccttgtagaatgaactggggagaattctctcctcttttattttttgaaatagtttcaggagaattggtattagtttttctttgtatggtataatttggctgtgattccaagtgaccctgggcttttcttggttgggacactttttattactgatttaatctcactacttagtggtctgttcagattttatatttcctcgtcattcagtcttggtaagttttatgttttcaggaatatatctgttttccctaggttttctagtttgtcagtatatagctgctcgtaagtctctgacactctcttgtatttctgtagtatcagttgtaatgtctccttcttcatttccaattttgcttatttgggtattctctcttcttggttagtctagctagtggtttatcaatttgggttatctttttgaataaccaacttttcattttgtggatccttcatattgttttagtctccatttcatttaattctgctctgatctttattatttcttttattttgctaatttgtggtttggctttttcttgttttctagttctttgaggtacattgttagagtgttaatttgtaattgttctacttttttttttttttttttttttgagacagagtctcctcgctctgttgcccaggctagagtgcaatggtgtaatcttggctcactgtaacctctgcctcccgggttcaagtggttctccagcctcagcctcccgagtacctgggattacaggtgctcaccaccatgcccagctaatgtttgtatttttagtagaaatcgggtttcaccatgttggccaggctggtctcgaactcctgacctcaggtgatccacccgcctcggcctcccaaagtgttgggattacaggtacgagccactgtgcccagctaacttttttgattgcattctacatttattgctataagcttccctcttaacactacttttgccttatttcacaggtttgggaatgttgtgttttcattttcggttgtttcaagaaactttcctttggcctggcatggtggctcaccatgtaaaaatacaaaaattagctggggtggtggcacttgcctgtaatcccagctactcgggaggctgaggcaggagaatcacttgaatctgggaggcagaggttgcagtaagccgagatcatgccattgcactccagcctgggcaacaagagtgaaactccatctcaaaaaaaaaaaaaatttttttttctttcaattttcattttaattatgatctttagtggttatttgggaatatgatatttaatttccatttattggtatagtttccaaagttcctcttggtgttaatctctagttttattccgttgtggtctaagatacttgataagatttcagcttttaaaaatttgttgagacttgttttgaggcctactcgatggcctattatggagaatgttccatgtactgatgaaaataatgtatagtctgcatctgttgggtgaaaggttctgtgaatatctgttaggtgtgtttggtctaaagtccagtttaaatctaattttttaaaactctgattttttaaaactgtctaatgctgagaatgggatgttgaagtccctcattattattgtaatgcagtctctctctttagatctagtaatatttgctttatgaatctgggtacttcagtgttggctgcatatatatttagaattgttatatccactgctggtttaatcactttatggttatataatgaccttctttgtctttttttttttttttaactctttttgacttaaaaactctttaatctattagaaatatagctactcctgctcacttttggtttccattttcatggaatatctttttccatccttttactttcagtctatatgtgtcattaccagtaaggtgagttttttataagtaggatatttggggatctttttaaaaaaaaaatccattcagccattctctattttttaagtgggaaatttaatccatttatattcaaagttattattattattatgagatggagtctcactctgttgcccaggctggagtgcaatggcgggttcttggctcactgcaacctctgcctcctcagttcaagctattctgcatcagcctcctgagtagttaggattacaggcatgcgctggcacgcctggctatttttatacttttagtagagatagggttgtgccatattggccaggctggtctcaaactcctgacctcaggtgatcctcccacctcagccttccaaagtgctgggattacaggcgtgagccactgacctggctaaaggttattattcacatacgaagctttgtctctatcatattgttaattggttagggtgtttttttttttttttgagacttctgggctcaagcagtcctcccacctgagccccacaagtagctccccatgcaccaccatgcctgggtaatgttttttttatttttatagagatggagtttcactgtgttgcccaggctagtcttgaactcctgggctctaatgatcttcccctctctggctccaaagtgctgggattacagatttaaaccaccatgcccaggcttttttgttgttttatgttttttttttttttaatttgttttcttattgtcactgtggcttggtagatttctgtagtagtaccatgtgagtcctttctctttcttctttatgtgtttgctttaccagtgagttttatagtttaccttattttcatgatggtaagtgttgcagtgtttttttttttttttttttttttgcttccaggtttaagacccccttgagcttttctttctttttttttttttttcgtttctgaggcacagtttcactctgccacccaggctggaatgtagtggtgtaatcttggatcactgcaacctccacctctcaggttcaagtgattcccgtgcctcagcctcccaagtagctgggattagaggcatgctccaccacacgtggctaatttttgtatttttagtagagacggtcttttaccatgttggccaggctattctcaaactcctgacctcaagtgatccacccgcttcgacctcccatagtgctgagataacaggtgtgagccaccacacccagccttcagcttttcttgtaaggccagtctagtggtaacaaatttccttagcatttgcttgtctagaaaggtctatttctcctttgtttatgaaggataattttgct

SEQ ID NO: 1210 - DNA, 85281 bp, Homo sapiens
cagtaagccaaaaggggtgtctcaaagagtttccatatgtataatattcattcctgcaacgaagacagccacatcaggttattttaagaaagaaaagaatgtagttaatcatgaagtgtccatttgatcaggtttcctaataagattttggtcatggaccctatattactttctactttaatagacaaatacaaagttagacaatagctattggtatcaagataggtagatgacttctagccatatttattcagtcagcatcccaactctgttaatagagtcagcctgtgctttctgaacaattatacatgccgacacaaaccaatccaatagatgccgaaaagatgttgcatcccacctgaatgcagatgaggtctgtagtccaaggaagccccagttgtctgggtccacagaggacagtcactgttgcatccttgggtgcagaactcttggcccaagatctgagtatgctgagcttcttagaagccatggctgctggaggccaggatctcattaacagttcctaccaacagtcttaaaaggcaggactctgtggactccagcccagggggatgctttgattctgcatgtttattgacagaagccaggtatctctgctgacacccactctggcttcctcagatctcttagccagtatccaccagcccatgggaaacagctccgtttctaggctctgcaaacctgcgtggggtgatgaaaactcaaggatttctcaaagctggctgagtgtatggctccctcccgctcatctcctgtgaagattataacagggaaggaaatgaggagaaaagcaggccgagcaaatttctaagccagctgaaaaatgtggccagtggctagtgaaaagagaatgctttagaataagggggatttattcatggacacctgtcagggactgtcattcctctagctgaactatagtctgaattttactatgaaataaatcagtccctcctggacttaataactcttctttataggtttcttccctcttataaataaacctcattccatatgtatatattgcaaaaggcccacttgatttgcagctctgcacatcaggacaggtacgttccagccccatactataaaggggcttttctgtgatcatctctttcagatagcacgttcccttccctggggcactgtgaacctcaaagaagaaggtttcttttaaaaatctcctctgccaggcgtggtggctcacgcctgtaatcccaacattatgggaggccaaggcaggtgggtcacctgaggtcaggagttccagaccagtctggccaacatggtgaaaccctgtctctcccaaaaagtacaaaaattagccaggcatggcggcaaatgtatgtaatcccagctacttgggaggctgaggcagggagaattgctggaacccaagaggcggaggttgcaatcagctgagatctcgccactgcactccagcctgggcaatagagcaagactctgtctcaaaaatacaatacaatacaatataataaaatgtcctcaatggggacataagataagtctgtctgccaaaggtaaagaagatgagatagagaaatggaaaagtggcatttccttcccaagagccaggagtgactttcatgatgggtccaagtgcagccaagctggaggctaagatgcaaggggtttacgcctctccttgctgtgggaatactgggcctgggctccatgcatctggccaattttgcagcagatttatgaagctgcagattccgaggaaatgggccagctaaccacagccagagcctagggctgctctggagtgctgctgccagtttggagagtcaaactaggagagtcgcttacctgttatactctcaggctctccacatgaggcaggagaataggttctggaggcaggaaacctatggctgaatcacactgacttcttagaactaaatcataaggaaaaccccaactttccacacctaagtaacaaaaggaccagaggctattccctttgcaaatcgcccccaccttttctgcatggcagatggaaaattcaaagtacctctaattggttgccttctgcaaccaatcagactgattggggccaagtcttcatttgcatagaagtgtaactttgtaacttcactttagcctcttattggttgctctccacaaccaatcaaactgactgcagtctactacttcatttgcatgaagcgtacaccaagtggccactgggaaacctttagagggtattcaaaccagaacattctgtaaccaggctcttgaccccctatgctcaggcctgctcccaccctgtggagtgtactttcattttcaataaatctctgcttttgttgcttcattctttgttttgtttgtgcattctgtccagttctttgttcaagatgccaagaacctggacaccctccactggtaacacacagagcagtgacccttaaccttctgacttgtaacaccccatcttggttggatttggggtcatcagctcccattctcctctatgtaacaagatagcaaaatccatatgcattacaatattctcagggctttgtactttctcagaaaggcctccataaatattcaaattctaattttaaaaacatagttggaaaggacgttagcaaccatcttgtccaatatcctacccaaggaagtaaacacctccacatcaaccctcgcagatgggcactgcagccttcctatttctcctagaatgagaattataaagagattcagctgttatttcaactgtgattcttaaacttgaaaatgaattacaactaactttgtttaaacaatattttgaaattttattgttattaagatctgtgagcacttcatgagaatttatactttctggagaaaacttatcaataaaacatttaatgatatgagtcacgtgccttgaaatatgccaagtattataatgataaaaaaaattacaagtggaaaatgtaagacaaatcctgtaacctcttaagataagaacgctgaaagtcaaaatctgtgttcacaaaacaaaacaaaacaaaaccccggaaaatgacaagtgttggcaaggatgtggcaaaattggaaaacttgcacattgaatataaaatggttcagcctctgaggaaaagtttggcagttcctcaagaagctcaaaatagaattaccatatggttcaacaattccacacctcgaatataccgccaaggaattgaaaacagggactagacaaatccatctacatacaccttcatagcaccaccatttgaaatagcaaaaaggtggaaacagcccaaatgtccgtcaacagatgaataaacaaactgtggtatatacatagcatgaagtattttcagccataaagagaatgaagtactaatacatgcaaaactgtggatggacttcaaaagtattatgctaagtgaatgaagccagacacaaaacagtatgtattgcataaatccatttgtataaaatatctagaattgccaaatccatagaaccagaaagcagattggtgactgccaggggttggggtgaggggaaaatagagagcgattgcttcatggggcatagcttcctttgggggcaataaaaatgtttttgagctaaatacacatgatgatcagacactgtggatgtacaaaacaccacttgattgttctttttaaaatacttgatgttatgttttatgaacttcatctcagtgaaacttttttaaaaaatgatctatgttcgtctgggtgtggtggctcacatctgtaatcccagcactttcagaggccaaggctggtggatcacctgaggtcaggcattcgagaccagcctgaccaacatggtgaaaccccatctctactaaaaatacaaaattagctgggtgtgatggcacatgcctgtaatcccagctactcaggaggccgaggcaagataatcactggaacctgggaggcagaggttgcagtgagccaagatttcgccacagcactccagtctggacaacaagagtgaaactccatctcaaaaaaaaaaaaaaaaaaaaaaaaaaaaatctatattcaagtctcacctttgagactgatctcccatgtgttttgagcaagtttctgcacttctctgggcctcactttttccatctaaatggaacccaagtagaactgctttaccagtggccagtctcagcacagtctcagccatgaccacaataaccacgagactgatgtcccagaaaacaattagaaaaaaaaacaaaaaacaaaaccttcagtatttttgggttaaaacaatcacttgaaactacatctaactttttctgtctcctattctacaacaaacatttttaaagaggaatattcttgtcttagtccatttgtgttgctataaaagaacacctgaggctgagtaatgtataaaggatagaggtttatttggctcacggttctgcaggctgtacaagaagaatgcaccagcatctgcttctggtgagggcctctggttgtttccgctcatggagaaggggaagaggacttggtatgtgcagtgcagagatcacatggtgagacaggaagcaagaggaagtgacagcacaggtgtcaggctctttttgacaaccagatttcacgggaaccaatagatcaagaattcactcattactgtggaaatagtcattcttgagggatattcccccatgaccccaacaactcccattgagcccactgccaaaatgggggatcaaatttcaatgtgaggttttagggggacaaatatcgaaactatagcaatccacttcccccacactcaaaatcattagcagatgctaaacaagggaaacatacataaatggttcaccatccatttttgtaaataaggctttattggaacacagccatactgattggttgatgtattctctgccactgctttaaggctataatggcagagttgagtagttgcagctatggtacacaaggcctaaaatatttgaatacctagccatctacataaatcattcatcaatccttgatataaaataacctagtaagaaattgtcagtaaaatgagaattcatggataagatgataaaacagcaaaatgacataaaaagtgagactgaaattctaaaaggggaaaaaaaactaggaaccaaaacatcatttgttaccaataaaagtggaaaagcaaggaacacaatagacacctctggaaaccaaattactgccatagaaaagtagcctagataatcattgtcaatgtagatgaccaaaaaattaaattaaattaaattttaaaaagagagacagagagattaaataggcaaacaccacttaagaaaaaacaactctcacctcttaatgtgttttaatctccctttttaaatagaaagtaatcttttaagaaaagctctcccctgtggtgacaatacaattatttgaagatcagagattcttagtttaatatgagttttctcccttctgttaaattataataaaattatgttaaatttaaaataggggccttttatgtaactgtttccctaaaagtgcagcctagcctaccccttctatctttatatttgtacagaaagacattcaaaatgatgttcacctagttaaaatcatgattgctattggatggtgtgatttgagggtgatttttagtcgtctctgtgttttcctatattgtttaaaacttaaatcattcacttattttcttttttaaaagaagataatttttcttaaaaacaaagactaagatgttattttttggatggcgccatatggatggtggctaccatcttcctctgtataatttaaatttctcctaaacaatgctttgaatatttttattgatttgttttttggaactgcccacagtatctagcataagcaaggcacataatccatgttcattaaaaatttcattgattttttttttctaaaatgtcccagggattgttcgctgttctcaatgacagtaagagtttaaaatattgttgacacaaagttacttgtaatttattttgtactttattaattacagtagaaatacaattgaatctctttgtaatattaatagcaataaaagaaaaaacagtttaaatagttttaaaatgccccaaagctttgcatgtcatgacaaaccacaaaagccaagtcatcgccacccatttttcacctttgttctcattgaaggagagcagctattctaaaacttgtcccccagattctcaaaacctctgatccactgtagctctggcagtcccgccttctcccaccccattctccggcttttctcaagctattattcttctaactctttcctgagcagcactttgccttttctaaagaagaggttatgaactttctagagcttgtcattcttctaccaattacctagatccacacaacaaaggaaagaggagaaaataaaggctggggatctccaagtgttcttccagcttgacagtttagtgatggctgtgctctcccatgaaggagagggcaattgattaaaatcattaagaaacaggaggtacagaattcagtgttcaaatgggcacgctctttatttagcgcaggaggtgaatttacccagtgggctggattaattggggaaggtggcctggagaagctggggattatgctgaatccaaaagaaggtaaaatttacttataatgaggagagaaaggaagaagagacttccctgtgagagaaataccatcagcaaagtgcagaggtagacatggtttgccagactctcaatccaggggtagaaaccacatccctgtgagggagaaaagaaaaggtgtgttgaaccaggttaatcaagagaagctcatcaactagtatacatggtcttaggtggtagcatgaccttagtaaatatgcagaaacatgtactaattatagggtcctgcctccatttggcagtgggggaatcatcctttccttgtctcctccagtcttagggttctacccatcttctgactgctgtatcagtccctggcctcctgttatttacccaacgagaatacaaagatgcgagagtggaagccaagaggtgggggcggatcacctgaggtcaagagttcgagaccaccctggccaacacggtaaaactccgtgtctctactaaaaatacaaaaattagctgggcatggtggcaggcgcctgtagtcccagctactcgggaggctgaggcaggagaatcacttgagcctgggaggcagaagttgcagtgagccgagatcgagccactgcactccagcctgggtgacagagtgagactctgtcaaaaaaaaaaaaaaaaaaaaaggaagaagaaaagaaagggaagggaagggaagggagaaagaaagagacagagaaagagaaagagagagagaaagagaaagagaaaaagagagagaaagagagaagagagagagaagagagcgagagaaagagacagagaaagagagagagaaagagaaaaagagagagagagaaaaaagaaagagagagaaagacagacagaaaagagacagacagatgctggagtagagagggcaacatgtgcttgtctgtctacgaaatgaaacactttggagtagaaaggaaaaaccatgtaggaaaaggagaagaaagaagaaggaagaaatcagctctcccctttcccccaaccttttcctggcagcttggagcttctaatggtcgacggaaggctccatcatcaccaaacagtgcagcgtacagacacagccacctattctgaagccactggctctctagggctccaggcttgcctctccaaatgcctgatttggagcttcccttgaacgtctcataggattttgcgtcaagctcagcgtggccaaaacagagtccatcttcccactcaccacctgcttctgctcttgggtacgttttcttatcatcctcctctggtctttccagctggtcccctccttctccttcacatcccgtacatccaggcagctgcctggttatggcagcaccacctccagagcatctcttcatgctattccccctttttattcccattgtcacggtccatgcctgccccttgtggcctccctggcaaaagtcttctaactgttctccctgccttcattctcttccctgcctccttcaccactcccttgatgctgtggctgaggttgcctttctagtgccacaggcctgttgatatcctgtctcaggtttcaaaacacagatgaaggggccaggcatggtggcttacgtctataatcccagcattctgggaggccaaggtgggtggatcacttgaggtcaggagttcaagaccagcctggcaaacatggtgaagccccatctctactaaaaatacagaaattagccaggtatggtggtgcgtgcctgtaatccagctactcaggaggctgagaaaggagaatcacttgaacccaggagttggaggctgcagtgagccaagattgtgacactgcactccaatctgggtgacagagggagactccatctcaaaaaaacaaacaaaaaatatagatggaaccccactgcctgtagcaaagtgtttagaccccttagtctgctccatcaagccctctgaattctcactctatccacatgtttggccccacctctcactccttctcctcactttccctatttaataactaacacatcacttcatctacttccttagcctttatgatggtgttcctttagccagtatgcccattctattactcttctgtatcacttcctaagatatttgtttttccttccaggctcagttcaaacatttcgtccttctcctcgaaaccctgctggggtgtgcctagaacacagtaaaccacaacgcatttcggtgaagggatgaatgattcaatcaatcaatgaataaagcaattaataaaagatggatttcttgtctggtctttgaggtattcacttacattccaagccatttcttcttgcctgggctgagcttccccagagcctgcctgttctgatcgatctgcaacatcttctaaagtatgaatgatgcaccaagttaaatataggatttgactagtttttcttgcaggcactttggctcagggcatgtaagatcaactacaggttgggctacagcatggtgctctgagccctcagtttgaaattccagggattgggaaacactagcaagttcaaagccagaccaaacctgaatgtaatatttagaaggctgctccgagactatactcctggaccaaaatgcttaatacacacgtcagcatccttggctttccagagtgggtaggtgctgggagacaggctccagaaaaaaaaactaagctctgtggattccacgactttatgttcaccccacctaacccgacctacaggcctgggggacttcaggggctctgaccttcgtcctcctgccccaaatttccacactgacagctccatttcttcataggaatacatgctatcaagtagcacgtgccccaaagtgacaattatgtcatgactgcctgactctgaaggagctcttcaccctggttgggggagaacccaccacctctaggaaaaggaatagaagaaacatgtttgagttgaggcgtggaaaatataagcagaatacagaggactcctctatagacaccctgtgagtgacctaggctgatgcagagcaggcccgaggaagggaaagaggagagaggaacaaagaagcgaaggaaaggagactgacacagacaccgacagtgtctcatgtttataaaaaggtttcacggcttggaaagtaatttcaaatgtattatgtcttttgatcccaacaccaccacggtgggttacagcaagcagctataattttttttttttttttttcatttcataggtggggaaactgaggcttcgtggggcctgactcacttagagtcaaagagctagtcagaggctaatcctggatttcaaacctgtcttctgacctccagctgggcgatcttagtaccacaccaccatgcctctgaacgtggctcttcagaagcaagcctctctgtaagtctggcaaatatcctacaaacctagcatacaactggctttttacaatgggtacaaagtatgggaatgtaagggagccccgcccaggtagctgaggacctcgggactgactttctggttcactctctggcctctcaattgctaagatctcaaacatgctcaaggtatgattaatttcactaatccttgtggacttctgtcatccaggtaaaaaataacaataataattgtcctccggtgtctatatgccagcaagcactgcaggccaaaatcaaccctgggtgattatgaaagtggctctggtgaactcctgcctgtgcctcctgcagccacgtggaactattcaaaatgataatctggcatgtggtagtaactcagactggatgggtccatcactcacagagcagtgggcacagcctccagagttcttatgtcttttgccagggccagcatttctactccaagctctcattcatcctctgcacaatttatttctgcagagtgcccttcatacacatcagcactgcttactttaccctgagagtcaatcaccaggtgccaagagaaagggaaggttcctttggggagatttaaagggaggcttagactcaaggtgactggggcgagagaagaagaaaagagggatggccctggtgcaagagaagaccctgactggaccctgagatgagacccgggaggccgtggactgtggaaggaggatgaagttgggcctggggaagagagatcagagaactgaactattccagcccctccccactgcaccaaacagctgtttgcccttggcactgagtttctagaggctttaattcaagttctgtcacccaggagtgggaactacttaataccactcctaggaattctgaatagaaggaatcctgggaagattgttaataattacaataaaaaatgacaggccagtcgtggtgactcatgcctctaatcccagctggaggctgaggagggtggattacctgaggtcaggagttcgagaccagcctggccaacatggtgaaatcccatctctactaaaatagaaaaattagccagacatggtgatgggtgcctgtaagcccagctactccagaggctgaggcaggacagtaagaattgcttgaacctgggaggcggaagttgcagtgagctgagactgtgccactgtattccagcctgggagagagagcgagacgctgtctaaaaaaaaaaaaaaaaaaaaaagacaaatgttgggattggagagactcaactaatactatctctttctttcacctgaattcagaactgagaaagaggctcatgaattggacagatgaagacatgtgaaaacaatgtcgttgttaccagtaaaggtgaggatagagactgtatcataaacaggtttgtctaggtggcttaatttcactctatccttgttattgcttgtccacccatcctcagacccctctgaaattcaagcctgcctctagaaaacacactaagagaaggagagaaaggagctgaagcagctgcaggtaggctggctcgagaaaggtgagaggagggagcgcatccacacaagctctactccttctctcaaacatgcccatctgagaagtcatgaaggcccaagagctccctttgtggaagcttccccacctggaagaggacaaatggagaataagtgtcctgtgccccaacacctgacatctgtgtagtcctttacagattacaaaacaccgccgtgcatttgcaaaaggagtctttgaagtaaccgtctaagtgactcaaattatgattttcatgcccactctaagcaaaatatggggtcagaggacccccatccatggcagagctggaaatcaaaccagatttcaagcaagtatttgaaatcaggtttaaaaaaatatacccaacaggtgaggtgagacactcttgcagccatagccattaatgactccaggagaggtgaatgggcagatggactgaggagtgcagcagaggaagttcagggacacttctcagtctaacaagcacttactgagcacctactgcatactgcatgctgtgttgcatactggggatagaaccgtgaacagacatgacccctgccttgtaaagctggggcaaaatgggaagtgtctagcaatcaagaggctctttagagagggaagcagccgcagaggtgatgtatgtgcacccctgggacgtgcagggatatttctggactcacatcccaagaggtgattcaagatgcagaatcagccccaactcagattggccttgggtgctcattaaacagcagtagccaggccaggcacagtggctcacaactgtaatcccagcactctgggaggccgaggcgggtggataacctgaggtcacgagctcaagaccaggctgcccaacatggtgaaaccctgtctctgctaaaaatacaaaaaaattagccagtcgtggtggcagttacctctaatcccagcaacttaggaggctgaagcaggagaatcgcttgaacccgggaggcagaggctgcagtgagtcaagatcacatcactgcactccagcctgggtaagaaaagtgaaagtcagtctgaaaaaaaaaaaaagtggtagccaccatagcctgactataaaaaggtaaagctccctgctctgttattacatcatttctttgtgtttgcatttttattttctgcctttgacttgttttgtttttctctgggtcctctaacaaaattctttctccaaaacctcaaactcttgtgagatgaaccaaaataaggagaacttgcgaatgcccagacagggaatgagaagtgaaccatggtgctgaccagagccaaatgctacaggtgccaggaaggaccagaaagggtcaagaaaacaaagtgataaaaacgcacagcggggagatctagacagctccgtgttttgaatctccttagtttggtttgaaaacccatccaaacccaaaacaccggaaaacatattcttctttattaggtagcccatgtcttccattttcaggtttgctgagaaggaaacagtatccaaaggctgggaactgtcctcttatgttcacactataaagtcgtctccactagcatctaccattcccatgccattttaaggatctgctctccaatgatagagcctcaaccctcagtcatgtttttctaggatatatgcagtttccccatagagcaggaaagagcctaagtggatgacgttcttctagtagagcttcatagcccttttattacatacggctttcttcatctgtcctatggataaaaggccagccagagagggcagggcaacattcaacccacactcaataaagaggattatttgtaacaagcatttaatgtcttttcaaagcttaataatcagtgaccttttcaagatttctcaatttgctggaatctacctcagtcttgataatgatcatctgtggcttctgttatcctggaatctcacatctggctgggcttgttcccccacaggaggtttaatttatgtgcaataaatgcatccaatctaagagtatagataaatgaatgttttacagcatcagtttattatttaaatatcatgtggagtgaatcaagcaatgattttgctgagtggagtatctctctagatgcttattataataagcctcctggtcttcgctatcaattaatcaaaacctatcaattggccacatgcggtggctcacacttataatctcagcactttgagaggccgaggcaggcatatcacttgaggtcaggagttcaagaccagcctggccaacgtggagaaatcccatctctactaaaaataaaaaatgagccaggcttagtggcaggcacctataatcccagctacttaggaggctgaggcacgagaaccacttgaacccaggaggcagatgttgcagtgagctgagattgcaccactgcactccagcctgggcaacagagcaagactctgtctcaaaaaaataataataataaataaaaatttataaatttttaaaacctatcaatcattttatttttaatttcttcgatagctttattgaggtataactgacataagatttatatgtggtacaccaatgaaactgtcacaattaagaaaatgaacataaatattaccccactccagatttttcttacgacacttttcttccttcttgctcctactcactacccccatcccagtaaccccaaggaatacatgctttctattgctatagattacattgcatattctataattttatacagatgagagcatacattatgtagttttctgggtctgatttttttttcactcagcataatcattttcagattcattcatgtttatgtgtgtatctgtcattccttttagttcccaatagtccactatgtggatataccacggttggattatcccttcacctgttgatggacatttagatagttgccagcttgaggctattagaaatagagctactatgaacatgtgtgcatgagtctttgtatgaatacgttgtttcctttcttatgggtaaatacctaagaacaaaatggctagatcatatggcctatctatgtttaattgtgttaaacttctcaactgttttccaaagagattttgccattttatatccccaacagcaaattatgagtgttccagttgacccatactctctccaatacttggtaaaattagtcttttaaattttagctattgtaatggatgtgtattaatatttcattttaacttgtagttagtatgcagtgtttgtaggtaagtaatggattttcatcatgcttttaatttgcatttttctaatgattaatattgttcaggagcttttcagttgctttattttcctgctgtctatatatttctttggcaaagtgtctcttaaaatctcttgccaatttctaaaaatctgtttgttttcttattaagtttggggagtactttatatattctaagtcctttattagacatgtactttgtaattattttcaaccagtctatggcttgcttttctattcatttaactgagtcttgtaaataacatacgaagtaacttttgatgaagtttatcaatttgttattttatggatcaggcttttgatatcatacctaagaaatcactgattaaccctaagtcacaaacaccttccctaggttttctgtagaagtttaacagttttagggcttacatttaggtttatgatccattttcacttaactttttaatacagtgagaggtatgggtcaatgtttctttttttttcttttttttttagacagagtcttgctcttgtcacccaggctggagtgaggtgatgcgatctcggctcactgcaacctctgcctccggggttcaagcgattctcctgcctcagcctcctgagtagctgggattacaggtgtgcaccaccatcctaattttgtgtatttttagtagagatggggtttgaccatgttggtcaggctggtctaaaactcctgacctcgtgatccgcccgcctcggcctcccaaagtgctgggattacaggtgtgagtgactgtgcccagctccagtgtttattttcttgcatagagatatccaaatgttctagcactatttgttgacaaggctgaataacgtgtgactatgttatctcatttggactttacaacaaaatgttttaattcctatgctacgtaagaggctgaagtgtaacaaggttaagttactgagccaagctaacacagaaagctgtggcttttgttttgactataacttcctctcgatatttcaagactctgagctttttctgtgtaccaaaatcttgttgagagcagcaggcgatctggagagaaagaggtggaggaggaaaaagtaccatgtctccagagctggagggcccaagataaaaagcaatgcctttggcttccttaatatggcctctttgctccctgaagtgagcaatagctttgctcatcttcacccctctgccctttcttttctgcactgagggtactacatctgctcatgcacagtcactaacaaagattcctgagtgatctgacatcctctcagacctacttaccaagctgtgcttcctggtccaggactgggtccacttggagaacagaaggcaccctctttatctacccccaaatgtcctatgggctagcaatggcttttcctgttcccctggcccattccttgactgggaatatttttaaagcaagaggtactttactctttggggtactgtcacaggagattctccctcaggcctggctcatggtccctgatccttattgaataccccaaactgtatcctagctagtgataagtctggttgttctctttcctatctccgtgtgtctgcatgagcggctgtcacttcatttctggactttctgcctctaggacatggactgattttatcattcgctggcttctctttaacttccttcctttctccccaggggcaagggggtgcatctgttttcatgatctcccatcttgaatggtaatcagtgttccaccagacgtggcttcccatatccttgactttatcttaataaatgacccatcatatttagcagaaatcattgcgtctttgtttagggattaggactagagatatatttaaactgcactgagcactggtaatcctgaaagggctgaagcaattctgataggatgatggggccacagcagttagcgcattcgctcagttgcagatgttattaaagcagctgtccgttctcagcacagaagagataagcagggattggtatgcatgtgcacatatatatacaggcttgctctggcatgcatgggtgcatgcaaacacacgtgcctgcacactccaaagcatgaactcatgtaataatgcttgtatgcctaagcaaatcccatgagcctgcacatgcacattcgtgtgtaggacatatctcttcatgcacatgtaaacatatacacccattttcaaaatgttgcaaataatatgaaggcatgtctatgtacatatacacaggtaaccacatccccacaattatggtggtaaaaatatgcaaacaaacagctactctgtagccctctggtacagtgtacagtgttcaggatgtgagcctctgggttccagatacagagtctgcaaaaagctccaggtgtcttatgactgcttcttcctgcttttgtgcacagcagtctctatctcctgggtgtcttagcagagccttccttggctaccttatgatgccaggtattacttgaaaaccctactaaatcctgatcaattcagcctccctttgccccaggagctgggacacctctaataacattaaagcatctcagctacctgcccacagtctgccacacggccactgccccccctactagtggccttgatgtttcattgatttattcattcattctgttcacaggtatttcttgagttcctgctgtgtctagacctgtgcaacgagttgaataggatacaaatgcatttcagatttatttctgtctttcaggatcttgtgggaatataaggccttcatacacaaaccagttatataatagtaaaagacagttatataatggtacaataatgctaagtgctcaaatgagcatgcactggggtccctgagaccacgtttggatattcactggaagcactactgagactcagcatataattgtcctcacacctaatattcatgacaatgatgtggtgaggatgcttagctaaatcataaggggaaaagggacaggcagagtctggtggaatccacgtgcaagatacctcacgctctgtccaaccctcagcaacaaaaatgcagcaacatgtgtgtggtatttctgcccagggcagcccagtaaggactcagtgccaaggattttattgggggtgactgcattggcacaatctgcctagcatgtaccaaaactccagcttcccagaatggaagcaggtgttcagcataaacaccacgtagacactgtgagccacccttatcaattagggaatgtattatataagcataggaaactggctacattccaagatgccaacaaagggcaaccttgtcatcagtcctttgtaaagagagtggtgtcaggtttgttccattaactcttctctgcacggagcggcaaggagaggcgagcagttctagaaaacgaaatatgagtctgagctgggaagagggcttttgaactgagtcttgaaggatgactggcatttaagaaggcacagggtgctagcagtggagagaaagacaaaagtttagctcaaagggagattaagcagggtagcaaggaaggacaaagagaggcagaacaggattctctacctattcatcaaacataaatgcgatatttgctacaagttggaaactctgctaggcagtgagaacttagatccaatccttaaagaattataaaccaagaagggaaatagacaaatagcccatcatttcagtagcagggtcaaagaagaacccagccacatctgaggaagctctggaacattcacatcgtgtttgagacctgagatatgaggatttgctgggtcaagagggagaacagttctctaagactgcacatgcagaggcctagaggagagagaacatggtgaatccaaccttctattccaaattgctgctcctgggcaggctagggcagtatgtgtgtgtcttttgcatgtttgttctgttttgctgctaaatgagattcagatcagcagggcaggttcacattcaattatgtagctgcttatattgttgaatgtccatcaaatatgcaactatagcaggtccttgaataacattgtttcattcaatctcatttcgttataatgttgatgaaaaagaatccatttgcagccagggccactgtctgtgtagagttggcatgttctgccccatgtctgcatgagttttctcctggtgctcttgttttcatcccacatccaacagttgagcatgttaaacaaactgacctgctcgattttctgagactgggtgagtgtgggtgtacatgtgagtgtgccttgtagggggatgacatcctgtccagggctggctcttgcctggcaccctgagctgctgggataggctgtggttactcatgaccctgaactggaataagcagtttggaaaatgaattattggaaaatgaaagcttgtaaagtatatgataatgatacaaatgcatgacaataaatgatgcagcatgaaaatgctcagtgagcccacaagatttgtgatggtttcaaactgtgtggtgggaggaggtgctcctgaaaattctcactttgcaaacatttgttccttgatgtaacccaccaccactatgaccattgtcattcaccaattcaccaaaaatctgatgagtaattatccttttattaatctttctaaagtgtatgtttggcccacatttatttcagtgtttaatattagaggtgttcgggtcttcatttagaagtttagtgatgttttcatgacaagaaatacactgtaggaccttaactcttgtttataccaatgagcctaagggaaaattggttttgttgtctcttgcttcacctaaaggtgcagtttccaaggacctttggatgatggtaattgagggcttactgtattttatagcgaagacaccagagttcgtaactgttaacagatgttctcattcccctggttatccctggttctctaactcccatctaatgtgttggcaagtccttttgtctgtacctccaaacctatcccccatcagaccccctctcaccatcttcactgctatcctaggagccctagagaccagcatctccttcctaagcagcatcaagagtaaattaaaccaggtaatatctctgtcctgtaaagccttacaaatactgaccattgcatttgctgaaaggttcatactgcttaccaatgcctaatgccccagttatctgtcccctgcttacctttccacccttggcatatttctcttccttccactcagtggactgggtgccctggtcttctttctgtccctggagcacaccaaggttattcttaccccacggcctctgcactggccgttccctttgcctgcaactctcttttcccaggtcaccagctcactggctctttctgatgctgcaggtctctgctgaaaagcagctccgcaaagaactctctcagcttctgtatctcaagctctcccttcatcccccgcccccaaaaccctcctctatgactcactgttattttctttatgtaactatttatccccatctggattcttcccccgtttggattttattgtctgtctcccatcaatggcaaagtaaatttcctgacgccagaggtcttacctagcttgcctggcgtcttcttcaacaagtatatgatcaaatgaacgaaatgtttcttggctagcaagtggttggactggggaattaacagagaacactagaccttctcttctgcctgtcttgggacacagagcattcaaatccctccagcagggggaggaagaagaaatacctggcagatgtgacacagcaaggagacctgggcagccagtggacagaaggacagtgggcccggaggacacccaccagcatacttgctggggcagaagaggggactgtggccagtccatctacaggcaatgcaggggggcaagctgagccagcagccttaagaggaaagagagagttggtacatgaattccaagcgagtgcagaaagatcatccagacacatgggatgttctgattgacagcagagaagcaaagcaatgagggaaacagaggcaggcaggcaatgtcaggtgtggtagccaggcactagctgctaatctgggctttaaggtcacaactctctcccttgggagaactggcaagagtaaggctggcctaaccctggaagagcgggggcacccaccagagtggcagttcagaacctcccgatctgcatagggtgcatttggtggaattctgggcatgaccaaagatggggtgcctgagctggggtgtgagggaagggtgtgaggagcaaggatggacttgatagggagcttctcctttcctttttttttaagtacaaaattatacatatatttatatatataataacatgacatatctatgtacaacatggctgggacagttgaagaaactatacaatggtgttcaagagagcaagattctgtaatcctcttgctgcttctttcatccagcaggaagcttgtggttgatgtcagaggcccaggcagcaggagttggcacactgctgtcaagtggccacagctgtagctgttaggagatagagtagcaggaacagggagccaggaggtcattaaaccacagagccaagcatgaacttgcctcattcacacttttcctagggaacagacctgaatggacttatctcgaaccaccaagaaaagaggctggaatagggctttgggagcagatctctttagcaggagagagaatggtgccagcagcccttcccaccaacatccggccaagctgtctgcattgaaacacagagctcagcaactgcagcagcttaaaatgcattctattctatctctgctcccagcatctgcagaagctaagatgatgttctttaagggcaaaccatagacaccttccatctctggagggttaaatgtggagaaggaggaacagaggaaaggtccctgcacctgtgaacgcagccccttccccacatgcagtgaaacttgatgaaacagcccttcctgttggcacctctgggtcctgggtgggcctgagtccatgccactcactgatggggaatagcatggctctgtttgcatggatgcaactccccagcagatggtgaatcagacctcgatgtctctgtgtgcgctttatacattttacttgttggtaatgaatttacaaatcctttaagtatggaaaacagagccttcccacaagctgaacagatgggagagaaggctttctaaaggctcttcaaagtggcctttttcttcaccccctcctggcttaatatctctctctatgtctacaaatgctttattagctgggggtgagagagaaccttccctgagtctctttctctggttccctagaaaattccaggcaggcctgccccggctaggaacgcattagcaagacagcactgggccctggccaagaaccttcattcaacattgcattcctggagtgcagcataactcatggagagaaaaaaggaggcagaacctcttgcaaagctgcccctgacttctctggcagggaaagaggttctcttctttgtggtgagagcttccttctgagtggccagagtgtggtggattgaatgggttcaagctgcaagcactgcagcagactgaactaatgttttaccttttcctgatccataccctttgccgtatcacttttcagtgcaccttgacgctgaacttggcatgcggcttgctttggccaatgggatattagcagacataaagcaggctaagaatttgtgatggttaatttcatgtgttcatttgactgggctaaaggatgcccagatagcagcaataccttatatttgagtgtggccgcgagggtgtttctggaagacattaacatttgaattggtgggctaagtaaagcaggtggccctcctcatacaggtgggcatcaactaacccactgagggcccacataaaacaaaaaggtgggaggagggcattttgctctctgtttgagctgggacatctatcctcctgctctcaagacttgagttctctgggtttcgggcctttggacttggactgggacttaccctattgactccccctagttctcaggcctttgggtttggcctggaactacaccaccagttttcgtgggtctgcagcttgcagatggcagatcacggaacttctcggcctctataatcacatgagccaatccctactaagaacgctctttctatacatctatgtatatcttactggttttgtttctctggagaatcctgacgcatacaggctttaaatgaacttgctcacagaagcatgtttcttgctccatcagaaggacgtccctgggtaagctcgctggtcccagaaagaggagacacatggggctgagccagctcccttcccgctagacatggacccaggatccaaacaggcagattagatgcccacggtcaagagcctggatcacgtacttcctctcactctcagcatctccaacacagagcacccatgtagaagaaacaataattacataaacggctatgatttactgaacttatgctaaacaaagggataatgattatattcatcttatagagttgttttgaagattaagtcagatgataaagtttattccttttttaaagatttaggtttattgtcccacttaatctttggcccacagttttttggcccatgacaagcactaaataaatgtcattttttttgcattatttacatgcattaattttaatcgttaaaacaaccctcaagttaaatatcattatctcattttacagatggaatactgaagtacagactacttaagtgatgtggccaaaattacacagccagatatgtgggagagctaggattgaaacttctgtttaaccctggaaataattaaacaatataaaacaagatgcaggacaagtgcatattcagattttggacacacagtaaatgctgaaaataccataaaagagtaaacctatattgatacggagcagggttttgacaacttgacactcctgacattctggaatggataattctttgtcatacaaggaccagcctgcgcactctaagacgtttagcggcacccctggcctctcacccactagatgccagtagcacctcccctgcaagtggtgaccaccaaaagctgtctcctgacattgtcaaatgtttcctgagacccaatgttctggaagtatcaaggaaggcttcaagcaggacgcaggctttgagaggtcctggtaagagcttacatagtagttcccatccttaaatttcaagaaccatttaaaaatcttaaaaataaattaagggagaacatttttttacttctcttaaaaaaaaaaccgagatacatgtgcggaacatgcaggtttattacctaggtatacacgtgccatggaggtttgctgcacctattgacccatcctcttaattccctcccctcaaccctcacccgctaacaggccctggtgtgtgctgttccctccctgtgtccgtatcatctcaatgttcagctcccacttatgagaacatgcagtgtttggttttctgttccggtgttagtttgctgacgatgatggcttctagcttcatctatgtccctgcaaaggacaatgatctcattcttttttatggctgcatagtattacatggtatatatgtaccacaccttctttttccagtctatcattgatgggcatttgggttgcttccatgtctttgctattgtaaatagtgctgcaataagcatatgtgtgcatgtgtccttatagtagaattatttataatcctttggatatatacccagtaatgggattgctgggtcaaatgatatttctggttctagatccttgaaaaatcgccatgctgtcttccacaatggttgaactaatttacatacccaccaacagtgtaaaggcattcctatatatccacatcctctcctacatctgttgtttcctgacttaataatcaccattctgactggcatgagatggtgtctcattgtggttttgatttgcatttctctgatgatcaacgacattgatctttttttcatgtttttggccatgtaaatgtcttctgttgacaaatgtctgttcatatcctttgcccactttttgatggagttgtttatttgtctagtaaatatgtttaagttccttgtaaattctggatattagacctttgttagattgttagattgcaaaaattttctcccattctgtaggttgcctttcatgctgatgataggttcttttgctgtacagaagctctttagtttcattagatctaatttgtcaattttggcttttgttgcaattgcttttggcgtttttgtcatgaagtctttgcccatggctatgtcctgaatggtattgcctaggttttcttctagggttttgatggttttgggtttcacatttaagtctttaatccatcttgagttaatttttgcataaggtctaaggaagcggtccagtttcagttttctgcatatggctagccagttttcccagcaccattaactgaataggacatcctttccccattacttgtttttgtcaggttggtagaagatcaaatgtttgtagatgtgggtagatttgttattttggaggtctctgttctgctccattggtctagatgtctactttggtggcagtgtcatgctgtgttggttactgtagccttgtagtatagtttgaagttaggtagtgtgatgcctccagctttgttcttttttgtttaggattgtcttggctatacgggatcttctttaattccatatgaaatttaaaatagttttctctaattctgtgaagaatgtcaatggtagtttgatggcaatagcattgaatctataaattactttgggaaatatggccattttcacgatgttgattcttcccatctatgaggatggaatgttcttccatctgcttgagtcctctcttatttccctgagcagtggtttatagttctccttgaaaaggttcttcacatcccttgttagctgtattcctaggcattttgttctctttgtagcaatcgtgaatgggagttcattcatgatttggctctctgtttgcctattgttggtgtaaaggaatgcttgtgattttttccacactgattttgtatcctgagactttgcggaagttgcttatcagttcaaggagattttgggctgagataatgggattttctaaatataaaataatgtcatctgcaaacagagacaatttggcttgctctcttcccatttgaaaactatttctttctcttgcctgattgccctggccagaacttccaatactatgatgctgtactatggtgagagagagcatccttgccttgtacttgttttcaaagggaatgcttccagcttttgcccattcaatatgatattgactgtgggtttgtcataaatagcttttattattttgagatatgttccatcaattcctagtttattgagagtttttaacatgaagggatgttgaattttatcaaagatcttttttgcatctatggagataatcatgtggtttttgtctttggttctgtttatgtgatgggttacatttattgattgctgtatgttgaaccagccttgcatcccagggatgaatgaagccaacttgatcatggtgggtaagtttttcaatctgctgctggattcggtttgccagtatttttttgagcattttcacatcgatgttcatcagggatattggcctgaagttttctttttgttgttgtgtctcctcccagttttggtatcataattatgccggcttcataaagtgagttgggggggggggtctctccttttcaattgtttggaatagtttcagaagaagggataccagctcctctttgtatttctgctagagttcagtcgtgaatccgtctggtcctggggtttttttggttggtaggctattaactactgcctcaatttcagaacttgttattagtctattcaggtatttgacttcttcctggtttagtcttggtagggtgtatgtgtccaggaatttatccaagtttttctagattttctagtttatttgcatagaggtgtttattgtattctctgatggtagtttgtatttctgtggggtcagtggtaatatcccctttataattttttattgtacctatttgattcttctctgttttcttattagtctagctagtggtctattttgttaattttttcaaaaaaccagctcctggattcattgaatttttcggagggcgttttgtgtctctatctccttcaattcttctctgatcttagttatttctcgtcttctgctagcttttggattagtttgctcttgcctctctagctcttttaattgtgatgttagggtgttgatttgagatctttctagctttctaatgtgggcatttggtgctataaatttccctcttaacactgctttagctttgtcccagagattctggtccattgtctctgttctcattggtttcaaaaaacttcttgatttctgccttaatttcaatatttatccatgagtcattcaggagcaagttgttcaattttcatgtattagtgtggttttgagtgagtttattaatcctgagttgtaatttgattgcactgtggtctgagagactatttgttatgatttcagttcttttgcatttgttgaggagtgttttacttccatttagtagtatttgcatataccctatgcacatttcccatatactttattttttaaagaaatttgtatttccataggttattggggagcagttggtggttgggtacctgagtacgttctactggtatactttaaatcatctctagattacttataatacttcataaaaggtaaatgatatgagtagttgttattttgtggttttggttcctattatatttattgttgtgttgttatttttattccttttttccaaatagtttttatctgtggctagtttggtatggtttatgaatgcacagatatgcagggccgactgtattagtttcccagggctgccatagtgaagtgggtggcttaaaacaacaaacgtattctctctcagttctggaggccagaagcccaaaatagaggcatcagcagggttggttctctccaagcgctctgaaggagaacccgatggaagagccacatcaccctcctcccctcccgttggttgctggcaatcctcagcaggctttgacttgtagctgcatgaccccaatccctgcctttgctgtcacatggcatctccttgtgtctcttctcctcttcttataaggacaacagtcatatcggattaaaggcttaccctcttccattataaccccatcttgactaattacatctgcaatgaccctatttccaactaaggtctctttctgaggtaccgagtgtcaagtcttcatcatgtctttttgtgaaacacaattcaactcataacaataacgtctctgtgagatctcacagatctcctggatgatcttctctcctcccaaacctgtactcttcaggaataccactccctgttaatcccagaaggaatggagccaacagagatcacccctctgtaacccaagaactccatatgttccaccatcccttccatcaatttgtacccatgggatagtactgctgccccaccatatgcactggagttgtttttctgcagcaggtgcgatgcttttcacggctgtatccatcctctcctccccagataccctgcaaccacccatggcctgcatctgtagaatgagagccagcgagctatgctccctctgacactatgaaggagtttggtttgatgataaaagcctacaagaaaatgcaagccttgttccagcagcacaatgtggtcagattttttttttttttttggccttctaggaccctcagactcacttaaatgagaaggggaccctagttttaccatgcatgttaaagttaggatattatgccaaacttctaactgccctgaagtggacagtgtgtaaatgatgggataaagggaggggggaaggaattgaaggaggtcccaggaagctatgctggggcagtgaggaagcttgaccttgtcaaagaaacaaataaacccctaggaaaaatcagtgggataaactcttaagaggctgattttgagagaacaaggatgaaggagagtcaatgacaaccatccacactggaagatacccatgaagaagtgggggataaaatccaccagcttctgcattgtgagcctcaccagctgggacacaactttgctctatggtctttgaatggaaagaccatggtaagagcagctaagtgctcggttctaaaaatgttgaagactgtagaacatcaaaatggccctgtagccaggcagatcattaccagggaaattctagtaatagcgaccaagagacccatccaggaaaagtcacctttaacacaggtcataggaaacagcattagctgggggctgtatggctctgggcctataccactagcttgagcctccatggcctcatctgtaaaacagggacatgtgaaatcctcaaaagtcctctcccaaacttacagaccctgcatgtggccccagggatggaaattgaggagaaattttcttctagcaccttttccaacctgctctctcatttgttttctcttagcaagcctcccaccttgtcgcaccagctgtgggtttcttgttagagctccaacctcataaatacctccatggccagaaattgtttctctaaaaatgtaatatgcatgcaaactcaacatgtgaaaccccacaacaattgaattcttctgtaccccaaaatcaattgtcaaagtgcacataaaattacaacagtgctaagctttccataatgaggtgattgtgctaagcgagcatctgatttaagaagtggctcagcagtacagggcttcgtggcatcatctaatcaggctgcagcaggaaacatgctagcttccaagtgagcagaccgcagtggaggggtgagcaggcaccatgccagtctggaggtgtggtggggaggagttgggctcacgagtgaggaggcactccctgattcaggcccccccagtcttcaacctcttcccccaccaagaaaaatggaaattaaagctttgaggacagagagggagcaagagaggggaggcataaataaaaagagggcaagcagggtgagagggctgcagagatgaacacagatgaccggcaggagtgaaggtctgctccgtggacagagacaagctgctctgacatctgagcttggcactggatagaccttggctagaggcacagctcagccctggagggtcagagtctgtcctttgtcctcctttgcaggaaaggagataggcccagagcgacgggataggtgttagccatgaaggagctgggagtcaccctaagtctcttcacacccggacacattttcccacctgcttgtcattttccaaaatgctgctattactttagcttttccagtgcaatttttgggtcacactgggctctctccctctgtttcctcctttatagagcaaatatgccctagaggagtaactcttcataccttggtagcactagcatgtgggagaagaggggtagacatcctggaggtaaacatgcatcctcaggcatggatgtattatctacatctcaagggccagacactgagcaaggggtaagtgcaatgcagggatggtggcatggcacctcctgatctagtgtagaagaggatgataaccccacacacccagcactgagtgtgtgtgtgtgtgccagtagggagtgctcaaggtgaagggcaggagggaggaacagagcggggcccatttctcagggcaagaggacttctgagcagagtcttgaaagaactacaagatttagcaaagagaagaaaggaagagaaaaagtatctgcaaatgcacggaggccaagaaacagtgacctgtttgaagacagatgagaggttctgaatggctggaatagaatttggcatctggagaagcagcaagaattgaggtgggaaaggtcgagacacagctgacaccacctgactcaatgaatgttcaggtggaatggaaaggtctttcctggcccagatagtttccaagttccaagaatcttccctaggattcactgaaatctcaaaacaaccactgcctgttagctttgagccagccacctcactgatcagagacttcctgtctctccggagcatctttctctctcaagagtgtcttttggggataatcaatgagatcatttctgggcaatccacctaaaaagggctggtgactcacaacactagatagttggggaagcctgtggtaaggaagatgctggagggagtggtaatagttatgggtcttcactctcttgcctggaatcatgattaatgtgccagtagttcagtctgagtgagcctaaacatatacagatgctccttgacttacagtgggattgcatcctgattagcccattgtaagctgaacatatttacatcagaatgcatttaatatgcctaaccaactgagcatcataacttagcctagcctaccttaaacgtgcttgtaacactgacattcaccaacagtcaggcaaaatcatctaacgcaaagcctattttataataaagtgttcagaagctcatgtaatttatgaataccataccaaacgtgaaaaacagaaaggttgtggggcaaatgaacctgggttagaatcttaacttctccagttattatgggtgtggcttcagtttctttatctgtaaaatcgggataataacaataccttgcctcacaggataccaggaggatgaaataaaataataaatgctaagatcttagcacagtgcctggcacagaaagatgctgaataaatattggcctaaaatacaaaacaaaaaaattacaagtcaaagcacttacctaagatgattctcaggtctcctttgagataagcacaagaatctagaacttcaggcttttactgacttctaagaagaggatgaccccaccccttgggaagttttccttcctgctcagaagtggttgctggtggaagagactttccccatatcaggtctgaatctggaagggagataactccaaaacctgcccaaggacagagcaggatttagaaaggagaaagtttctttgccaagctccctcatagaaatccagcaagataaagcccttacccaaatagcaattgactaccaaaaaaatttcagacattacaaacaactgtcaaaagttgtctggctggctgggcacggtggctcacatctgtaatcccagcactttgggaggccaaagcagacagatcacctgaggtcaggagtttgagactagcctggccaacatggtaaaacccaatctctacttaaaaatacaaaattagctcggtgtggtggtacatgcctgtaatccaagctacttgggagactgaggcaagagaatcccttgaaccccggaagtggaggttgcagtgagccaagatcgcacagctgccctccagcctgggtgataggagcataactcagtctcaaaaaaaaaaaaaagtttgcctgtctggcagcattatctcctgttatttacagtaagaaaactgaggaacataggaagcaagtgacctttcctaacaatgcatggccaatgagggacagaatgccaggcatctaactgttggtatagtttctcttagacttccatctggtttctgaagtggaagtgtagatcctagcaggagatggagggggacatgggggaatgattctgtttgtggctcaatgaggctatctcaggggcctgccttggcccttggctgggcagagtctgcaggtgagcacagttggcatatcccatgcccagatgtcaccaagtcagagcacagacatctctggggcaggtgccattggcccaaggacagaaagataagtttgagaacctctggcagtcacttggattctgacggaatcatctttgaatttttgtaggagttggtgctacgtctttagcccaacagggtactgaccatcactgctgcaccccaaggctgaatacttttccaggagggtttctgtcaaagactaataccactcaccctcctttccctccccctctctgttgtaggtggggggcacatttaacttatcatctaaataagaatccttttaagagtgaaaggaggtgtcgcctggaccatccaggcaaggggctctcatcttcaatcccaatcctaccaacccttaagttgagattgctatctaggtgggggaagctgtctttgtgctcagatgcaatcacagaggaacctattccagatgagaagcaggcagcaggagaaacattctcatgggctacatgtcctcttgggaaagaaagaacaaaagaagctgtttcaaagatggtgctagagggtagagggggaagaacacgcttctgaaaagtgtgagtatctccaaaatacaaaacactcaaatgaatgcctcccacctgctctccaaatagacagattctgcccatccttcaaaacccagctcatgctcctcctctgttatgcctcgaaaatcacccaggcaccagggagcctcctcctcaggccccagttgttctcactttttagaccgtgggactttatggtttcccttgtaatttgccttatccagtcatctaataatttatccttgagtataccttttaacttctctactaggagggcagggcagttttatggctacctttttgtaatagggtacatgtgggtgtatgtaaaatatatacatataataatatattatatgtaagtccactaaatttacatatattctactaaatatgatatacatataagcatgtacatatacatatatacatagagacacacttatatattcatatgcataaatgaaagtaagaattaatgtttagatagagagatgaacctactggatatgtttatctcaaaagaatcaaggagatattcccagagaacaagaagtcatttacctattaatgggtgatggaattttcactgtgggagtttataggttgagcgggggcatgatgtctgtgcttttcacacctacatctttggtttggggactggcattgtgaggatctaaccaggtggcttcatgaagtcattcccatcttgagatatggataaacataggggaaaaagtaaaaccaagggaaataactagctaccaagtgggcagcatttccaggaattagttgctcacccctttgctaggatgagtcatggttttggcagttgagtcattagtgcccgcttgggaagcttttccttattgatttctgctaggcttcagccccttgccaatcaacggcttggagacagaagactggacccagagactggctaacattccttttcagatttttaagattctggggatacttttctagggatctcctattcatttaggcagagatgagttgttgtttttttaagcctcctgcctctccctagcctctacccacagaaagtaatgcccatgcttgccgtcccatcttgaaagctttcttccaaagtttagttactaattagacattatttataccccagaacacatgcacgtgtcatgctgctcagcatgctgttctcatgagctccctggtacacccgctgttcttaaatgtccccatcactccagctctatacgctgactttgacaggcatcccaccctgtgaatcctctgtctgaacaactcttctaattcatgtatgccagaacacagttactccagctccatccatcttcccaagggtcctttgtcactggtcggtcgtgtgctggggaaagtcatgattgagatgctttccttctctcctccactgagggaagagccaggtcagtgagcccagaaggacagagctctctgtgagccacatgaggagcctcagtaagccaggagacctcaagataacacccacccacctaaccctacctcatctacacacacagcctcatcagagtaatccagtacaatttttaaaaatctatgtgatgatctttatgagtctagcatctggtaaggaagtagccatagattataatgcctgtgactccagcctcaactcttgtctttcacacatgacttctcatttaaaagaacaccttaatcagctgtaaaacaaaagccaaggaggtgtgccaagagcttggagaaaaagaaaaagtctgacctagaatgttggaataattaaatccactgctgctcttccaaattacaaattggaatcacctgctcagggtgtgcccggctcactccatccctccccactgcagcctgattaaggattccaggcaactgactggtgttcccagacaagcaaaagtaaactccctcatctgcaagccaattcacataacagattccctaataaggcatgaggaaaagctgccctggcacatctgttttgtcatgcatctccagcaaatcctgggacaacaggagaggcagaggcaatgctggtcccaaatatactcatcatatttcagtgaatggactcagtgtttaaggcttggtctcaaccattcagatagtattgaggatagttaggttcaggtgcagaattcattatgaagttatttgattcatttctcaagcaaacatttgctaaacgtctacaatgtgccaagcactgggttaggcactgaggatgtaggggaagagaaagtcatagaaagaggtcattgccacacactgtggggggtgctactgtagaggttatttgccaatttctataggaatatacagaggtcaggaccatcactatctaagaaagaaggaaaagatgaggagtcaaagaaagagccataagaaagcagtcttgaaggatagaatctggggagccattatgaaacctgagtggaaaaactggcttgcaatagatgaaagtatcgtgtcttcccctacacactagcaatacatagtcatatgttgggggtggtggtgcctcatggcaccagagcactctttctgccttcctcccaataccatttaccagctatttacactctgtccctggctcctcaaggcctttagaaaccctgctttgctctagtcaatgaagatgggccaaccaaatggatggagagtgcggctttgggaatgacgccttgtcaacatctcaccttttctggtgtgcctcagtctggggcccacctccagcttcctgaaaaccttctaacatctcactgctctctctctctacaagaagcgtctcttaacactctttgtacctttttaggtcagagacacccagcaataagtagcaaagcacccagcacaatgtctagcgggtattaggggctccacgttttagttaaaattatttttaaaaataatgaaattttagttaaattttagataaaattgtttatcatattcattggcttatatttataggtaagagaggggtacctttctctagaaaccatcagcttttgtctctctctctctctctcacacacacacacacacacacacacacacacccttacacataaaaagtatcatatttacatataggactgttcagatattagaacacatacagttattttcaatgcactaagccacacagataaaaatcctggccctgtctctctctgggagcttacagaccaaattctgctagaattcaggatagcattctgtgcattctccctcatagagtgagaagatgaatctgctagggaaggaaacacctccacactcagcaaatcaagagcaagaaccatctgtgttttccagaaggtcccagcaaaatgtaagaacaagagaatcttttgacatttcacatttctcttccctgggagaaggctgaatggaagttcttggatacatatatgtttagctatcttagatccacagggaagctatgggaacagtaaaagagccagatgagggggatcttcatactcgtagctgggttggtttgaaggatcagaaaaagaccagcctgagactgtaaaggaccaagtgagactgtaaaggaccaagtgagactctagaccaggcatgggaataagtggctgtcaggaaagagatcatctcagtgggaggaattcggttagactcctttagcctggtcactgaccatcaataaaatgggaatgatgaaacccgcaaaggaggtgaggattcttctcaactggcaaaacaaaccactatctatccttgacctttgatccttaaatgatgagatctcaaaaacttctcaaggtagtagcatggaaccacctctgtatccttcattttataatcataaagtttgccatttgcaaatatctcacatttaaacttgttttccttttgcataaaacatctaattaatcatattaaaatatttcatgggttacttttaagaaaagcctaccaaactgatatagaggatattaaagaatcatataatcttatccaattatatgtgtatagatgtgaaaacctgaaaaaaagggctcattttcttgaaaaacataaattactaaagtaaattacagaggagacacaccacttaaacccatcatttaccaaagaagaaatttgattattattattcttttttaagagatggggctcttgccagatgccgtggctcatgcctgtaatcccagcattttgggaggctgaggagggcagatcacttgaggtgaggagtttgagaacagcctgaccaacatggagaaaccctatctctactaaaaatacaaaaatcagccaagtgtggtggcacacacctgtagtcccagctactcaggaggctaaggcaggagaatggcttcaacctaggagggagaggttgcaatgagccaagatcacgccactgcactccaacctgggcaacagagtgagactccgtcttaaaaaaaaatagagagagatggcggtctcactatgttccctaggcttgagtgcagtggctattcacaggtctgatcataatgcactgcagccttgaactcctggtcccaagtgatcctcctgcctcaccctcctgagtagctaggagggcaggcctggcagaaattgattttttttttaatgtcaagaagctcttgcaagaaaaaaaataatgccaaagtgtttcacaaaataattgtctaccatgtaactaacatgtatctccagtactattttaaattgctcaatatgtttagaacaaaagatcacttccaaattacttttataaagttagaatagcattaatagtaaaacctgacaaatcaaatacaaagtaaaccggcaaactactttcatttgatgaatatcagtgtgtacattctacatgaaagaataatgcagagaatcgggcaaaagaccaaaagaataattatccatgaataaatgatgtatattccaaaaatgcaaagatagtttgactctattaattggccatatcagatgaaaagagaacctccataaatatctatcagatattaaaacatattacaaagctatggcaattaatacattacggtaccaaatcaaaaataagtttatcaggctggacacagtggttcacgcctgtaatcccagcaatttgggaggctgaggtgggtggatcaactgaggtcaggagtttgagtccagcctggccaacatgatgaaaccgggtctctactaaaaatacaaaaattagctgggcatggtggcacatgccctataatcccagctacttgggaggctgaggtacgagaatcgcttgagcccagaaggcagagcttgcagtgagccgagattgtgtcactgcactccagcctgggcaaaagtgagactctgactcaaacaaacaaaaaagaataagtgtatcaataaaacagagtatagaatccacaaatatatccaaatacacttaaaaatgtagtatgtaataaatgtggtttcacatattagtaaagatggatgagtcaataaattgtattcacagaatagccatccaacaaaaaatgaaagttacaatccctagcttataccctatagaataatcagcacattaaatacaaaatatggaatcacaaatgtaccagaagaaaacattagtttttaaaaaataatctcaacttggcaaagccattaaaaaaagactgtagtacaattatgatttatcaagataaattttgctacattaatttcaactttttctcagtaacaaaagtactataaaaaattaaaagaaaaatgacatgtaaaatatcagaaatatttatccaaacaaatatacaatgaactcccacaaatcagtaaagcaccaaaaactcaatatgaaaatatacaaagactgatgtatagaaaaaattatgaatagctcctaaataaaaagtattcagccccactcctaataagggtagtacaatggaatctcaataataaaccatgtttacatctatcatattagccacaaataaaacacataataacactatttggcaagattaggacaaaccagctgttttcatgaattctaagtcattgtgcaagtttatgacattttgaagggcaattttatgatatttataaaagttaaaatgcatttatcttttgagccaatgattcattactaaacctactctgcagagtaacatgctcatgcaaaattaatgaatatgttggatgattaatcatagcatcttttgcaacaggcaaagattgaaaaaaaaatctaaacacccacaagaagggcactggctaaataaatagtaccgtattacaatgaaatattatgtagccattaaaacaacaagacacttttataattaactatatgataaaaacttaaggtacatttttagttttaaaaaacaaggtgcatctttttcattattgtcctataaatcctagctaatgtaataacacaagaaaaggatataaaagagatacagattgggaggagaggcttcaagatgcctgactagacatctggtacccacctcctccataaagaaggactaaaatagcaagtagatacttagacttcaactagatcatctaaagcatggtctattcaacagataactcacagagaagtaaaagaaaacacgtaaggtgagaaaggagaggagagtgagatggcctactctactgggatctgctgggagcctagagaggctccccagtgcagaaaaggaggaaatgaatgacctccagtactctacatttccaccatggactcctgcagtccgagccacaggggaggctcattacatgagggccctaagactaacataggcagttgcctggatacaacacaacagcatttaagggagctcaaactgggtcctacactcccccaagtccaaagcagctacagcacagcaccattttgagagcctagcactcaccaaactgcatctgccctacggcccaatagtctctgcatcttcagatccctggagactcactgacatcccctacccccagctggacaccactgctggctgctgctaccagggctgaagagtgtcattggtagcaactccaccactcacggtagcaggactactatgcatttaaaagcattctgaggaaatattaacctgcttatagccaccagtgagggctgaagtgtgcacttccaagccacctatttatggctgttgacaaagaaagcaccctgccctcccagcaacagggccttagtatagccgctgctcccacccaggcattctctcaggggcctgtggatcaccctgctcctgcctactacagcacagccagtgtccacacataccactggggggcctagggacagaggaagtgaatacattcttgggtgcgtacatcctatgaagattgaatcaggaagaaatagagaacctggacagaacaatgacaagtaatgagatttaatcagtaataaaaagcctcccaaaaaagcaaagtccagaaatggatggcttcattgccaaattctaccaacgttacaaagaagaattcacaatgagtctcctcaaactatttccaaaaattgaagacgaagaaattctcccaaactcattccatgaggtgagaatttcccaaatgccaaaaccagacaaggatacaacaacaacaaaagatacctacaggccaatgtccctgatgaacacggacacaaaatcagtttatcagaaagataatacaccatgaaaaagtgagatttatcccaaggatgcaaagatggttcaacatatgcaaatccataaacacaatacatcacatcaacagaatgaaaggcaaagaccataggatcatctcaatagatgcagaaagaaagcatttgataaaattcaatgtcccttcatgataaacactctcaacaaacagcacagaatgaacataccttaacataataagggccatatataataagcccacctctaacatcatactgaagggacaaaagctgaaagtctttcttctaagaactggaacaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcgtggtggtgggcgcctgtaatcccagctactcgggaggctgaagcaggagaatggcatgaacccaagaggcggagcttgcagtgagccgggatagcgccactgcagtccagcttgggcaaaagagtgagactccgtctcaaaaaaaaaaaaaaaaaaaaaaaactggaacaaggtaagaatgtccacttttaccacttgtattcaacatagtactggaagtcctagccagagcaatcaaataaaagaaagaaataagtggcatccaaactggaaaagaggatgccaacgtgtccctctttgcggatgacacgatcttttacgtagaaaaacctaaagactccaccaaaaaaaactcttagatctgataaataaatccagtaaacttgcaggatacaaaatcaacatataaaaattagtagcatggctgtacactaataatgaactatctaagaaacaaatcaagaaggaattccatttacaattgctacaaaaaaatgtctaggaataaatttaactgagaaggtgaaagaaaagctacaaaactctgacaaaggaaattttagatgtcacaaattgaagaacatctcatgttcataaattagaagaattaatgtctttaaaatgaccgtactatccaaagtaatctacagattcaatgcaatccttatcaaaataccaatgtcatttttcacaggaatagaaagaatataaaaaagtcatgtggaaccaaaaaaagagcctgagtagccaaagcaaccctaaacaaagaaacaaaataaagctggaggcataacactatctgacttcaaaatatattgcaaggctatagtaaccaaagcagcaggatatttggcataaaaacagacacacagcccaatggaacagaatagagacttgaaaataaatccatgtacttacaaccagctgattttcaacaaaggtgccaagaatatatgttgggaaaaggatggtctcttcaacaaccagtgctaggaaaactggatatccatatgcagggagcgaacctggacccctatctcccaccatatgcaaaagtaaagtcaagatggattaaagaactaaacataagcccccaaactacaaaactactagaagaaaacacagaagcaacacttcaggacattggtctacgtaaagatgttacagctaagacctcaaaaccacaggcaacaaaacaaaaatagacaaataaaattatcttaaactaaaaagcttctccaaagcaaaggaaacaatcaacagagtgaagagacaatttgttgaataagagaaaatattttcaaactatttatctgagaagggacattataatatccagaatacacaaggaattcaaatgtctcaacagtcaaaaaacaaataatcccattaaaaataaagcaaaggacataaatagacatttcttaaaagaagacatacaaatggtcaacaggtatatgaaaaaatgttcactatcactgttcatcagagagtgcaagtgaaaactacagtgagatatcatcttaccccagttaaatggttattactaaaaagacaaaaattaacagatgctgcaaggacatggagaaaaaggaactcttacataccactggtgggaatgtaaattagtatagcaactatggaaaacagtatggcaatttctccaaaaactaaaaataaaacgaccatgtaatccagtaatcccaatagtggttatttatccaaagaaaaggaaatcagcctgttcagaaagataactacaccctcatgtttattgcaggactattcacaataccaaagatatggtggactcaaactaagtgttcatcaacagacaaataaagaaaatatgaaaatacacacaacggaatattattcagtgataaaaaagactaaaactatgtcatttgcaggaaaatgactggaactggaggtcatcataagtgaaataagccagaaagacaaatatcacatattctcagttatacataggtgctagtaaatgtaggtgctagtatatgtaggtgctagttatatgtaggtgctagtaaagtgagtctcattgaggtagagcgtagaatgatagatgccagagtatgggaatgtgggtaggtagggacggaaagggatcaagagagattgcttaatgggtacaaatatacagctaaatagaaggaatacattctaatgtttggtagcagagtcaagtgactacagttaacaacatcttgtatatttccaaatagtcagaagagaggtcttgaaatggccccaacacacagaaatgataaatacattgagtagatgaataccctaaacacatcaacttgaacattacacataccatgcatgtaacaaaatatcacatgtaccccataagtatgtaaacatattgtgtataaagaaaaataaaggtatacagattggtagtaagaaataaaactttctgatctcagatgacagggttcctatgtagaaaatcagaaagaatcaacaacaaaaatatttgaaactaataagtgattatagcaacattacaagaagcaaggttaatatacaaaatcaattgcttccctatgtaccagcaatgaataagtagaatttgaaatcaaaaacacaatgccatttacattggcactccaaaaaattaaatacttaggtataaatctgacaaaatacatactagatctgtattaaaaaaaactacaaaactctaatgaaagaaataaaagaactaagtagatggagacatgttccgtgttcattgataggaagactcaatatagtcaagatgtcagttctttacaacttcacatatagattcaatgcaatcctaatccaaatacaagcaagttattttacagttattaaaaagttgatttaaaattttagagagaggcaaaagacccagaatagtacctgcactcctatgtttattatagtactatttgcaacagcaaagatgtggaatcaatgtaagcgcccatcaatgaatgattagattttctaaaatacagtatgtgtgtatatatgtgtatgtgtgtgtgtatgtatgtatgcatgtatatatgatggaaaattcagacaaaaaaagtaaaaccatgccttgtgcaacaacatggatgaaactgaaggccattatcataagtgaaatggctcagaaacaaagtcaaatactgcatgttctgacatataagtaggagctaaataacgtgtacaccattatcataagtgaaatggctcagaaacaaagtcaaatactgcatgttctgacataaaagtaggagctaaataacgtgtacaccattatcataagtgaaatgtctcagaaacaaagtcaaatactgcatgttctgacatataagtaggagctaaataacgtgtacaccattatcataagtgaaatggctcagaaacaaagtcaaatactgcatgttctgacatataagtaggagctaaataacgtgtacacatggacacacaaagtggaataagaaacagtggagacttggaagtgtgagagggtgggaggtggatgaaggataagaaattacttaatgggtacaatgcacactattggggtgaaggctacactaaaagtccaaattttacaactatacaatatatccatttaacaaagctacacttgtacccttctaaacctataaaaatttaaaaagaaaaaaatattgaaggtgaacaaagttgaaggattgacactaacagactttgagacttaactataaaactacaggaatgaagacagtgtagtagtggtgaaagaacggagaaactgattaatggaaaagaatagagaacccagaaatagacatacataaccatagtcaaccgatttttgacaaagcagcaaaggcaacacaatgaagaaaaatgtcttttcaacaaatggtgctggaacaactgaacatccacatgcaaataattgaatctaggcacggatcttatatccttcacaaaaactaactcaaaatgggtcataagcttaaatgtatattaaaaaactttaaaaccttacttattaggtaaaaggactaaatctatgcaaccttggatatggtcataattttttagatacaatgccaaaggcatgatccatgaaagaaataattgataagctggactttattaaaattataaacttctgctctgcaaaagacaatgtcaggagaataagaagacgaaccacagactgggagaaaatacttgcaaaagatacatatgataatggattgttgtcaaaatatacaaatagctctcaaaactcaaaaataagaaaacaaacaacactttttaaaaagagccaggaccttaacaaatacttcacctcaccaaagaagacatacagatggtaaataagcataggaaaagatgttgcacatcttatgtcactagggaaatgcaaattaaaacaagataccacttcacacctattagagtggccaaaatccagaacactgacaacagcaaatgataataacaatttggaacaacagtaactttttttttttttttttttttttgagacggagtcttgctctatcgcccaggctggagtgcaatggtgcaatctcggctcactgcaaactctgcctcccgggttcatgccattctcctgcctcagcctcctgtgcagctgggactacaggcacccgccaccacatccggcttattttttgtgtttttagtagagatggggtttcaccatgttagccaggatggtctcgatctcctgacctcgtgatccgcccgcctcagcctcccaaagtgctgggattacaggtgtgagccaccgcgcctggcccagtaactttcattctttgctggtgagaatgccaaatgggacagccactttggaagacaggttggcagtttctcataaagataaacatacttttaccatatgatcagcaatcgcactccttggtatccacccaaaggaggtgaagtcttacatccacaaaaaaacctgcacacagatgttaatagcagcttttttcataactgccaaacttggaagcaagcaagatttctttaggtaggtgaacagataaactgtgatacattcacacaatagaattcagtgctaaaaagaaatggctatcaagtcatgaaaagacactgagaaaccttaaatgcatattatgaagtgaaagaagccaatctgaaaagattacatactgtatggttccaactatacgatatcctggataaggcaaaacttacggagatagtgaaaagatcaatggtcgccaagcgttaggggtggggaaggaatgaatagcagcagcatggagaatttttacagaactgaaaatgctctgtgtgatgatgtatcataatgttcgatataaaatggcagatacgtgtcattatacatttgtctaaacccataaaatgtacaataccaagagtgaaccctaatataatataatctatggactttgggtgataatgatgtgtcaatggagtctccattgaactaatggagtctccattaattgaactaatgaagtctccctggatttggaggagaaagattcattgattgtaacaaatgtgctcttctactgggggatgttgatagtgtggaaggctgtgtatgtgtggtggcagagattatatgggaactctctgtaccttcctctcaatttttcagtgaacttgaaatttctatttagaagtagactctttaaagtcattataagaaaaagatacttgcacacgcatgtttatagcagcacaatttacaattgcaaaaatatggaaccagccctaatgcccattaatcaacgagtggataaagaaattttggcgtatatataatcaaaatttctcaatactatgtgtgtgtgtgtgtgtgtgtgtgtgtgtgtgtgtgtatgtatacacacacacacacacacatatacatatacatacacatacacaccgtggactaccactggccataaaaaggaattttgcagtgaactaatggcatttgcggcaacctggatggaactgtagaccattattctaagtgaagtaattcaggaatggaaaaccaaacattttatgttctcactcataagtgggagctaagctttgaggatgcaaaggcataagaatgatacaatggactttggggacttgcagggaaagggagggtgaggaataaaagactaccaattgggtacagtgtatactgctcaggtgatgggtgcaccaaaatctcagaaatcaccactaaagaactgattcttggaggctgagatgggcagatcactggaggtcaggagttcgagaccagcctgggcaacatgatgagaccctatctcgactaaaaacacaaaaattagctgggtgtgattgtgcatgcctgtaatcccagctactcaggaggctgaggcaggagaatcacttaaacctaagaggcagaggttacagtgaaccaagattgtgccactgcactccagcctgggtgaagaatgagactccaactcaaaaaaaaaaaaaaaaaaaaaaaaagaacttatttatgtaaccaaataccacctgttccccaaaaacctatggaaataaaaaataaaaatagtcttaagattaaaaaaaagaatgatgcatagcaatgtgtttaatagccatttatatccacaaataaattaatcaacagtgttcataagttcttgaatatgcaaagaattgctctgaaacatgcaagaagcataaagcaggttaccattagagagaactgagcagctgagagacagggtgcacgtgagactcaccatcttccacataccattttctactatttaagtgtcataccacatacaaaacactaaatgcccattgatctttgacaaagtggcaaaggcaatacaatggagaaaaaatgtcttttcaacaaatgtgctggaacaactgaacatccacatgcaaaaaattgaatctaggcacagatcttatatcctccacaaaaattaactcaaaatagaccaagagcctaaatgtagaatgaaaaactataaaactcctagaaggaaacaggataaaacctatatgaccttggaaacgatctttatttgaaacactaaatgtccattgatttccaatacccagagtgatatttatttgtgggatgcttagttgcctgtgccagaatcggccatttgattcctaactcctctgcaaggaatccactccagtggagccttttaccataccttgtttgcttctcaactcaagcctttcttcatgcttcctgccaactctctgcctacccatgcaccttgacatcctgccaggccttcaataccaggtgcagacacaacctccctggggctttccctgtccattacccccaggatcccactgtttcttgatccacagtcccttcctggcttgtttcctgctgccattctcaagttttcagctaaaatacacatgcctaaattgcatagaccaattgctgtgttcttaatgttgctgtttgatgtgttgaaactttatcatcactatgaaaatatcaagagaaagtatccttgggaggtgatgagatcatgagggctcatgaatgggattaatgcccttataaaagaggcttgtctcccttaccctgctgccatgtgggacacatagaaggagccatctatgaagtccaggccctcaccaggcactgaatgtgctgatgccttaattttggacttccaaacctccagagctgtgagcaataaatttctgtagtttataaattacctggtctaaggtattttgttatggcagctggaatggactaagacactggtcatacacatctctgtaattctacggtgactttctttttgttgttgtttttgagacagtgtctctctctctgtcacccaggctagagggcagtagtgccatctcaactcactgcaacctccacctcctgggctcaagcaattctcctgcctcaacctgccaagtagttgggattacaggcttacaccaccatgcccagttaatttttttttttgagaccgagtttcactcttgttgcccaggctggagtccaatggtacaatctcagctcactgcaacctctgcctccccagtgcaagcgattctcctgctttagcctcccaagtagctgggattacaggcacacaccaccacatctggttaattttgtattttttgtagagatggggtttctccatgttggtcaggctggtcacaaactcccgacctcaggtgatctgcccaccttggcctcccaaagtgctcggattacaggtgtgagccaccatgtccagcctctatggtgacttaaaagtatcaagtgctcagtgaaagagaggatattgatgatttacttctcctgccttcattggtcagctcactcatctgataacctttgggatctggtgtaaattcataccccatagggaactatagggccactcctgctgtgctgagcagagggctggctgggcagggccacctggcctttgagactgcctggtagtctgactctcattgcccgggcccatctcatctgtgctcgcttgccaggaatcccgagggtcctagaatcccagactctacatcctacaagagttggaaattactctttctgctgaatttactctgcaacctagttgcaccacactttcagcctgaaggacacaagggaattcagggagaatgcaagagaaaagaatacatgccagcaatataaccagatctgacaggttagtttaaaaaacaaaatgcaattctgtctggatcagagtgtgtgaatatggcagggtctagaggctgggggctcaggcctggcagaggccagttaggcaggatgccttttccttccttaatcaccactccctcacccacaaacagggcagccaaaaattttaggcaagaatcagactagaggcagaattagaaagtgtcagtaaaatagcagtaggtggtgttgggatgccgacagaccctcactggctcctccagaccacctcacgggaagaaccgaggggggctgaagtctctgtaccctctcctcttctcaagcccccctttcccaggttggggagggtgaaattatttatttggggggtgggttcttttttcttttttccctgcccctcatttgatctcttttggtgcagtgctgctgttaacaaaaaatacagcatgtttgagacaaagtatgcacaattcctcttccagaaaggaggcctttgaagaaaaggcgagtgatcagaataaagagagggagcgggggtggggagggggcgggaggtgagtggggagcccaggctaggagggcaggctttgatctccccacacaggcctgtgccttttgcgttttatttcactgttgggatgaggggagctttttgcaagggcgtgatgtaaatgcttaaggaaaggaggcagggtgcaagctctcaaaactacagatgcagacacaggtgccagggatgcctcctgtctgctcccatggggcatcacccagagcaggttagtaaagggctgccctgggaggaacctcttcccgtgtccacccctccttcctcaaacatccatgctttcacattcctaccacattcactcacactatctcacttacagtcatacacacagtcatcattcacacacacacacacagaattcacactcacatgttatcacacgcagttatcatgcaccctcagaattcagccacacactagctcacacataatctcacagtcgtacttacattcagaattcacactcacacacactaacaggcacacactcagaattcacacacactaactcacagtcatacacagtcagaattcacagtctcacacatacacactcaccattaacctacacacactatctcacactcatacacactcaattcacacaccactgtctcacagtcgtacacatattcgacgttcacactcacacacactgtcaaacacacactcagaattcatacttacacattatctcagtcatacacactaacacactcaacatttacaatctcacactctgaattcacactccaaattcacactcagccatagacactcatcattcacactcagtctcacacacaggcatacacatacccaacattcacatttagtctcacagtcatatatgcacaccattcacacacactatcttgatagacatacacactcagaattcacattcatacacattatgtcagtaatacacacacatgttcacatcccttgcacactattacctcatactcagtcatacccatgtacccattcacacattcacacacactcacattatctcagttattcacacactcgtaagttcacttgcccactcatcccatctcacacacactcaccctaacacacagttctacacacacacgtttacagacccccacactcatccacactctctcacacacacacaatctcacatccatactcacatattcatacccacacacactatctgacatatgtttgcacacacactacccacattcacacactaacatacacatgcacgggggatcagttctgacaaggttgtctgcaacacaatcaacaggggcttccatatgactccttcactagggtctctggcatgttcctccttccaactcccaggaccctgccccgcagcatccctgcccagcctgcccatttcctgtaggccctaagcctccattcaggtcaagtttcctcactgcccctgctctggagcttctccccacctccccttacatgcctgcccacagctggctacaataataccctaagccgaggcagtaacagctaataacagcttcacaagcagaagatcttggtgagatcttaactcaaagtgagacaggccttagtgccttggattgcagccacagtggtggagcaccaggcctcaggagcagagtgatgccgagatggctgcaggaagaggaatgtgggcgagtttctgcctttcaaatcatgtcaagcattccatcagtcatgaccttggccatggaagggtgactccactggacgcccccttgggaattttcagacttgtgaaagaaggatcccaaccaccagacctaggagggatctcatccatgctcgctccaccagaagaggttgcaggttgtgcccagaagatctcttacctccagagactccacacaacagaaagcattcccttgaccccctaacctttcagagaataagtatttgctaagatgctgcatgtactagggcagagccaggcatacagaccactttgcattctcctgttggacttcaaactatgctggataggtagtacatgtcctcagcacatggggcatgcaagaccaaaaaataatactctcccatcctttagctgtaactgtctcacacagaccaaacttagaccaacagggctctgtgcccccatccagttagcactaccggactgctcttaggacagtgccttgtctttggcctgccaagttctaggtcaccctctctcccctggtctcatcctgcatagacagcctttgagtcacatttactctttccttcccatccttaagaagactcagcccttgtcctcgggatgcctcagggtagaaaataaagcagagtggatacggactccagcttcaccccccaccacacttactagcccttggcaagttaatcgcctgccgccacgctcagttttatttactgtaaagtgagcgtgtaactctcaaatttagaactccagcacatacctttcccttgaatggtagaaggctatatccagtgctacttgacatctctgcttgaatatcaagtaggagtctcaaacttagcaggttgaagctcaacttctgatttcccactccaaaccaggcctctcctggtctccctgtctgagtgaacatcagctccatcctcctgcttgctcaagccacagttctcagatttgtccttcctgcccaataacccagtctcccaggattatcttcaaaatgtatcaaggaaactactacttcccaactaaatctccaccaccttgctccaagctaccaactcctctactgcatcagctcctggcttatctctaagcttccctagctcccagtgtacagctgcaggaaggttgtggagtgatcctactataatgtaagtcatttgcacccctcaaatcctgtaaagggtctccgtctcactcaaagtaaaagccaaaacattccctggagcctacaaggcctcacaggctctgccctcacagtttggctcccattcaagcctcatctcactggtcctctctgcccagactacaccagcctaactctattctttgaactgaccacgcaccctccagattcaagccctttgcctttgtagtaccgtctacctgcaaagcctttaccccagatatacatgtgaggacacatccctcacctgctccatgactttgctcaaatgttaccttctcagcgagaacttctctaaccccagccctggcacttcctctctgacctccctatttcatctttctccatggtccttattgccatctagcctattatcttccttttacttatttatttattgtctgtctccctttgcttgcactgatccttatgagggcacagtgtttagtttcagacagatccccagagatgagaacagttcccaacacggagcacacagtaagcctttgttgaatgaattgttgaaggaatgcatgaatgtgtagggggtgaatgagtgatattgattaaatactccctaggtatcaggcattgtgaaagtgctttccaggtattaaccccttctatcttcaccctgactgagaggcaggcgtttttgtgatccccatgacataagagcaggagcctgtcatgacttgctgggaagaacaaatgaggtcatgtatccaaagtacaaggttctcagtaagctctcaataaatgctgacaattgctactatgatcaacatcatccaagtcatccacacccctgtactgagcccttccctcatggccatcactgttctgggcatgaggggttgacgctggggttggttggagaagaagcaaggcctacttgaaaagggcccccaaatcagctcaggtgagggcctctaactctgggaggagcataccccacaccacttcaggtgcttgagacagttgctctgtgcccagatagatgggcaagcattcaggctaagtccccagtgggatggacaaacccaccagcacaggcctaggggagcaggccactttgaagctgtcgagatggggaggatcctgtatgtttgtgtgagctaaccggcccttccactaaccccgcccctgtcagcctcccctcctcgtgtgactccagaggaagagtcccttgccctggcctggcctctggttcctcacctgaaaaggtgaaggggattgtaccgcagcatcccaactatctccttcagcaccgagtggctgtctgactcctccggtcagaggtaccagaataggctaaatatccccagcagctgccatcccagcgggtgggatgagagcgagcctgagctctgctcccttgatctcctctgcgtctctgctggatggcaggggtgagctggagcttccctggaggctgccacatgctggactcccccaaagtgctgactcctgagcctctctgctcgttttctatgcattgaacttcaaacaccagagaggcactcaggcagcaagacgggtggatttggccattatgttctcgctctcctttttcccttcatctccctcaagacaggattatgggttgcacctattaattcttgtctggaagcagcaagccaaccttttctctttgtggagttttataaccttctctgctgcaatggaggaggctacgagccattcctctcacccaagcagcatctggcagaaggagtgtcctctgagttaactagctaaggacacagctgtatgaggcaccaggccttctccccaaggagaggaggggaaggtgtgtgtgtctggcatataggagcctccaaagggaagacacctggaaatctcccttccttgatctgtttcccaaggacaaacacagaaatcaaaataaaactgtgtccagtgaactcatttattcattcatctgcttttgacgaagtgcctcctaagtgccaggcactgtgctaggctccagggtacagagataaacttcacagcctggaagcatataattggacaacaatcagtgaaattagcacttttaatgctctgatagtggaaagcacagaggacaccaagctctgttcggagagtggggcaggaagggccagtttctgccagtcttgggggagaaggatagtggcgacagtaccacaccctgctcagagccaaggaatgctgataaacagaagctatgcctgcctgggtggactttggaaggttaagtagagggaataaaatatacacaggttaggccacttaaaagacaaagtacatttctccaatcacatgtatttccatatggccaaaaagaaccgtttctatggggaagaagtgagagatgatcaaagagaggagtgggaccttgcacatcatgctaaggagtctggattttctcccagagagcctgggatgccaccgaaagatatgatgtaagggtgtgacatgatcaggtttgtgctttagaaagaggactcccattgcaaggaggagagatggaattgtggttgggaagtcatccaagactgaggatgagagaagaatccatgcagacggttgttacagtaatgatgggtgccgggggtagggggtggtctgggagtggagcatgtttagaaggtggaatttgcaggtcttggaaatgattccatgatagaggtaagaggaagggaagataaaagaaaaggagggggtaatcctcaattactcattttggtgactgggtggatgacaatgacatttgctgaataaaaatattcagtgtgagaagcagatttgcaagggagaaatgacaggctcactttcagagcggttgagtctccagtgcttgcgagctgcaaaagagaggaagctgagaaagcagctccaggaagtggctccacagcacaggagcgaggcctggcagggacagcctgacatgtggttggcaggggccacccaaagccctaggggtagatgcaatctcccttagaactttcgtagagtagaaagagaagcaggcaaggattcaagcaggaaatatccataatgaattagaaagatattagaaaggtccacaactggaccacaactttcttaagagcaaggactgagcctgggaccctcatttaaatagccacgttcctggatcagagagtgctggagtcatagcttaatgacaatacagggtctaagaatacatttaatagagaaaaagagaagagagaaatcctttctaattaattatggccatttcctgcgtaaatccttgtgggccccccacaggagagttaaacacctccaagtccaaaaagaaagactcagtcatggggctgtgcctgtactggctacctggcttctggaagctcttaggagggaaatgttcatcagatgggttcttttggggcctctgcagtcatcatcgtcctctcagcagagctactgcaggctcattgctaccccagggttccatgaccaaatgtgatgcaggctatcttagacagagcctccatttacttcccatgttaggagtaggcagtgctccagtgctgagaaatgaacacttccttttacctgacagcatccccgtgacccagacctgctctccagttcacctttgtatcctgcctagatccctgtaccaagttcctgttctgatacactatcttttccttgtgtgtttcttaggattccagttagcctttgcatgccactcagtcctagccctgggggagaagactagtggctagggtgccacactctgcaagcaactcaggagggtatttgaggctgactgcctgcaggttggttatctgggtttcatccctcctggaagtgtgttcctaagcttcatccttttgcgagaatgccttgatgcagtctgcacactggcttgccggtgaggttgaaaccctgttcccaccaacagaatccaggggccagtggccaggcttttttctgtctgccccaattgtaattaatctgtcccacctctgccctggctccaatacttggctatgatattagatatccatctgcctctcatgcctacagacttttgcctctgtccatccagagctgaccagttcccactgcactttcttgatacacagcagtcacttaataaggctgcttggtggcaatgaaggatacaatggggggccagtgaccttgctgagggactggctcagttggaggcaggaccatgaaactgggctttcctgctccactttctttctcccttgattcctgccttctgccaatcctcttaaaacagcaaaaaccctattctttcttctctttttctctaataaatgtgttcttagacacaataaatgggttcttagaactcttaaggttcttaaacaaccttaacgttgttattaagttgtgactcgagcactctctgatccaggaacgtggctacttaagtgaggatcctggctcagtccttcctctagagaaagttgtggtccagttgggagaagggttcccaggtcacccaagcagtcggcagaagagccaatgcctgtctctaagccgtgtatgttcagctccctcactgaagacctctcaagggaaggaaagccaacagccattcatcgagcatttattgtgagtaccagaccctgcacaggagtttgaactaggagtggctctcagttaatcttcatcacaagtttacgaagtccaaacgcccatttcacaggtgaggaaagagcatgagaagagacgaagacacaggaaatggggatggggacatggggaatagtaacagcttagtctggcaagtgttagtggggtagccctggatcttgggaacatgcctccctcttttgtccttgactttctcatctgagtatgagagagctggacttaatgacctctgagttctattccagttctttttcactctcagagtaatgcatgatccccaggaaagtcccctccactggaggaggatgtccaaaacattcctgttggaccacagttctctctggggaagcaacctgggcttcactttcccgtggctgcccagtctcacccacaacatggcagcaccaagattttaagacagggtcctgtgggacttgcaacaaagcaccagatgagagattcagcctgcatacatcctaggagatttgcctgggctgcatgctccaggttttgggctaggacaggggagaaggtgaaactaagggcgggtttggaaggaggagtcaaaccacaaagaaaatcctacaggctttcttctgggaatgttctctgtggtctgggagtacaggcagttctagagtcttcccaagagaaaacatacttgttatccccctttcaagaaagcaaagacatgcaccttcagaattcacagatcttgttgtctttttgccccccagtggaatccaggcgatcccctgcgatgattctcaagctctaatttgagcagctggacctcttgaactctggtatgtggaagtggagctgcttgccagcctttagagaagggtgcagcagagattcgccctccctcagttcacacccactttgttccagggtggggcgtccattgcaaacgacaaaaccaacaagacaaaatacaatcacgggcagtacaactcaactcgctcaaacaaccaggaattttacaatctcacagcatggaaaatccaaagacaggtggctctgttgacttcacgtcctcacaggatgaggctgttctttgttttgtttctgatgctctgccacattcagaatgttcaagatgagggtaacttctccaggtctctcccatcggggtcacaagacagctgccattcactgagaaagacatggagtcgttcattcttgccatctttttaaaaaacagaacttccccgggagctctccaacccctgcagccctcatcggcccgggatgcttgacacacacaagttatgccttgccaaaacccatcgtctgcactcaggacagggtacggctgtgcagccctgaatgagataactaagtggagaatggtggatgtctaaactcagtgcaggctcagttaggaaaggagaaggctttcctgcccaggatctggtactcacaataaatgctcgatgaatggctgttggctctccttcccttgagaggtcttcagtgagggagacgaacatacgtggcttagaggcaggaaagggtgtgaattgcacagacaaatggcatcatgcgctaaagagggcccagcttccctaggcccggcggacttggcttctcacctggctctccaactaactggtgctcatctgcttggctttccaccaaccaattgccttttttctctttcatccagccagcctcgggacaaaatccaaatgttggtcaaagtcctttttctcccaggtagggagactgtgagcctgggctccagccagagaggatgtgctgctgtccagggcccacaggaaggctgcacggttcatgcatcctggtgtccccatgagaatgcatctcattgcccaggtgctcaaggctgccaggctggaggagtgcacatgatggtgaagacgaccttggtcactggagctttccacatgtggacactatgcatatagtatcatgcgttcctccattctagctgtgtgactttgggcaagtaactgagtatctccactacctcaatttccttataaatatatataatgtgtgtatatatatatgtgtgtgtatgtgtgtataatttatgtaactatgtatataatagtagcaacctcataggagcatgtaagaattatctgggttcctacatgtaaaactgtcagcacagagtaagttctcaagaaatgggagctcgtcaccatcaccgcccttgtcatcaacatcatcacggttatacagaagacattcatcacagtctcacgatgccaaagcaggctgccttcaagtgaagagtctagaatggcagactcccagtaagcttcaccaccgaggcctcagacactgctgacctcctggggatagaggggatggactcaggctctgaccctccttgccccagaagctccaatggtgggaggaggaacacccctggagctgataaactgggtgactcctcagagccttgcatcttgtgggctcatgacgtcaatcatgctgccccacccacagcccttcctccctccccacacctgacatgcgtacagacactcctcatgaccctcccttctgccctttgcacccttccattgctctaccctctcacgaggctgactgtcggtagctgcgctggaagcaaccacagggcaagggaggcatctctaggctatttgcctccagctccaggagcagccctggaaagacaagcgagggggtgagagtgggggagagctgattctttgtacttcctcacacaggaacatcaggaagcccatatggtgctaccgtctggctgagtttaggggcgggagagctgggaggacagcgcaatgccccctgcagtggctcggaaggaagaagtcagtgatgtgtgcgggtttgataggatggcgccatgtgtgttcaacacacagtctggggccacggccggcacattctcccttaaaaataccctgcttagctaaattacctctgctttctgaaaatgcagctcctccagctggactttctctctgtccctccctctctgcacactcgtctaccctgcgttctccgtactcttccctctgtttccacacacatccatcctccttcccttttccctccgtgtctggctttccctccctctgggcaatcccacattttctctcccagacacctccccttgctctccgtggggcctcttctccctagtgaagctcctgtcagccctgctatctgggttcactccagcccagcccagcctagctcaggcctactggacccagcccccactgccctcttcaactccccaccctggggtcttccctctagaaatcaggttcaccagcatcgcatagcccattgactgccaccaaacgctcagtggaaggagtgattgataagaggcgctgcacagggaggtgagggcaacaaggctcagctctgagcccagaggccccctcccctctgcaggatgtgaacggagccaggcagagagcagacgcgcggacatgcgcataggcattgcggcaaggaggctggaaaaaatggggagggggcacccataataccacacgggagccccagaggagaggacggctcctggggtgcatgagagcaacctgctcacaaggacaagaacccggaacagggaaccagcctggcaggtgaagaggctatgagcggtgatggttctggcccgacaacagtggtggtagcagtgagaaggtagggagagcacaggccaaggggagataaatagcccaggtgttagattgagggtgacatcagtgggcagaggaggcatggccacattttccagtccaggattgggaggaagcacctgtgagcttgatatttttagcatttaagacttgaatacgttaaattcagagcaaaatggtcaagtcagccacatgtgcccttagcaacctcctgtccatcttctgcagcttcagccttgccctgagggaagtgtgggtcatatcacctgggagaggggaatacaaggagccttaaagggcccccagtcctgcaagacaaaagagctatatgccatccactgcaggaacaggaacttaagagaaaatggcatcttccagggaagtcacaagggctacaaaagcagagtcctgttgcaggagagggtagccagccagccctggggaccatgactaggaaacagttttatttttctaacaaatgtccctccacacttctctctcagagccccgactctctcactgggcagcagcttcctgaatggcatcttggcctaattccatcacctaccagccactttcatttattagaacagtatcacagtggtccttaagacttggtcttgttcattttaaaacttcaatctcaaactcagatcaaagctcccctcctgtggctatagcagcctggtgtgtgtgtgtgtgtgtgtgtgtgtgtgtgtgtgtgtgtgtgtgtgtgtgtgtgtgtgtgtgttagggatgaagaggattgtgttgctagattttgcaaataaaaatatagggtgcctggtgaaatttgaatttctgatgaatattgaatattgaatgaaaatatccaaatgcatttttagggtatttcctaggcaatatttaggacatatttatgctgaaacatattcattgttatctgaaattcaccttgaactgggcatcctgtattttacccggggaccctggggtgagactccagggcatccctggacatccctgcctgttctcagccccagggatggcctcagcagagacacacccagctggcaggcatccttcaggggctgcccttgagtctccggctatcacccacctccctctgtgcagcgggcatcaccatgccagctcccagggggtacacactgtggtgccgtggacccagctccactgccccattcccccagggggaggcttcagttctgctcaagctctgccatcccctctcacctcctgctgccaaatctctgctgctagatctctgctgctgaccccacctgtctagggtggggaactccagagactccatcatccttatcagttggggaaaccacaggccatctctctctcatgctgtttctgcctgtttgtgtcacaaagggacagatcagccagcctgcaggataggcagacactggctgggcacacaatgcctgtcttgcctcttcgtagaaaccctggtctatatgagtgactctctcacagcttccctctctcatcatagaggaaaaaaatcattttcctcttccccagtcaacttcccttctcaccgtcttccccttgcatgaactagggaggcagaggtgggcacagtggaggcatcagttccagctccacggtaagccctgcgcgattctgctggcccagctgcagggactccctgcacctagaaggtggggaacttagtgttctctgtgctgagatttgggccttagtccccattcccggacagcaggagaatcccacttgacatcttgttgccatcaatgtcattcctgtctaaagccaggaagaggaaggaggtgtggctcacaggagaagttgcagggcagggggtcagagggtcagggctctggtggtcatcagctgtttgatggggaggaggatgctctccctttcagccctcagtgttaccttctgttagatgaaggactggcctgggttttctcttccagcacttgtcctgtgttactgtaattgcagaagtggggcaggaagagaaggccaaggggacccttctcagtcaggacatagaaattgaagggtcaaaaatcatatcctcacttccagtaaccatccttccctgagaagaggccatcattaccctctccacacatcatccttctaacttttgtgcacccaggaaatgggaacagagaggagtggggtcaaaggagagagagcagagggctgagcccccaggacgggtaggcagagaccaaagcgccttaagctgggggcagcagacttcaccccaccagcagagccgagcacctaatgtgtggtagacttttcacttatattctatgaagtaggaaaataatttgcaagctcctggttaatcctcaccattgccatgtgaggtgatattatccatttctacagcaaagaaactggtatgtgtttacctcaaagtgcatatcattttggttccaaggcacactttttcaccttttataacatttttttcctcctactccatcctttagggaagaaaccaggcattatttaatcaatgatctatattacagtgaggctccagactatctgcctgcctacaaagactgtgctatttcgatatcactatatggcattgccattgcctccatcagcacagagtaaaggtgaaggtaggtgtgccctctcaactcagggctcctcccaatcatggctcctgctgtgaactgaatgtctgtccctataaaattcatatgttgaaatcccagcccccaaggagatgttattaggagagagggcctttgggaggtcattaggccatgagggtggagccctcataaatgatattagtgtccttataaaaaagaccccagagagctcccttgccattttggccatatgaggactcaccaagaaggcactgactatgaagcagaaagtggatcttcatgagacatggaatctgccggtgccttcaccttggacttcccaaccttcagaactgtgagaaatacattcctattgtttgtaagccacccagtctatggcatgtgttataacagcataaaaagactaaacagctcctgagcagacagcctcagatgacccaggcctggcatttagccagcagccgccagaacttctccatcttttctttttaaagactagtgtttattctgatgggtggatatccatgctgagccaattgttaaatattgtcatcataatccatggccctaccatctgtgccaaggtctcaccagcaggttaatgcataaaatgagccctgttaagcacatggaactgtgctaggccctgatctgaaggctgaggagtccaagattaaagcaccagcttatcctggggctggagagggctcatttctcatagacggcaccttctgactgcttccgcacatgatagaagaggtcaacaggatccctgagttctcttttataagggctctaatcccattcctgagggttccaccttcactacttgttacctcctaaagtctctacctctcaataacatcccattaaaaattaggtttcattataagaatattggaaagacataaacattcagggcatagcaataggaagctgatctgagaccaagtgcctcaatatgagatgatgcctccaagctcatttccatttctttagaataaataaaaaccaacaagcctttttcccccgagggcttgcaatgtactaggtgtttttaatacatttcatctaatttaatcatcaatattaactcagcatagattaagtgtccaataatgtaggagaatcagaggactgagaaaagtccagggcgtggattttgctgtcaaggaacacccagctgtaatgattcgaaactagatgtgccttgcagaagtgagaaaaggcttggttttacaatcatacagacctgagctcacatctcagccttgccactcaccacctgagctcagacaagtcccaacttgagtctcagctaccctatctataaaaataaaacaaacaaaaaaaacagaaaaaaacaaaaaaacagaccctgagatctatcttggagggtggttgagggttgagtaaattaagatgcgttgaagtacctagcacagcatctcacatagcagatgtgtcatcatcattagctgggttgcagtttcttttcttttttttcttatatgaatttatttcatttgataggatttttatcccatctatgatgacaaatatttttcaacagccttttactgtatcttttaattaattttagagacagggtcttgctctgttgcccaggctggagtgcagtggtgtgatcatggctcactgcagcctcgacctcctggcctcaagcgatcctcccacctcagcctcccaagtagctaagacaaaaggtgcatgtgaccatgtctggctaattttttattgttttttttttctagaggcatgatctcactcttttgctcaagctggtcatgaactcctggactcaagtgattctcccacctcagactcccaaagctctgggatcacaggtgtgctgtatgtttttaaaataaacgttttattttagaatggttttagacttacaaaaatattggaaaaacaatacagaactcccatttactccacacccagtttcccctattattaaaatcttatagtccattaatcataactagtgaaccaatattgatacattattactaaccaaagtccaccattaattcagatttcattagtttttacctaatgtcctggtttttctggtattaccccatccaggacaccacattacacttaatcatcacatcttcttaggcctttcttgactgtgacaatttctcagactttcctcgtttttgatgttctgaacagttttgagaaatactggtcagatattttcaagaatgttcttcaactgaaatttttctaatgttttcttcatgatcagagtgagggtatgagtttgggggtggaagatcacagctgaagagccattcttggcacaccctatcaagggtacacacaattgatgtgtgtaccttatccctctcagtgttgacctcgacgcaaggctgaggagtgtggtccaagtttctccactgtcaagctactctttttcctcctttgtcgttagccacatttcccccatttgcagaagacaggacttacccagatgaaacaaacagccaatagtgtaagataatacatgtggaagtctaaagcaagcaataggaagccactaaattcaaggaggaaaagctggacagagttaatgggctctgacaaagccccactggggaaagatgccttaaactggggtagtcatggcaaggtcaatagtgtttggcgtggaggttgggaatggggaaagcaccctaggtaaggggaatggcaggcgcaaaggcaggagcatgaatgagcatgcgcgtcttgggccagtcggtggcggcgccacctcactgtggttggagaaagtgatctgggaatagtcaaggctgcgtggaggcactgtgtgattcagaaatatgaagacgcatcctcttaaggagtggtctccagcctttttggcaccaggaaccagttttgtgaaaggtgatttttccacagacagggtgggagtagagagggatggtttcaggatgattctagcatattacatttattgtgcattttatttcattatgactacattataatatattataatatataatgaaataatgacacaactggccataatgtaaaatcagtgggagccctgagcttgttttcctgcaactagacagtcccatcttggggtggggagacagtgacagatcatcaggcattcgattctcataaggaatgtgcagcctagatccctcacacgcacagttcgtaatagggttcgtgctcttatgagaatctaatgctgctgctgacctcacaggaggcggagctcaggcggtaatgccagcgatagggagcaactgtaaatacagatgaagcttcactcacatgcccgtggctcacctcttgctgtgcggcccagttcctaacaggccacagacctgcacccacctcctgctgtgcagcccagttcctaacaggccacagacctgcacccacctcctgctgtggagcccagttcctaacaggccacagactggcaccactctgtggcctgaggattggggacccctgctcttaaatattctttgagcctattcattccacaagagagcagagctaaaactagattcaacaagcaggagaacaaagggagctgcaggactcagcccctctgcccacctccacaagagattctagcccagtccctctgcctagaccgcagccctacccaaagtcacaggaggctccttgtgccaagatcttgtagcggcaaagaaaggcaaagaggtcaagtccttgcacacccagccaactgcttcctcctatgcatgtacatgtttgtagttacagaggtctgtgccctcacccaatattccccatgggtttacagacatgttcacacgtgggtgcaagctgatctccattgtcagtacacagatgcccatgaataatgccgtggatatacacatgtgtgttgcacaagctacacaagctaaagctggtaacccaaccctgaagaccctcacgagctgctgtgggggatcttggcaaccacccttccttgccagccaggtcctcactgctggagcaggtaagcttattcatcttagtttcctacatcttcacctccatcagctgcttcgctaccctggatgggccaagcacggggactggactacagtgcaagctttttcgagggaagttgcagaagagaatgccagtaaataatctctgactggctcaaagtgctgataaccagtttatggggagaaaatgtgctgcttgtagtctccgggaactgagtttctagttcatttccatctgcgtgggaggggaatgcagggactactggagggtgggtgatgttggtttaaaaaaatgaaaatccatttctttttcctttgtcctgtggtccaacaaggcagagccttgcagtctacaaggagggggtgtgagtggcctctggctacatggcagggcagggagaagcaagaggacaggaccgaaggctccccactctgcaccaggatgggcacagcccaggatggaagggacttgctgaggccaggcacagccaagctttggagtcgcacagagggctgaattcaaaccctagctctttcactgctaccttgttgagcttgggcatcttaagtaatcactctcagcctgggagtctttcatacatggtaggcggtacagaagaatggttaagagcatcaatgctggagttacctgcctgggtttgattacaagctctgcctctttctcaactggttgtctggagaaagttgcacacctttcctgtgcttcatttttgtcatctggaaaatgcctcgttataaaattactcaataaatgttaactgtttatgaaacagtttacctgcaataaaaacaactttaagaaaaaaagggttgaaaacgatttactctcagaatatgggtactccaaggatcacctttctttaggagaggagggtcaacagtaaaatggttggcctagatgacctcatgaagttactcagtttgtccatgtgtttgaataatggacaccacttggtaaaagaaatgttctagacactttaattcacaccaccatcctgccacggtagtatgcattgagctttgagagatattgactcctgccttctagacactggccacttaagaaatagagccacagaaaatcacaatatcagccgtattaatggtcaggctgagttggacttggacctgggaccagaatggagtctcttgttagttcttcctatccaataaaactatgtcttccctgaagactcttggccagtctcttagggccccacagcagcaggcaaaggatccccagacatgtgcaagcagggagaccctgggcaggggaccaggtggctcattgcatgggaacaggggtcaaaaaaagagaatgggtttctttattgagaaagctgaactcaaaagggggaggttggtcatacattgagcatcagtctttctcctaatctctctatccaggggaacagtaagtgtagacagaaaaatcaatggtatatttccaatcctgtatcctcctgagaaactatgcaagctgacagtcaatgtctgtcctaaaaacgtggctattctctgtcgacgatgtggagagtggtattcagagaggtcaaaggacttgtctaggaacatcagactggcagagctaatgttgaaacccaaccacaaatgccttgctcttctccttaccccactgcatgtcctggatcatgctgggtctgcatgctcatccggactctttccagcggtccctagctgctcatcagaatagcctgagtctcttcctcccaggcccaccggctgttgcttggcttgtctgcactccacactgtcaggaggcgacattcatagacagtgatgactaaccatcctaacaaatggtacagagagtaagtgctaaaagcgttcaaaaatagcccagaaagccctgggcacacaccaaaagggcagaatgacactctgagtatttcaaagagggagacacaaggaatgccagtgctgagctggagtgaccctttcccacaccacaaggcttgcaggagctgctgaggccagtgtggagtgcagggccacagaagggccctctgcctgcctctgtgtgtgtgtgtgtgtgtgtatgtgtgtgtgtgtaacaagcagcctttagcaggaagatgctgcccagatagaggccttcctggattcaaatacaatgaagggcctgaccctgcttgtgtctaagctcatgaaggaaatcctgctgctgtgagattggacagctatgtgatggtaaaagcaagggagtacagagggagagcaggcaaccaagggaacgaagtcaaggcaggaatgactaaagaggtgatccttgatttcaatccccttgatgggcaggggctcacagggcctttgtgcagctcagacaaccccagctgacagtggggtctccttcagagctgtgggtgtgccctggagtgcaggtgcagagacaagactccagagcagagaacagcccaagtgtgagagatctaagggaatcagaaaccaaaagtcaggtttaaggcagatagtggaaaccggagcaaaaccaaggagtggaaaagcccaggagagggaaatgggaagagctgttctaggaaaaaatctaaataaggcatacaattttttgttgcatagaactgtcctaggcattgcagccttgggccccacattgagagaaccaaagtcctctcacaaatttgccaactatcagtagtgcctcccctgaggatcaatgtctgatccatgggaattctgataacacaattaccatacttcaccacactgggttcaacaccactgtcaaagatagggccctggagctcgcattttccctaagaacgtagcctaatatatggggaatgtgctaggctcagctaattacactttggttttttatttattttttacagatgggatcttgctttgtacagtattgtgatcataactctctgcagttttgaactcctggcctcaagcgattgttctgcctcaacctcccaactagatgagactacaggcacacaccaccaggcccagcctaactgcactttgatgctaactgactctccatattcataccttctagcttctccatccctcctgatcttgaacatgtaaacaatggcaggtggaaacgccctcctggctttcctgtgactaaaggttttcactgccactgctgctcaccatgctaggggcacctgcctcgctctttgagaaagaaacctgacatccagtgttcttcctcattcctgcctcttggatcctcgagatttcaaaggtgagaaatcttctctgagctctctataagcaggcttctgattaaattggagaagttaggcgatgaacaccaatacaaagattttcatattttttattataaatagcccaaatatttggtcccatttccagtttaaatgggtaaaccataatattgatggttttcaacagatggaagatgaattgagcttctctaccagctagctgaaccacttttaatggggaatatatcgaagctataaattcctgcagacagtattgctatgcaatagcataatatatcttctattcaatcttttatacattatgttttgtcctgcattccagtggatatatttatggatctgaagctttgccatgaagaggcaccatgcacctcctcattcccatctctcaacatttccatggcctctggagatagtcctctcttgttcttgttctatgtaaaagacctggagtctgacccctttgtccccatgggtaagttttatctctgggaacgaagctttgtggccccaaacgtttctgggaccttagtgctcactgagaggtagagacgctatggaaaatgaatggatgcttgtaagtaggagagctgaccccttgccctctctcctgacacagcagttggggacctctggctctagacacatttttatatcacaggtagagaaggctagaatgctattgccacagtctatttttttggtggtggcggtttctcctatgagacaaatcaagacctagcagtagttcctataaactaagtctctctgtcaccagccccacccctcagaactggatgggaccaaaatgcggcagacagcacagtcagagggaagagcagctaactcaagccagagtcttggagacagcttgatccaggtctgcctttgctacttcccagctgtgtgacatgggcgttatccaaaacctcagttctcttattcacaacaaggataacagtacttctagtggtgtgctggtaaatattcaatgcccctattgtgtttattgcctttgtttttactgtaatctatttcattgtaagtttatataattttatttttagtaacaggtttaacaagtgactcacagcatttctgaaatttaacggtcagctctcccgagctggccccagcacagactctgcatcccacagagtgtggctgtgaaggaccagtcactgagggctcacacgtatgcactaaggcctggcaaccttagcgacaatgagaataattttgtcaaccttaaaaatgatattatcaaccttaataataagagtggggagagggccaggcatggtggctcacacctgtaatcccagcactttgggaggccgaggcagatgaatcacctgaggttgggagtttgagaccagtctgaccaacatggagaaatcccatctctactaaaaatacaaaattagtggggcgtggtggcacatgcctgtaatctcagctactagggaggctgaggcaggagaactgcttgaacctgggaggtggaggttgcagtaagctgagatcaagccattgcactctggcttgggcaacaagagtgaaactccatttcaaaaaaaaaaaaaagagagtggggagaaggggaagggagaaagagggggaagtgggtactgggagatgatttagaccactgtcagcactgagggaagccagtgacctcatccttttccagtcagaacatcaccgggtagcttcctcatttggcttccgcttaccgcactgggaattctccaaacgtcatacacagctattttcaaatgccagggcgaggcatacgtcccaatgctaaattgaagtgatgtttgtatttctcatcagtacctgatccactgttcccttctctctgcataaaacaggagttgactgtgagcagagctgcacaaccagcttcactgttcccaggtagaccccgagtgattacagactggatgacaaggacgaatgaatgaagcttttctcctctggtacagtgtgactggtatgaacacctaccttgtagggttgttgtgaggattaattgagataatccatgtaaagtgattagcccgatgaatgtttgctgttgctcttctccttgggcctgaggaaacctaatctaatggtataggtgtagggcagccattctgacatggtgattaggtgttctggcaagcttttatcttccctgcactgtgaacccgagagattccacctggccccctttctggacttcctattattttcactgtatttgttaacagaaataaaaattccctgacctagaaatttaaagagtcatgagtttcccacatgacattcataaaaagagactggatggctctccccacaaagaagtcaaccaatcctagaagcttcaggctcgccaaaaaatcagagatggtcattgactctccctcctcctccggtcctcctcctcccctacacttctcctctcctcccctcctcttcctcctcctccccctcctcccttccccttttcctcctcctctccttcctcctcctccttctctccctcttcccctcttcctttttctcctctcctcccttcctcccctcattttcttcctcctccccttcctctcctcctctccctcttccccattctcctctcctccccaccttctttttctcttcctcctcctctcctcttccttattcccttcttctcctcctcctccttttcccctcctcctcctcctcctcctcttccttttcccctcctcttcccctcctcctctttctcttccttctccagagattaagaggaaaagcacaaggtctggagtcagaggccctggtctgacaacagctcagcaactcttggccaggggggctggagaaaccacctcagccctctgagcctcagtgccctcaattggaaaatgggaacagtcattcctaactcagagggctgctttaaggactgatttaaaagactttgtaaactgaaccctgctccacctgggttcatggctattgttagtgtagcaacctgtgtcttacaaagcagttcaaatccattatctcctctcaagtttatatccctaaaggaggtgcagaaaatggtggttttgaaggagttgcatggagctgctgggttggagcaaaagcttcactccgggctgaagcaggaagtacttgggaacaatagggtgaagccagcctaagagtttaggctccacagtgctggtaatgggatgcgtaggagattggagcagagcagtgacaggtaattgaatttgctgaatctcgtggagttgacttgttcttgtctccattccctcaagtaaagtcagccagttcttggggtttaacaaccatctgtctctctcccacacagaggtaacaggatactggaagagacttttcctggtaccccagaattgacaaccagaacccctatctggcaacaaaaaggcactgagaatgccatgttctaaagagagcctccacagaaagacaaataccgcacatcctgattcataagtgggagctaaataacgtgtacacacggatgcagagagtgggttgatggacgacagagactcaatcagaagggtgagggggtgaagggatggctgatgacaaattacttaataggtacagtgtatcttattcaggtgatggataccctaacaggagtgacttgacaactacacaatctacgcatgcaacaaaactgcacatgtacctcccataaaatgatacaaatacatatataaagaaagctttcaaagttagactcggaccctacttccacccagatgtagtgcaaggtggcagagtaggctctactgccaccagccactcccaaccccccgcgtcccttcccttcctccagtctctgtagggtaaccgtggctggagagagagtatctttggagctctcagttactgaggtgcacagttgtacagtagcctttttatcccctccagtgaggggttaggatccaaggggagcactggctgagactgactgtgattgtagacacagcacctgctgctgagacagcatagcacagatgtttccagcaaaaccgagggacgctagcctgtcgaggtccaaatcccagttctgctgccccaactgtgtaaccttgaccaagttactgaaccttcccatacttcattttcccatctgtaaaactgagataacagtagatacttcgtgtggttattgtgaggattacatgttgctatggactgaatatttgtatctccccagattaatatgttgaagccctaacacccaatgtaatggtaattagagaaaggcctttggagggtaattagggttacatgaggtctatttctgcttttaagctacccagcccatggtattccattacagcagcctgagcagacaaacacacatggatggtaattttgagcacagcctggcacatagtaagggcactgtaaatgtttgctttgatctattagtactcaattccaggatggatgtttatttctgcaaagaacttgttaaactgctgcatcccctcctgagcagaagatacgatacttgcatggaagagaggagagccggaggagattggtagtggggcagctgacactccaacacagggcatgtcaagtaggtggcagctactatagacccaggagtgccctgagacacactgcattgccattgtcaaatacaccaaagggccactaggtgagaggacccaataacaggaagccatgggctggaaacccattcagggagctcaagtggggagcaagagaagcccctcagaattcccaacatgcacacctgtgccccacagggaacagtatctggactcctgcagagaagggcgcgatggccaggcagccactgccaacaacaggctcaattaattaagaaaatgtttgcctctttccctgtgcttccatgtccttatatttcaaccctgcaggagctaaaagaggaggaaacaaaaaattagagtgggcattcatcccccacccaaacataccctgcagcttcctcaatccacacgaaaagcctactgaagggtaaggaaaagaaatgaggttgatcttggatatgaaacttgaatttaactacaaccactagagtttagtttcgccttcatttttgtgacttcattttaattggcaatacagtcacctggtataagaggtacagaccagtggcagccagatgaacacagaggtccccatttggatgtggccaactccagcctgctgtggggacagggagggccttggtgtgtcacaggatccctaagcacaggaaacagaggctgtgtttccaggtgtgggctttcccattattggactgactgcatgaccacatcctttcagactaggatccctgacattggacccgtccaggcaggagctctgcaagccttctttatcagcagacaaggaaaggaaaatcatccaagagaggaagcaggagtccttcagacaatgagacagtgtccctcttttggtgggggaaacgcatccgtttttggattgactttccatcacagcctttcaaactaggcaccccttttctcaaacatggcctgctcaggaggcccctcctccaggtatgccccctgtctgctgctccagtgtctgctgctcagagatcccagcccagtggtcaggtggagactgagtgtgcctggtgggttggggtaacccagctccctcatctccctctgcttacatcctcccttttcagatgcacccacactccagcaagagcaaacccatcctccgtgcctctgtttccctccctccatgctcctcttctctttatcccaacccttgggcctttataaggcagacttgggtgtggaaaagcagaatacacaggcatcctccaaggccagctctgacaagcacacctcctggtctacagaaggagcccctaagggaggaagggagaaatgtggaaggcaatttgagcatcttagacatagagcaagcagctggttcttactagggtgcttttggaaattgatggggtgtcttcagctgccataactgagaattgccaccaggctactggcatttggagggcagggccagatgtgacagatgctctgcagtgaggggacagtcctacacaacacagagcattaccccataccttgtatgatcttctaatgccatgcagacatttatgtaggaaccattgctgatctataaaaatagatgagctttctcatttttccactgggataatctaaactttgtcttagactactaactctattttactcaaggtcatgtttttgctatttcttatgctgtacaaaggtctgttcattcttatccaaatggtggttttcattttaggatttacccatatctgtgatctttcattttattttcctttttgtacataattccctctgatcagttcttaaatccaaacttattctcagtagaagtaagcatctgactacttcatgaggactcatagcatggtcattgccaagcatttatatatagaaataagtgccattttatatcagctttatagattccaatggtacaaaatatgaaagcgagtgtctctcctattctagtcccccagttttcttcccccaaagcactactgttagctgtttcttttgtgtctttctagagatatccttggcatttataggcagatagagagatatatggatagatgggtagatagatgatgcaaagacagatggatagatgaatgaatagagaaattcgtcgtgttttaagtggtaaccctatgttgcggtattttatggagatactcccatatcaatacctgaagccttccacatccctccaaatgcaaatagatcattccactatatggtgatcttgattatttaaccaggcccctattgtagatttgtgttacccatgatctttccttattgtatgcaatgatattaaataacttgatgcaaacaacattgtgtgtatgtgcaaacgcagttgcaggataaattcctagaagtggaatcagtgagtgaaagggcatgtgcatttacttttggtaaagagtgtatgaattaaatttccatgagcaatagttaggaatccccattacttaaaacctgcctgatactttgcatcctcaaacttttatttttgtcagtatcataggtatcttattataactttaatttgattttttcttctgatgctgtgagaatcagcatattttaatattgaggaatcatttgtatttccttttatgtgagctcttcatagctcttcttcatgttcaacttggacgactaaggtttgtttgtcttattggtgtttaggtacacattatgtgtgtgatatgtcacaagtattttcttctctgtcatgttttaatcttatttgttgtattttttccatgaagaaatttgttttatttgtacagccccattttctagtctttttttttttttcttaaggctactgggttttgtgtcaaactctaaaagatagttcccactctgagatgattaacaacaacaagagaaaattcccatttattcttttggtgtcttttttggtacacctctttgatacattggaatttattttggagtaagaggtaattcacaaatcagacttaattgtcttctggataactacatagatattccaacattattaactgaagcatttattttatgcatttcaaatgtacctacagcaaaaaatagaggcatcatagcatagcagttaaaaacataaactctggatccgattgccagggttcaaatatcagatgagaatgccaagcacattccctatgtgtccactgtcattactgttgctcttattgcctgcagtctccccctctgcatttggtgctagtgttgatctttctactcatatgtcccacattcttctaattattgtagctttacaatggttatattttatgttatcatggtagtcactattataacctgtctctttcttccattatatactttaactggttgttcatgtatatgaaggcttctgacatctgaatattattttctaccagcttacttacgaaattctcttagagtttaaaactgttttaagcctttccagatataagtatatgcaaccagtgattactaataactttacctccttctttccaatatttatgccacctagccctttctcctatttaattacattgtcaaggacctcaagcaattaacatttttatcctagtcctgacttcagtgtgaaggtttttaagtgttacaccattatgcataatcctggtttgcgtatacagatatgttctatcaaattaagtaaacatctgtctattctactatattaacacttttatcatgaaatttgctttttctttttttgttgttttttgggttttggtttttgggtttttgttttgttttgttttgttttaagacagagtctggctgtgtcacccaggctggagtacagtgacacgatctcttcttgctgcaacttccgcctcctgggttcaagcaattctcctgcctcagcctccctagtagctgagattacaggcacacaccaacacacctggctaatttttgtatttttagtagagacagggtttcaccaagctggccaggctggtctcgaactcctgacctcaggtgatctgcccaccttggccttccaaaagtgctgggattataggcatgagccaccacacctggccacgaagtctgaattccatcccaaatgtttttcatagtactttgttctatttctatcattaaatgctgtgaattatattcattattccatactacaactaggttttgagtgtctattatatgcgaggtactcttctaaatgctagcaattcaagagtaaatacttcaaaattggtctgtgccctcacaaaacttactttttacccagggagactttcaatgttcaaagagttgtattatataatgtgaagtattatgtcagtgcaattatagtaacagaccacttaatattacattcctggatggtctaggtttttataacggaaaatgaccagaaagtttttggatctttccaaaatttgataaggggatcagaaagggaatttcaccaaacattcttaaagacaatgagtgaaaaagaaaaactgtctgcctcagtaagatcagacaattcaataaacagattacacagatttttgttcatggcattccattagaaatactgaacaaattgggattagggagtgcctaaatggttgtttcaaaagacatagtttctatgaaaacaaggataacatgcagtcatttgctggcaaagggctagaaaaggcagaatgaggacggagcccccagactgtctgtaccttcccctaggagatacgtcatccacatgctcaatgccctgtcttctactctacatttggcaaactctttgtcatctaccagacaggaagttgcctctgctgagaatcctgtcctgatttcctgtgttagctgctcttgcctctttggtcccctgtggtccccctatgcttacatctctctttaccttcatcacatgatttaattcaggtggcagtggtagatcacagcattatggcgcacaatatgttcacgcttctctgtatccgtattctggtatattccccctgtctcccgactccaggcttggccatcagacttgctttgacaagtgtgtagaatacaaatgctatgcaagcagagacgaaaaggtgtgtgcatgtgttggggcttacggtgtccttttcctttttttttttttttttccttgagatggagtctcactctgtcacccaggctggagtgcagtggggcgatctcggctcactgctagctccgcctcccgggttcatgccattctcctgcctcagcctcccgagtagctgggactactggcacccgccaccatgcccggctaattttttgtatttttagtagagacagggtttcactgtgttagccaggatggtctggatctcctgacctcatgatccacccaccttggcctccgaaagtgctgggattacaggcgtgagccgctgtgcccggcccaccgtctttttttctttagaaccctgacatgaccacaagaaaagcccgcctactggaagttgagaagaccagatggcacagagacaagccacctgctgaggccctgcaccggccagtctgccactgcctgcctgccttggaagtgaggttgtgctactcatctgacaaagggctaatatccagaatctacaatgaagtcaaacaaatttacaagaaaaaaacaaacaaccccatcaaaaagtgggcgaaggacatgaacagacacttctcaaaagaagacatttatgcagccaaagaacacatgaaaaaatgctcaccatcactggctatcagagaaatgcaaatcaaaaccacagtgagataccatctcacaccagttaaaatggcaatcattaaaaagtcaggaaacaacaggcactggagaggatgtggagaaataggaacacttttacactgttggtgggactgtaaactagtgcaaccattgtggaagtcagtgtggcgattcctcagggatctagaactagaaataccgtttgacccagccatcccattactgggtatatacccaaaggactataaatcatgctgctataaagacacatgcacacgtatgtttactgcggcactattcacaatagcaaagacttggaaccagcccaaatgcccaacaatgacagactggattaagaaaatgtggcacatatacaccatggaatactatgcagccataaaaaatgatgagttcatgtcctttgcagggacatggatgaaattggaaatcatcattctcagtaaattatcgcaagaacaaaaaaccaaacaccgcatgttctcactcataggtgggaattgaacaatgagaacacacggacacaggaaggggaacatcactctctggggactgttgtggggtggggggagggggaagggatagctttaggagatatacctaatgctaaatgacgagttaatgggtgcagcacaccagcatggcacatgtatacacatgtaactaacctgcacattgtgcacatgtaccctaaaacttaaagtataataataataaaagaaagaaaaaaaaacatatataatgtagactaatgaagaggtctcacttgttgggacccagacacggcaaagttaccgaactagcactactggttttgaaatatgtttcacctacttaccatgatagtattcccatataaatacatatttgtaagtattttccaattctgtttttatttcaatgtgggtaacatggtagtttagattgccaaaaagaatgttttactttctttcaaattataaaaatgtctttagaatactaacaatcctgagtttattaatggctcattttgtttagctcattttgaaataaaaatcttacaaccaaaaaaaaaaaaaaaaaaacaaagtgaggttgtgctaggccatccagtcccagcaaagctgccagctgaccacagacatcagccaagccaacccagacctggctctgacccaaagaattatgagatattcaagaaatgtttatgttaagctacaaagttttggagtgatttgtgacatagcaaaggttgactgatagaccaccacctgcccctcttactcaattatcagcactttgaagtcaagatcacattttattcactgtcacagagtctagcacagtgctgggcacagtgactttctgatgaatacttttaaaatggaaaccctgatctcagaaggaaagattctgcttgtaccctcccttgtgtcacatgactcaacctgcttccatcagccacatctgtcccagagacgacattcgtgaggctgctttgtttaaatgtaaacagactataaactctgtgaaagtggggacctccttagtgtttgctcatggctgtgtcattcaacacctatcacagcgatgtgacagggctttggcaaatatctgttgaataaatgaaccaacacagcttggcatttgcagcagccagtgacgtggcctggtggcagggggtgttagtcatctctttcccgcacacacagcctcacagccctgtgccctcctcatggcatgaccaatgagcatgcttccccacaagggacaatgtggctcgtggagcagagcagcaggaatggtggcctgagggaccttagaggtcaggcacagctggtagccttctgctgaacctagacaggtggtttcatgcacaatacacagtcctctccagtgggcactaatttagaaagtctcctggttgaggaaggggcagtggcctgagaggccagagactggaaacttgggctcaactctgctgtgtgactcatttccactgacctaacttctccacaccacagggtcctgccatcccagcctaatataccagctcagagaaacaaagtaaatcatataaaatagctttcaggaaataaaaggtaagagaccaccttcaacttataagtagcctgtgttctacatagtcatgtttcagaaggttgttttgaagtaggtaatatattttcccacagaaaaccatgttgaaaatgatggttagcttccctggctcttactcaaaagcctttttaaaccataacgtaactgaaataacttatatttgtgaagaaatatggcaggaaaaatactgttgcaatactaatcattaaaacagaaaaaaaaaataataccgtggaatgaggaagagtgtttctgattcatcacaagtgccagcgtttgaagaaaactggatttaattggaaaagaaggaggcagtaaagaggttttatgaagatttaaagacaacttttggtcacaacttcagatgcccaaatgtgggcactgtttcccccaaaatgaaagtttgtcctattcttagtgctgcatcctaggtatgttcctcttgctgtgattttgtccatattttgaggcacacatggaacgagaaaagggagagaagatccagctggtgaagagctgaaagagaaggaggaaggtgaaaggaagagatgactaagcctgggggcagccaagaaacattttccatgcttactgtgcaccacactggatgattttcctgtgttctctcatgtcttctccttatcttaacctgctaaaaggcatttccccattttgtaaataaataatagactgggactggacaggaaagtgactttgtcaacaggtttagtgaagaggccagaggtcagtcttagggctgcttaactctaaagcccattttctttgctctctacttgactgtggagaaggaggacagaggaaaagggaagcatgatttctgtggagatggtgaggaggccatctgaagcaggtggtaccatgcccccaggacatttggttgtcaac

SEQ ID NO: 1211 - DNA, 23514 bp, Homo sapiens
tctaaaccacttctattgccatcctgctgagcgaggcttccgggagggctgactagaactctccttgggctttcttcatcagtgtcgttctgattttattcatttctctttactggttctattttccctacaaaatgttagctctgtgccgatatcctttgaggcaggaaattggaattcgcctggtgatgataggaggcatctgttgggggaggagggggcatgagggtggctaactcacccctcctgtggttcccactccactttcctcttatactcccggccttcacaccaagcctgtagctctagaaatcacaaaaggactggaccctgttctttaaaaggcaaagcatgagtctaacacaaaaccacagagaggatccagcggacttcacgggtgtaattttgaagagttctagggaatcattttgtaaaagacccagttaagtaagtactaagttttctttttctcagatattcatttttaaaggctgtattattactctatgtaaaattaagtgcaaagtatttggtttggccctgggcttccaagttagtggtggggtttaggacatgccgccccaaaattcagaaccctggcatttgagaaaagaggcagaggcagaaagatctctcacgttccctgctcttctcccctgaagcaggtcagtcataggacctgcgtttgagacgtgccctgttgatacctggaggaaagaaacgtccttatctctgaagacacaagacttcagagatagatctgaacaaacacctcttcgtaagtttcccctggtttattgccattagatcatagcctgtttgtgcaatcacacttccccacactgtccactcttcaccaacctaagcttaaaaatattcagatttctctgtttctttgggccttctcttctgaaggccctggtgtcttgtaaaatatgggtaaatgtatatgattttcttttgttaatctctctcgtgttagtaggggccacagctgtgcacctagccatgggcaaggaaaagctgttttctccttcctcttccatgaggttaagtgtgcagctgggatgtgctgcaggaccagggccaggtgtggggctcatgcctatcacgccagtgctttgggaggccaaggtgggaggatcccttgagcccagtagttcaagaccagcctgggcaacacagtgagaccctgttcctaaaaaaatttaaaaaattaaaaaaataaaaacatgccacaggaccactgctcagagctctttggtctggcaaccctggaccttcacatggttttgtttgccaaagcaaagtccttattaatatccaaatacagtttgagttttcttgggctttatcctctccagaaacccaggagtgtgtcaacttcttggttgcattgctttcttcaaagagagagtgaatccggtagagatagaaaggatgtcctttacgtatcccacagcggcctcacggagaacgataagagaacaatcattaaaactttcattgccataattttctgctttcgttttttaaaagtttgggttagcaaccaatttcctccttgaccaggtgattttttccttagactgtttatccagagcattaaggaaaacagagcataccaccctcccaccatagctgataaggggattcaacacaggtgcgtgtgctagagttaagggaacatattatgctaacatgaatctagactgacttaaaaaatagatgtctgaagcaagtcttttaattcacagcaaggctgtggctcaccactggaagtgtaactgttgtaatctggctagagaggaaagtccattacattttaatttttttatgacttcattcagcctggagcagggtgaagtggataaaagagagagttgtcgtcttagaaaaattgctgatttcagatcagaagaaggaaatcaacatcaagagcctgggacattctgttgggccaaaacaaaataaacaaaacaagaaagctgagactattgactatgttgacaggaataaggggccatctgaaaatgctcccattggcctaaagtgggggaatttggacattaaaaaaaattaactgcaacagactaggagtggtggctcacacctgtaatcccagcactttgggaggctgaagcaggtggattgcttgaggccaggagttcaagaccagcctggccaacatgctgaaactgcgtctctactgaaaaataaatatgaaaattagccaggtgtgatggcacgtgcctgtagtcccacttacttgggaggctgaggcaggagaattgcttgaacctaggaggtggaggttgcagtgagccaagattgcgcccctgcactctagcctgggtgacagagtgagactctgtcaaaaacaaaaaacaaacaaacaaacaaaaaacaaaaacaattaagtgcaacggattgaaatacatgaagtatattttaaaaatctatgagtatgagttcataatgatgtttttaaaatcccatgaaataatgagtctcaacattgatctgcaatagatattaagtttactcaatgaaatgctgatgagaaatttcgtattggaggggtcaggctgacaccatcactagaagtgggaaaacttgactttatgggctgcgtgttgtaacgcaattggttacaacacacagcatataacctaaaacataaacctgaatgcactcaagcctctaaatctgtcaatttacagcatgtgttggggataaagtaacaagctaaatgacaatagaaggaagcaatcagacaaatgtaggattcagaacattctgccaatgacctgggttctccaaggaatccatgacacttcagagacgtaaaaccagacccaatgagtggactgtgtttggatataactgtgaaaaaatatctttcaaaccatttgaatgtgggctggatattaaatgatattaaagaattatttgtaattttattaggtctggtcatcatggccttgctttaaaaagggaggcctaattaattagaatatatcatactgaagtatttgtgggtgacatggcacattgcctgctattttatttaaaatacttttttattaataaaagtgaatgcagatggagaaaacaagagtgtcaaaattaaagccaccaaaatgtagtcactgtgacaaaggacattacccatgagccacgtcgggccttctgatccttgtgcctctgggggcatccttggtcagctttcagtggctttcttactttattagtttcaaaagaccttcctaaatccatccacttgttcttttagttttttactgcctcatttttcctactgtacaagttggtgtcaacgaagtggtatttgctagaatgaccatggctctgggaaacatggtttgggaagagaaaggataaaagggtggggggtgaggaaccttcgattccttggtggccacgtgctcagccgtgtgtggagccacagttgtgctgtgctcagttactaaaagtgaaagttatcagtggtactgagagatggctccagctccctgggagctggttcactggatgtgtaaggaaatgcaaactagggtaaaatgttcaattccttggttattgttctatgtaacagctaaaatgaaactaaaaggcagtgctggctcagaccttgatgctagaccaagctcagatttcagtgggtctgagtttcagccactggcctgaaagccaccctcaagggaaaaattatgcaggaacaacgtgaagtatctctaagatctctggtcaccagcaggtagtccatgtggggagagggccaaaccagaagaccactgaaaccagaggtgccgtgtgaaggaactgttcattttgtagatcagtatcatcagcttcctgaggagtctttagtaaaaatgggttatgacagcaacaaatataggatgaatatctttggtttggaatgctgcagagtggaagagcgtgtttgggttcatgcagtacccacagcttgctatggaacaatcacaggtggctctaagtgatcagacacacagaaggttattctcaagggaacagccagcctggtggactggttacagtcactgtaagatttgtgtatcctgagaagagggactgttgtctcctcctatgactgaagtggagcaccccagatgaagcggcggacatgctttgcgtgcaagccatatgggactgtctttttgatgaccgcgatattcacctgttaaacatgcctgttacccatgtatagcaatatatatataatagagacagagagagagagagagagatggagtctcactccgtcgcccaggctggaatacagtggcatgatcttggctcactgcaacatccacatcccgggttcaggcaattctcatgcctcagcctcctgactagctgggattacaggcgcctgccgccacgcccaactaatttttgtatttttagtagagacagggtttcaccatgctggccaggctggtcttgaactcctgacctcaggtgatccaccctcctcggccttccaaagtgctgggattacaggcatgcgccactgcgccctgccgtaaagcagtattaattgggcatgctaaatgggaaccagtgagaccgtctgagcccacaggggagagttgaagctggagtcttggtatggccagattctctctgtgttaggtctgtgtggtgtgtgcactggagcttacatcaaagcctgtgagcacctcccagcgacaactactgggactctagactggagaattctcatttaaagggtatttactaacttggtctcagacattagtggaaactactcttatgactgaaggacataaaatgatcttaaaacatgaaatacccctgatgtcttgggtgatatcagagaaatgctctaatgggaatggcagtaccctagaagagtcctgtaataaaatggaagtggtttattcaggatcatgctgcctagggaatacaaggaggcgatatgagcagggagcccattttcctctaggactgaatctggagctatgtgaggagcttctggattctatcgtcagttgaacagagccctgtcaacctctctcaactgaccgacgaagagttgcttggtttgtgggtggcagttccaaggtgaagagacacacagtcctgttggaagggctactttgatcaaagcaggctaaaacaaatcaacttggtgggctgaaatgcatgctgttacctaacagtgatggaagaattgaagggttgtagaagcgcctgtgtttggggttttattgacttttgggcagcgaccagtggcctggccatacactcagcaagagggccatggaaacctggctattaaaaggactcccccatggagcacagccctgtggaaatctgagggtgcattaaagtaaaacaagtcaatgctcatcagaactcccttccagattccaaaggtgactggagtcaacaagcagttatccctgtgtcctcccctgatgtgggcagctgggtccatgaaataagtgggtagctgcagcagtgcagagatgggctgaatctagacatgttctgtatagacgctgactggtctgggctttgcttacccggtggaggatgcaaatgctcactgtgccattcaaaagccagaacagaagatattgcaccaatttggatggcccagtcacatttctttagaccaaggaacacactttacagcctgtaatatccaacaatgggcagagctagtctcctccgggtaatagtttgatagaaaagtagaacaggcaattcaaacattagttgtcctaaacggggggagatgaagacacgaagggctggcttgcacatcttcacaagtgtagtgcacactcaccatgagtggggctaaaggcgtgttcccctaacactttcctccgtttcctggtggatctggggtagaggggtgggaggatgctggtatgactatgcagttcttgccaagggagaagtacccaggcataatgactgcaattttttttccttccctctccacatcacgttaactttttttcccctacctgatgcaggggtcataggcccagggctgcaattataaatgctgacagcagggatgattcctaagcaggaaattgtcactatgtttttaaaacttgtgtcagaattcccaagggcctgatggggatgggttgtgccttcaccccatctggcaaactggggttgacacagaatgaagctatcttgtttggtggtaagtatagcccacggctttgtaccctgtctgaacggagtggacccagggaggggcacctgctagaccagtaatgctcccagcaatctagaccagcacagtgtctgatctgagtgtcccttccaagggtggaaacgtttgggtctaaacaaagagaaggagaaatcatagctgagggtaaaggagtgaataaaacgctcctgtaatgagggaagtctcatattatattaacactgaaaatgctccagagcaagagatatcattgcctcttagctcaattatcccagatgcccagaagggtaaagctatgtgtttgccgaggccactcctgcttttgaagccctacaggacagggtggaagcctgcaaatctgagtagccccaccctgggagacatttccataagatatgatgatggactggactaactattaatgaatgagtgggattctagtcatgtgacagtatcttttgagttgtatatcattttgctgtaagagattggtggccagagacagggggcggactgtgatactgtactatagtaagaaatatctattggtctctgccccgagttcctggcacagacctcccaaaaacccttgtaatttcctgggcaataggggtgctaggtgcatcttttattctgatgtttggtctttgactctggttcctgacacaaaactcctaacccctggcatttcctgggtggcaggagcgtctttttttcctggtggactcctgcatgggggctggtcaccagaaagaccaagccatctcctctgggaagagaagaggggctggaaatggagttaataatcaatgacacgtatgtgatgaagctgccataaaaatccctgaactgcagggtgtggagagcttctgggttgttggacatgggggagtgcctggagggagggaaggttccctctgtgccccatcctcatgctctaccctgtgcatctctccatctggtgctcatctgtatcctttacaatatccttgatattagtagtaaactggtaaatgtaagtaaactgttccccggagttccatgagatgctttagcaaatgaatcaaacctgaggcggaagtcatgggaactcctgatttatagctgattcattggaagttctggaggtccagccttgcaattggcatcatacaggcagttttgtgggactgggcccttaacttgtggatggcaactcccagtagatactgtcagaattgatgtgtggggaaaaacccggacatctggtcacagaagtgttctgtgctgtgctgagagcataggaggggaaatcagtttgcttgtgttttcctgccacgtaacagagcctcttctgggagaacctaggattctcttctttcaagcctgatggacacaaaggacttcatctccctgggtccttccttctacacaggattttctttttaaggcttttaagcacaatcaccatggaaaaaaaggacagaaggttactgttgggttcccccaaaatatatgttgaagtcctaacccccagcacttcagaggtgaccctgtttggagacagggctgttacagatgtaattacttgaggtcctgctggggtaggtgggccactggtccgatgtgcctggtgtccttacaagaagagaagagacatatgcacatggctgtggagatgcaggcagaggctggagcgctgcagctgtgagctagggaacaccagggatccacgtccaccccaggagctgggagagtcaaggaagcgttctcccttacagatttcagaggcggcatggccctgctgacaccttggtaccagacttctggcctctagaaccatgggagaataaatttctgttggtttcagccacccagtttgcggtcctttgtcaccacagccctagaagccaacacaactatggcagggggttccagaatctagtagtaattctgtgatgtgcttcacggcaaggtggggagcatctttgctgatcggcttctcactgaaatctccaggccctcatagtctcactcctgtattcctagggacaaagcatgctatagtctgaattttggtgtcccttgccaaattcatatgttggaaactgatgcccaatgtgatagtattaagaggtggggcctctgggaagtgattaagtcacaaggaccccaccctcgtgaatgggattagcgcccttataaagagacttgagtgagcttcctcgcccttgctgccatgtgagaaggcagcaacaggacaccatctatgaaacctcacaagacccttaatctgctggcatcttgaccttggacttttgagccttctgaactgcgagcaatacatttctgttgtttatgaattggtcagtttaaggtattttgttacagcagctcaaacggattaagacagagcccaaccaaacacccgctccttggatcgctcccctccttccttttgttgcctctcccctcattaaggaacgggaagggagagatgagggataaacaagcgtggtgacggattggtcctagactgatgcggatgacgtatgcatcagagatttcctgggccttgctctgactttggtcttccagcagtgcgcaggcctgctctgccccgctctgccccgctctgctggcctcagccttcctcattcatcattgttcacctcactcccatccaccttcttccctttttcccaaacctatcctgatgagaagtttgaattctgttttaaggaaagaccttccaatgcagtgtggagtgagggccattcccacatacatacacactccatactcttttgaagcgattttgtgaattacaaaaccaccataattttcaggagtagtggcatgtcttagtaggaaatgttgaatggaatcacaaaaagcttgagaataagaaaaataaaaagataggatgtgctgacatttttgaaagccctaaaataatttggtgcccatagtgggaaccttgtcatacttatttacatagtatggaaggctatttgacaaaaaaatcaaatgaggtataggaatagtaactcattataaattggggacaataaagccaaattccactggattttaaagttatacaaatgattctctagtccctaaattagggatataaaagtccgtaggcagctttggggctgaaaggggttctgtaagcatcttgctgtataatggagcaagtcctgacccagaaaagaatctgtactttgtcccagatgggctataacttgctctgtgactgccatcatgtgtgttctggcagagattcataggcaggcagaggagtggggaagcttcatagcagaaaagggaaggtgtcaggtgtgtgctgactggaggctgctggccggggaagctggaacgaagtgggctatccagaggtggtgtatccatcctctgtagttggttagggcacttagttcactctctccagttggggttgattgtagagttctaactttttacgtggtctggccattgtccatgtgtatattcagtctctcccaagctagtcatctggtaagtgaccaataagctttagttactcaatacaaagaaaccaaaccagcattagatggggaggagagttccatctagagatctaacactgtgatagtggaagcagtcccaaagaatgatagcctatgataccatgcttgggggtgtggccttccggtctcatcagaaaaagtacagagctcagagcagaatcacatggaagcagctctcccctagactctcctagatgttaggtctctgagatcatagtaatgcagtcagcaatgaaacctacctggttaattagagaaacacagctccatcaatgtaagagagaagtctggtaagccttcttatggaaaattctttacctattttcccttcaaatattgtttctgctccattctctcaactttctctcaactggaatctttccataaataagttggagcttttcattcttttctccatttcttttcactttttgtctatattttctatctctttagttctctgggtcaaagtctattttgtgttctcagatgtagtttcggctcactagttttcccttctgttgcgtttggcttacagtctaacttgtctgtggcattttattttaatggctgaatttgtacttatggtgttttttcagtcaatctccttgttctttttaaatgtgattttgcattcttatattacacattaaatacttcctttatatgttcaaactttgaaaacagacccacttaaaatatttttcacattcccttatttttctgttcctgggagtgagttacccccaactcttagctttatttggggaagtcagtttcagcttctcatcacatacaggcttgaggccacaaattctgtttctccttgagtactaaactccagtgccaagggattcactgcaccccatggactcaaatcatgttgaaactcaagagccacctctctgatttcagtttccttctatgactttatgactctatgactctatgactctagcacctttcttgcttttgagctctctttcccacaatggttctattcagcatttatctgtgggaggagcagccaggtctgctcagtctcacatgttaaccagtgtcaatgagtatttgtaatgcacctactgtatgcccactggggctaggcactgaggatacagaaataaacaaggcatgggcttttccctcaagaaatttatagtccaaaggaccagacagcaaatgaaccaacatttataataaaatgcaagatgtgtgatggtacaagtactgcaggttttatggaagtccagggggggcatctgactcaggcttaaggggaagtaaggggaggtcagcaaagaaaatgcatgttcttctaagcaaagatcttattggaacaaatgaatgagaaagggcatttttgtggggaaagcattttggctttattttctttttaaatctgtgtgtaggccctaaacccacagtcgtacacggacatccttgcctccctacttctcatagtatgaggctttcgtgacttgcgtgtttcctttcggcaccaaaggtatcatctgatgaatcatttattcagcaaacatcatgcaaacagttattaaggtcacttcccaaaaggttaattttactgcttggatataggttataacctggaagactttgaatcattgccaactgccattgtaaatatttatgagaagtttgttcccaatgtcttaggaagctttattctgttgtttttgtttttctgtatacattaacatggataaagaaatatccatgttatgtgccatccacatatttttggtaaggtataaaaattaggctgggcatggcaggtcatgcctgggcaacacagtgagaccctgtctttacaaaaataaaaaaaaattagctgggcatggtgactcacatctgtagtcccaactatttgggaggctgaggtgggaggattgcttgaccccaggaggtcgaggctgcagtgagctcttgactgcaccattgcactccagcctgggtgacagagtgagaccctgtcccaaaaaataaaataaaataacaaaatgaaataaaaattgtttttttttatattgaggataaaggatctggaatgaaagaaatatactgaactatctgtaggaccataagatgtttaagctggatgttaccttgttgaaaatgaggtaaatctaggtgaaaacagggtttcttaccctcagtacaattgaaattttgggtcagataattctttgttgttgaggggtttttctgtgtattgtaggatgttgagcagcgtctctggtctttattgactaggtgcccatagtcatgacatgctgcatgtccccagatgagaacgcctggtccagattctttattctagagctaagaaatgaaggctcagaaagggagggtgatatggcttagacagccagtgagaatcagaatttggaccagcacctctgggttgctgactttataaggctcttctcacaaaaatgaactgcaacaaaacctgctggctaatattagcctctcaatcccatttgcatcagagccctgggctcagaccctcagaataatgtagcttctattgaaatactcaaatttggcaagcttgtcctgtttgagttgtctccaattcacttaagaaccaggatttttgtgaaatttcaatgacagtcattgagttgattctgagtgaccaaaatgttccttccaaactcacactctttttcaacaagtgtctgtttctctttccgtctgcttgtgaaaaaacaaatcctttgagccagtcccagaggattattttatacttgatcattttccatggtactaatgattgagtgactgcatgcatgcttgccaaacagtaaataaatccgtacatagcttttgttcattggataatcgggtgtaatatatgcaaagttaaagttcacttcatgaaaacacccggttttatttgaggttttttcttctggtcagtgaacccaaaggcctagggaaaaaaatcaattcacatttttgaaacactgtggtcctgccatttgcctctcattcatcatgttgacaaacaagtgtaagggaaaacagagggtgaatgagaccaggctccagaatgttcttcttcggggagcgtaccgttgcgggcgcagccctctctggttggcaagaggctccctcacctccaggttgcccagggtcatttggcaggcctgtgttggattctgacactttgcagagctgttgtcactgagaccagcggcttgtggttgggaaagaccacccgagccagcgagtgatcagtgacattcaagctaagctcaatttatgtcagtatgccagtgacgaaattcacaacttgattctccctcagggctgccgagtgtctgacgggacaaatccttccaacggccgcagcaggtgcttcttctagccctgtgttgcaatgacctgcagctcctggggataactcaggcacgctgctgacgccatcaggaggctcaacaccctcacccgcttacgctacgaccagcaaaagcaaaccccgcagctgcctgccagccgggaagaaggactgtgtttccatgttgtgagtctcctcattgcagccagatgatgaatttgctgctggctttgtgcgaaaccgagaaatacccagcgtccagctgagggcccgggtggcaacaaaatcaagctgatgaattaaagaaatatggcctggtcaggatgcctggaggcctcagagttctgatctttcttctgagttactacatcttctgaactgctcccaggatggtgtttgtgataagttggtttgcccagtaaaactgtcgcccagtggaggcaagccctacctcctgtcctttctcatgcagtggtgtggagcgtggtggggaagaaagggcgttcgacagcaagtcaaaaactttggatttcatttgtggctgtgacactgggttggggtcagtggctcagtgttgggagggtctcatttctctccaactccatagggctgtgagatcacccacagctttgatttgcatgtccaagctcatcccagcactttctcctcagaatctggctaacatttcaagtcactcactagcttccagaactatggttagctcagactcagttgtagcttccccaaactgtcatcctactgtttttatcttacagctgaaggaactgaatcccaaacagcccgagcaacccattcagaatcacaccacagatttcctcacccctcttccacaccacagagccttcccatttttacatgtcttttatattaagacaaaaccaaaaactcataattaagtcagtagtgtagaaacctgaaagatattttgttataaaaggttcactgtaaaccaggatttagaaaatgcaaacccttgggtaaaatgaagtgttttcaggacactcaccagcaggatccctggccccaattctgagaatgtgaccataaggacaagaggcctgactggtcaccccaggccaggccacctctctgacagtctgggattctccctgcatgccccagatccatcctaatgatgaagctcaggtgctgagagcaactgatcagatgttggcaggatcatctaaatccataggcagccaagcagccactctactttgcctggcagagctgcagcaggcacctgcagacaccacccaagagacagttctgcagtggctgaaatgtctggaatctgtactcctggagcagtggcgagtgggcacaggtggctatggagacttagaatggggctagtgcaagtgggaaactgcatttgcagttttatgtcattctaactggtttaaagtttatgcagccacatgtggttagcgactaaggcactggacaacacagttagaaaagtccctctcctgggcactgccagctgcaggcacattcctaacctaagatgtcctgcttgttcctctgggtgtgtgggctgcagtctcagtgtctgctcgcgcatgtggacacacctgcctttgccagcacataactcacccacccgttcgcacacacatacacatgcacccaattcaccttgactttgagtgtccatgtcttttcttggccccacctgcagtcttgatgccccaggtaggaatcttggcatgttgagggaggggcctgtgggaagcaaactgcattctcgtccttactccgtgatcgtcaaggattcacccctgccatcttctccccctgacctcagcgagagcactgttcagcagtttgcctaaccgagaatccacagcttctcgtccctgtctggctccctgtctcggaagcaatgttctcgcgtcttcctccagacaggcagctgctggcatcttcacagctccctctctccgcggctgaagtcaggacccacagatggtgccgctcgttttcctcagcagctctgcttaccgcatttacaggggtggcagaagccagtgcgaatgaatattaaatcaactaaggcagaacttctcaaaatacactcctcaaaacaggttttttcttttttctttttttttttaaccccacaaactgagtccattttggcttcagcgaaaaccacactctcaccttcctttctgtgaattaccaggaaatagttcaattttacttttttttttttttctgtcaaacattttcttcctaaactttttggctgctacctgttttcaagcagacggctaatccggtagcaaatgaactgggtttttcttaggcttgacatatctctgtcaacagcctttttcttttttttaaactaagcccagatttttgtgcaaaaccgagaaatacccagtgtccaactgagggcccgggtggcaacaaaatcaagccgatgaattaaagaaatattgcctggtcaggatgcctggaggcctcagagttctgatctttcttctgaatgactacatcttctggactgctcccaggatggtgtttgtgataggttggtttgcccagtaaaactgtcacccaatgaaggcaagccctacctcctgtcctttctcatgcagtggtgtggagcgtggtagggaagaaagggcattcgacagcaagtcgaaaactctggatttcatttgtggctcttacacccctttttgaaaggagttttgaagcaagcttgcatgcggttacacctgaactctcagttaagagcaattccatcttccagttgcttgggccaaaaacttccatatcagtcttaactcgtatttctctcatacacatatgcagtctggcagctccacctccaccaaatatggaaatctggatgccattcctacctcccctgccaaccccctggtccaagcgaccatggcctctcagctgggtgaatgcaagagacccttctctgatctccttgtatcacccttgagcttttaaaatctatttcccacccagaagcctaagaaccccattcctcctctgtggttctcctcctcactcaggaataagccctgcacgatctagagccccttcctggcctctccctgcacaggcatcctgccctcgcttccccttcccccttccccgttcctcacccctcccccgcctctttcctgtcgtccagcacaccctgctccacctccgtgggcacttgctgtttcctctgccagaacactttgttcccagtatcttcacaacccaatccctcacttcctccatattctggccttcctaagcattttatctgaagttccagcatcctcttgccccaacacgtaatacagacacacattcctggctttagtgttccttgctaacatttcgctcttgaaagcatatcttaggcagttactctgtttattttcaatctcccgcgtaagaacgtagcttcctgagggcaggaatttgggtctcttttgttcactgctgtgacctcgttgtccagaggagtgtctagccctccgtaggcactcgggaaaagttaagtgacttcatgagggcgtcttctccacagcagtacccacattctgtattgtggtgtcaacactggcttactttgaaatgactggcctctaatgtagagataacccaaccctcaacacagtcactgcccgactcttcaaaagccctataaccattgaggtaggttattaaacttagtatcataggctttttaaaaaaacaacaacaaggatttttgaggtataactggtgtacaataaactgcataccatttaagtgtaaagtttggtaaacattgatgtgtatgcatcattaccacatgaaatataatgaatatgcccattatctcctccaatttccccatgccctttgtaattccttcctcttgccccctacccttttctacacaactattgatttgttctctgtcactatagattcgcttgcattttctagagttgtaagtagatgaaatcatgcattacgtacttttcccctagcttcatttgctcagcatggttattttgagaatcatcgatgtcattgtgtgcatcagaatccatttctttttactgctcagtagcattccacatttatccactcatctgttgataggcatttgggttagttccagtttggagctattactagtcaagctgctataaacattagtgtacaagtctttgcatgggcatctgctttcatttctttgtgtaaatacttgggagtgaaaatggttgagtcatatgatgggtacatgtttagcttttaaagaaactgccaaactgtttttaaaaatggtcataacattttgcactcctgccaatagcgaatgagagttcctattcctccacatccttgccaacacttggtatggttggtctctttaattttagtcattcaagtggctatgtagtattctctcactgtgctttttatttgcatttctctgatgatgaacaactttttaaggtataattgccatgtattaaattacacatgattacaatatacaatttaatcttgtacatctttttgtttacttgccatccgtatatcttctttcataaagtatgtgttcaaaccttttgtccatcttttattgttcattttttactgttgagttttgaaagttctacgtatattctggatgcaagattgtatcccaagattgtaaagatttctcttatgatttctactataagttttatagtattcagttttggtcacgtatatatttatattctctatgatgtacatgcattaaatttatgactcactttgtgctaatttttatatctgatgtgaggtaagtataaagttaactttttggcatatgagtatatcctgttttttagcagtatttgttgaaaaggctatgctttctccactgaaatgcctttgcacttttgtccaaattatttgtccatatatatggatctatttcgggactctgttttcttgcgttgatctatttggctatctttatactaacaccatactgatttgattactgtagctttacaataattcttgaaaccaagctgtgatggcactccaacaaagttgttttgtctattttagctcctttgcatttctttctttctttctttcttttttttttttttttgagacagagtctcatcctgttgcccaggctagagtgcagtggcatgatctaggctcactgcaagctccgccttccgggttcacgccattctcctgcctcagcctcacaagtagctgggactacagacgcccaccaccacgcccagctaattttttgtatttttagtagagacagggtttcactgtgttagccaggatggtctcgatctcctgaccttgtgatccacctaccttggcctcccaaagtgctgtgattacaggcatgagccaccgtgcctggccaggtcctttgcatttctatatgaattttagaattggcttgtagaattaaattctagaaaaaaagacttctggaattttgacatagattgtgtagaatctatagaacaatttagtgagttaacattttaacaacactgagtcttctgtatgacatatcttcctgtttattaggtcttcttaatttttcttgttcatcttctgtaggtattcaatgtagaggccttggatatcttttgtaaatattttccactaagaatttattatttttggtgctatttaatttcaattgccaactgttgccagtatataaataaacaatttttgcatatttattctgtatcctacaaccataataaattattagttttagtagtttctgttgctgttgttgatgtcagatgccatcagataattctaagtagataattaagtcgtctgaaaataaagaaaaattagttttccctttccagtctagatattttttctttttctcgcctgagtgagctgtatatcctccagtacaattttaaatagaagtgcagagagtgaacgtcttgttctgttaccaatcttaagggaaaacaattagtttttcacgattaattataatgataaccataggttactcatagatccttattatcagattgaggaagttctaatcttagtttgctgagagtttttttttaaatcacagatgttggattttgttgaatgattttctgcatctatcaagattatcatatggtgtttcaattttaatttgttaacatgataaattttattgattaatttttaaatattaaatcaaccatgcactccttgaagaaatcccacttggttgtgatgtattttctgtttgaaaatttttttgacttagttattaatattttgtttagaatttttgcatctattttcaaaaggaacattggtctatagttttcttttcttgtaatatcattgtatgattttggtgttaaagcaatgttagtcgcttagaatagtttgggaagtactccttcctcttcaagttcctggaaaggtttatgcagaattgaaattatttctttttaaaataattggtagaattcatcaaatgaagacatgtgaacctcggattttcctgttgaagaggttttaactacaaattcaatttaatagatacaaggttattcaggttatctgtttcttcttaagtgagttttggttgcatgtgtcttttagaaaatttatccatttcatttaagttgttgaatttataggcaggaagttgttcatatcttcttcttatctttttattatctgtagactcttgtgatatcacttctctcattgctgatattggtaatttgtgcattctcaattttttttcctgatcgttcttgctacaggtttatcaattttattgatcttctttaagaaacagtttttgtgttttattgattgtttatcaattttattgatctttaagaaacagtttttttgttttattgattgtttttaatgctttctatttcattgagttgtactctgatttttctttttttccccttttttgtgcttactttgggtctaactttctctttttttctagttttgaaaggtgagatctgagattattgatttgagatcctttctacttttaactatagccatttggtgctcccagtttccctctaggtacagatttagtgttattccatataatttggggttttatgttgtcatttttatgaaattcaaaatattttctaacttctctttgctttcttcatagattcatgggttatttagaactgtgttctttacttttcagctatttgaagatttttaagtgatttttctgttattgatttataatttaatggtcagaaaacatactttgtatgaattaaagcattttaaatttgttgagaattattttatggtccagaatatgactatcttggtaaatatgatatatgcacttgaaaggcatgcgtattctgctgttgttggatggagaattcaataaattcacaattaggtcatttggttggtattgctgttcatgtcttctataacctttagtttctgtctacttgttttatcaattattgaaagagtggcatttaaatctgactataattgaagatttctttgtgtctttgtttctcctttcacatatataagtttttgcctcatggtttctgaagtcctgttgttaggtacataaacttttatgattgtagtaccacttgatgaattaacccttatcttagtgaagtaaattttttaaactgtgtaatattatttgctctatatttgtctttgtttgatattaatatccacttcaaatttcttttgattagtgttagcatgtcatatctttttccatccttttcattttaacctgcttgtttctttatatttaaagtacatttcttataaacggcatttaaatgagttttgctttatttatacactctgacaatgtttgcctttttactttattagctttatttagatctattagattttttatttagatttatttagctttatttagatttaattagatttaatgtaattatatagttagattaaagtctaccattttgatatttgttttctatttgttttgcctgttttttttcctttttccttatgttctttcttcttttgaattaatttttttaatacctcatttaatttgctttgttgacttattagatagaggcttttgctattttagtggcttctttagggctgatagttacgtacttcaaatggtatatgactttcatatagtacaagtatgtataatagttgaactctgtatttttcttcttcaggttttatgctatgttgaaacacattttacttaaaccacagaaatctataaaatccatagtgacttacttttaaaaaatgtcttaaaaatgaagactttgttgttaaaaagaaattatttttgcccttaaaatgtcaattatgtttaaaaagattttaaaaatagaaaaaaattacatatttgccaaaatcataccatttctgatgtgcttcattccttcatataaaccactagttctcaactgggtataattttgcccctcaggggacatttggcaatgtctggataccttcagtttttattgctgtcataactgaggaaggttacccctggcatttagagggtagaggccagtgatgctgataaacattctatagtacacaagatagtccccacaacaaaaattatccagcaccaaatgtcaacagtgccaaggttgaaaatcactggtataaatccatatttccatttagtttcagtttatgctgaaagagcttctttttaacatttcttataatgtggctctgctggcgatgaattctttcaacttgctgagcatttagaattttttcttttattttgccttcatttttgaaaggtattttactgaatatggaatttattattgacagtttctttcttttagcacttaaaagtgtttcatcatgacctcctcacttgcattgtttccaaaaagaaatctgctgtcatccttattctttgttcctttgtatctattatctattatgtcttgttttttggcaccttttcagattcattagtggtttgtgcaatttaattacgaagtgctttggtgtgatttttaaatatttcttgtgctcagggttagatatgcatcttggatctgtgagtttatactttttttaaaccaaatttggaaaaatttcatctttttttaaaaatagtttttctgttgttcccctcttcactcttctttagggactcagttgcaaaatatacatgtatttggccatttgaagttgtcccacagtttgatgatgattttgtcatttttttaaagttcttttttcttcaaattaattttgaatagtttctattgctgtattttcagtcaactgatcttttcttctgtaatgtctaagtagctattaattcatatctggtatatttttcatctaacagtttatagtttttttctctagaagtttcatttggatctacttaacttcttgaacaactagaatacaattatatagttataataactgttttatgtctttatctgctaattcaaacatttgtatcagttctggatcagttttgattggttgagttttctcctcgttgcagacactttcctgtttctttgcatgcgtggtgaattttactttggtgctgagtattttgatatatctatggatattatagagctttgttctagaaggcagtcaaattacttggaaaaatttgatccttttgggtcttgctttaaagaatctttacttggaacagagcactgcttcatcacaagctaactattccacattactgagaaaagactactttgtgtgccctatctaatgacacattaatcctgatgcttttctctctcagtggtgggaagaggctctttatctggtcgtggtactcttctctaatcctccatgacacttccttccccagcctcacatagtttccttacatgcatgtgcttatcaacactctgctaaattctttaggggcatgttccacaaatctcagaaatcctctctccatgcaactctcttcctctctggcactttaatcagcagactctaggcagcttggtctcccagagtatcagctatatttacttacagggttctctttacctagggagttcactgggtgccacctgaattttcttttcctccaccatggactggaaactttctcatggcagtaagctggagtaatcatagggctcatcttgtttatttcccatttctcaggattactgtcctttactgcctaatgtccagtgtcttgaaaactactgtgatatattttgtttggtttttatgattttttcagacaggaagataag

SEQ ID NO: 1212 - DNA, 20664 bp, Homo sapiens
tgtgcatacttatttgtatacatatttgatttttttctgtagaatatgtacctagaagtggaattcctggctcgaagaatgtattttaaatattagtgatattccaggctgatattcaaaatgcccatacaaatttggttttcagtaactgaatgcatgtacccgttactccatatccttgacataatagatactataaaactggtaacattttgtcagtctgtggggtaaaaaatgttaatcctaaaatgtttaattggaattttatgaaaatagtcatcaaccaccatctttatatatttaccagccatttactgttttcttttctataaattgctttcatattcctaggcccatttgcctatgggttttgtctctttcttactcatttgtaggacctctatatattctagatgttaatagttcatctaatatattgcaactattttcttcagtctattgcttatcagattttttatgttttgtcatattaaaatgaaggatatttacataataaaatttgttagtttttttatttatggcttctgaatttcttttttttgagacggagtcttgctctgttgcccaggctggagtgcagtggtgtgatcttggctcactgcaacctccgccttctgggttcaaatattctcctgcttcagcctcccaggtagctgtgattacaggcatccgccaccatgcccaactaatttttgtgtttttagtagagacggggtttcaccatgttgaccaggctggtctcaaactcctgacctcaggtgatctgcccgccttggcctcccaaagtgctgggaattacaggtatgagccaccacactcagcctgcttctgagttttatgtctagttttctatagctcaagattaaaaataaaaactcttaccttataccatgcataaatcaaagagctaaacataaaaattaatgctataactaactacattagaagaaaatgcagttgccttattaggcttttttgatttacctattttcctggaatatcagtttgtctttaaatagctaagaatctgacttatatgctgtcaatacacacagttagtaatacagcatgaaaatcctaacatgcttttctatactttagccgtgatcattttcatttgaagtcctaaattacaaactgatttaaaagctatatatatatatatatatatatatatatatatatatgccacatccatgaaaccttccttaatcaaatctcaagcttcacttttctcccttcaagctccctgaatacaacattcttcctatgagataattgtagtctactatctattacagtaaatttccaatgcattttatctcactgattagattataaactcaacgtggggatcgtgtcttgtttttatatcctatattgattgccaaagataatgatttgttttgtataaaagtgaatgaataaagtaacacatttgctttatttcagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagatactgtctgtgtttcatatatttttaaaagttttgattgttggaatgttatatgatcttaaggtctgtatagacaaaattatgtacaaaaatttgaaactattatatttaaatgggtattcttttatttccagacacataaagcagatttgtttggacatattttggaattatttcactttctttcttttaagggacattagtaaacccatacatgtctggatttttttcttggaaatggaaaggccattagtaaaacgctgattaaaaggcaattttcctattactgttcagtaatcccaattatctatatttttagaaaagtgtttgagatcccttttgaagtgatctacataaagaaatacataaatgttagatgtgtttctaatgatgaagaaaacaaatgtagagttactatatatcaagtcattttgtagcccaatatgtgagtattggaaaaggtaatacgtccagattagttttttaacctgatgtatagaaactagaattattttactcattattaataattacaattggacctaattagatatttgaacatttacaagaatcagaattaactaataaaggccaggtgcagtggcttatgcctatgatcccagcactttgggaggccaaggcaggcagatcatttaaggtcaggagttcaagaccagcctggccaacatggtgaaaccctgtctctactaaaaataaaaaaatcagccaggcatggtggcacacgcctgtagtcccagctgcttgggaggctactccaaaaaagaacaagaattaataaagaaaaatattctttatttttgttgtaaattaagttgtaaattcactagtcatgctccccaccatttgcagggttccaacaatagtacacattgaggcttatatacataaacaccgtagtgggagtaatttttaaatgcaaaaatatgttgtgaataatgatcctcttaataaatgcctagctcagttttttaaaggtataggagtgttatggaaaattcttgagaaaaatcttaacattggacctgaaggctttggcagtttccatgtaataatttttctttctattttttttttttttttttgagatggagttttgttgttgcccaggctggagtgcaatggcatgatctcggttcactgcaacctccactgcccaggttcaagcgattctcctgcctcagcctcccaagtagccaccacatctcgctaattttgcatttttagtagagatggggtttccatatgttggccaggctggtctcaaactcctgacctcaagtgatccacccacttcggcctcccaaagtgctgggactacaggcgtgagccaccgctctctgccataattttttcttttgagaaaaaattactccatttgttttagctttcataaaatctacttttttgcttcatactattattctctattcatatattattctctagaaagttttaacaaacaggttgaggagctcaggtgtggtggctcatgcctgtcccagcactttggaagacaaaggagggtggatcatttgaggccaggagttcaagaccagcctggccaatatgtgaaaaccccgtctctatttaaaaaataataacagtttgcggcacatgaagttaccccttttgtaggtaaaaagtagttacatagctgcagtttaatatgactcaatgcctatccatcatacactgttgatcagattataaaatcaaatagtatggatcaaatgcaatgttaattaagttgtaaattcactagtcatgctccccaccatttgcagggttccaacaatagtacacatcgaggcctatatactatttgtcttaactttgtttttgtttttgtttttgttttttttgagacggaatcttgctctgtcgcccaggctggagtgcagtggcgcaatctcgactcactgcaagctccgcctcccgggttcacgccattctcctgcctctgcctcctgagtagctgggactacaggcgcctgccaccacgcccggctaatttttttgtattttttagtagagacggggtttcaccgtggtctcgatctcctgacctcgtgatccgcccgcctcggcctcccaaagtgctgggattacaggcatgagtgtcttaacttttaaaacataaattggccgggtgcagtggctcacgcttgtaatcccagcactttgggaggccaaggggggtggatcactgcaggtcaggagtttgagaccagcctggccaacatagggaaaccccatctctactaaaaatataaaattagccaggcatggtggtgggcccctgtaatcccagctacttgggaggcggggaggcaggagaattgcttgaacctgggaggcggagtttgcagtgagccgagatcgcgccactgcactccagcctgggcgacagagcaagactctgtcttaaaaaaataaaattataaatcaagctatctgttaaataaaatgttttattctattatcttgacaaatatcccttcataatgacctgtcagaccaggtttgaattcagaattctctgattttatcagattccatgacaaagcatggcaatgcagggagaggtggcccccgcccactgggtgcctcctttatttccccaccccttgatttgttctgcatcatgaagagcctggtgcatatatatatatgtgggtcccccacctatatgtataagatctggctacagccctggtgtataccattagcccatttcactcgtaagaggtatgaggccagagcaagccctggaagccggcttggagctatttgggctatttgggtgttagatgcacttctagaagggggcatctgttctagctgggcacatcacgttggcagtatggattcttatcctgtggggcagagccagaggtcagagtaaagtcttctaaagtgtcggtccagggtaggggctcctcttacctagaccaaagagtggtattgtctctagacataaggttctttttcaaattgtatttctattccaagggtttaagttgaaaatgaatgagtagattcaagaaaaagaattccataacatccaacatttaatgatttaaaaagaaaagcctggtaactagagtggaaggaagcttccttaatcagagcagctgtgaaaaatatatgggaaaaaatcttatttagtggtaaaacttttcaaacattcacattaaaatttagaagtaagttaaaagatgtctagcccctaccttctgtatcgtattagagggcctaaccattgcagtaaaacaaggggctaaacagtttaagacgtaggaaaaaaatctgaactcactaataaatctcgacatctctaaaagtgggacagtatgtatatgccttctgctatgatgcaaggaagtacctatgaagtattcttgcaaaagcaaacaaaaaaccaaaaactaatcaagcctctagatgtcactggcagtttctggaacaaattaagcatcaccatgaagatgtaatcagcagaatcatgaagtgggaaattctataggaccaatgacttagattcttcaacaaatggcaggggggaagaaatggagagggaattgtcatgtgaactaaatgcaatgtgacaatcttgttggatcctgattttaactaactgtggaaggaagggcatttttgagacagaaaactgaacatggaacaggtatcagatgatattaaggaattattaattttgttgggtatgataatgggattatcagtatgttttttaaaaataagaaaaggcaggctaggtgcagtggctcatgcctgtaatcccagcattttgggaggctgaaacggatggatcacaaggtcaagagatcgagaccatcctggccaacatggtgaaaccccatctctactaaaaaaatacaaaaagtagctgggcgtggtggcgcgcgcctgtagtcccagctactcgggaggctgaggcagaagaatcgcttgaacccaggaggcagaggttgcagtgatcacgccactgcactccagcctggcgacagagcaagactccatctcaaaaaaaaaaaaaaggccttgtctcttagagatatacattgaagtatttatgggtgaaataatatatctagatatgctttaaaatactccaggaaggctgggcaaggtggctcacgcctgtaatcccagcactttgggaggccgaggcaggtggatcaccttaggtcaggagttcaagactagcctggccagcttggtgaaaccctatctctactaaaaatacaaaaattagctgggcatggtggcaggcacctgtaattccagctacttgggaggctgaggcaggagaatcgcttgattgtgggaggcagaagttgcagtgagccgagctcacgccattgcactccagcctgggtgacagagagagactccgtctcaaaaaaaaaaaaaaattctgggaaaaacacagaacaaaatgaaaaaagttgtggagaggagaggtaggatagataaaacaagaatggcaaattgtttaagctgaagctggatgataggaacacagggatttattatatcatctcttgtatttgtttgaaaattttcatactaagtttattttacaaattaaaacattaaataaaatagaatttaaaaggttggtgtttgcataatgttctgctaaataaaaaatcctaaagaactttagacaaatttttttaaagtcatttttattttatcacatactagtttccatctaccataatatgatttttttttttagagacagaatcttgctatattgcccaggctagccttgaacacctgggttcaagcaatcctcctgcctcagcctctcaagaagctgggattacaggtgtgtaccactgttcctggcacagacaaaatactagaataacagaattcaacaaggtttttggtacaagattgctgtacaaaaatccacagtgttgctataccccaataatagccaaatagaaaaaaaaagatgtgaaaaacaaaactataaaactatgaaaatgaaaatgaaaatcttagtgacctcaggagagggaaggatttcttaagaaagctacaagtcagctatcataacaacagattgataaatttgactacattgaaattaaaatctagagaacaaatcaccgtaaacaaagacgacaagtgtcaacctgggagaaggtatttataacatataccaagcgttaacttaaaaaagcccaacaatgggctgggtgcggtggctcatgcctgtaatcccagcactttgggaggctgaggcagaaggatagcttgagcctaggagtttgagaccagcccgggcaacaaagcgagactctgtctctctctctcttttaaaaatgtatatattaaaaagccccacaatgaataaatttagaaaagaaggggagactttatggcctgcaaggtggccatcctgcaggctgggaagcgtgcctccagaaacaggcgctttgaaggaggagggcttggagtgtagttcaggctgaacaggttggctaaacctacattttcaccaggttacaggaagagctatgaatattcatgaaagtggtcctgacacatgcgtattgaacaaaaactcatgtaacatatgacccatattcactttgggatggagacttaacttttttgttgttgttgttcagacggagtcttgctctgtcacccaggctggactgcaacgatgtgatctcagctcactgtaacctccacttcccggtttcaagcgatactcctgcctcagcctcctgagtagctgggattacaggaacctgcccccacgcctggctaattttcgtatttttagtagagatggggtttccccatgttggccaggctggtctcaagctcctgacctcgtgatcttcccacctgggcctcccaaagtgctgggattacaggcgtgagccaccacacccagccaagacttaacatttaaatgtattacgagccctatacgtcaaaaggtctttcaggacatgaagccatgcaaatgtgcgacctctgtagaccagccagaaccagtccatggccagtggtcttcttacctggagaaagttactgaaatcaacaaaaagttgtccaatgaaagctgtagctatggctggtggaacggggactgggggtcagtaagtcagcatctcgtggagctgcacattattttaatattgtttatctttaggccagtacttgtttagctgctagagaagaatcttgtggcagttagaacacagtttattctttaagtataggggtgtgggactaaaaccttgcctggaatggctttaggtcttttttataatttggcatcttattgccagagtctgttctgtcagtcttatcatctctgttttaacattaatgctggccagttgttgtgttaaactacaaaagggagggagtataacaaggtgtgtctaacctgtcccatcgtggtctagaactcagttttaaggttttctaggatccccttggccacaagggggcctattctgttggtggcggacttaggagtttagttttactttatacaggtgaatgaatagagcaggctatctaatgacgtacacatcatttgtgaaagaaaactccatagcaaactttataaaaggtaagagtggacagttcacagaagaggaaataaggtttcataagtatggaagaatgcaccactttgttagggaaatgtaaattgcaattttcacagcggtaaaaatggtaagagtctgaccatatcttgtgttggagagaatgtggaacaaagagaactcatcaatgctagtgagggtgtaaactgataaaatagtacatacattatttaagacattcttgaggctgggtgcggtggctcacgcctgtaatctcaacagtttgggaggcagaggcgggcggactgcttgaattcagaagttttgagaccagcctgggcaacatggtgaaatcctgtctctacaaaaaatacaaaaattagtcgggtgtggtggtgggttcccgtagtctcagctattgtggggagaggcatgaggatcgcttaaacctgggaggtcaagctgcagtgagctgagatggctccactgcaatccagcctaggggacaaagtgagcccctgtctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgattttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgcggcaaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattggggtgagtgggatctgagaatgtaccagggtggctcgggttcgcgtctaaaggtttcttcctccctacttccgcccactcgtggtgacaggtgtggaccaaccctgcctggggagtgaggcccctcgtcactcctgttcgtgcccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtccgtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctaacagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtaggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgatacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgtctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcttcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagattttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgttttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatat

SEQ ID NO: 1213 - DNA, 188527 bp, Homo sapiens
cctgaaatgcaagaatacaagcataacaataatattactgtttttatatgcaccaatacctctctttaatatataaagctctacaacaaatacctctaataattttacaattaaattaagtccatacttctatactactttggtctcaacatttttaaaacatcaattaattttgaaaatttacaatttaacaacatgatcctatcaataacaagcacattttgtagtggattaaagacacattcaaccatgcaatccagtgttcaataccttaatgataaataacaatgctgattgacttttattttgaaaaatcattgaaaactggaataatcatctgagactcacagtgatcacaaacatgcagaaaaaagcatacaattctattcttcctgaaggaatgttacaaaatgcccacttttttatatagggtcaatatgccaaattacttatatttttcaatccatcatcttctaacatttgtcacttaaatttttcttaaagtacaaatgttcctgtaagttgtaacagaaaatgaaccccaactctttcagtctttaagacctcagtcacagtcccacactaatagctgccttttagtaaaatagtgacatccagtggacaaatgaaatatttctcaaattcccatatttgaatcataaacaaaagttgcctctttaaatccaacaattttagtatgagttcctacttattttgatggaatctacagattctcatgaatacttcacatcataatttctatgtatcttaaatatatcctcttttcttcctatttaaaatcaattatttaaattgagctagtaagaatgtctactcttgaagctagtgaggttaaaggtattacttttccttctttgcttcagctacttcccaccaccaaataactggtttgtctctaggaatggaaggactaaaatataggggaaatactgtgcatttaaataaaaatgaatagtatttaaaagaaatcacaaaagatgaaatctgaacctgttttgcatttataatttgatgtacggttgaacataaatagggatgtaataagtaatgctatcaattacatcctcttgcctcaatgctcaaatattaagaatatgtattttagcaatgattgtttcagtgtttaaaaacttactttcataaatcagtataaatgaatatccattatatattatgtttaagtaaaagtgaaaaaacttgcactgtactgagtcatgatttaccactggttatatatattatgtgtgtgttcaaagtacaaaatgcagcaatgatgttaacattgacagtgtaatgaactgccgtagatgagactgttatgcttaatttcttggaaaactgtaaagaaatttcacaggttaaaaaaaatagagtaagcaaaaaaaaagaattggagaactttacttttaaatcagcagctaaatgaagaaaacttttcctttctaaaaaaagattaagaatgtaaaagtacattttaatattaaaaaagcattttaaaaaatctataacaactttatgacaaaatctgcatttgaaaaaggcctgtaaaaacagtaggacagaattgccctcatcaccttttactttttcttgtcagaaaaaagtgtatgcatctctggaaccataaatgatgttaaaataggcatttataaaatgacaaggagaatttcatgataaatttgtttgttttcttacaatcattggcattgcagccattagtaagtcacaaggaaaacttctctagctaaaacgcaaaatgaaatatcaagttttgaaatgtattaggtctgttgcctgcgttttgctgatctcattttttcaaagcgcgactccatttcttctaagactttgggtgtgtatcgtaccactaatttaacctttccttgtgcggctttcagcagttctacagctttttcatgatgttctccttcaacactctaggggaaaaaaaaacaaccaaccatacactaatatctaagttttgaaagtaactcaaaatgcaaaaatgtttacaatatatataatgaagaaaagttttaatgttatattattccaacattacaaaactaagaaataatcctgccttaccattttaatctatatgaaatcctctcttacatcatattctgtttatagtctaaaagctggcttttaagttccaaataattagcatattaatctatatgccttattatttcagtagatcaagcaattggcattttataagagtaaaatgagggtagacttctaatttaatgtattgcctttaataaagagcttatgtcataaaaatgacattaagcactgctaatttacactgcaaaatacacttatagtgcttaaaaaaaaggatcactgtattaatagtactgcctaggattccctcaaggcatttctaaaccacaagtttcttaggtttctcctattactcaaatacgcccccaggtggtcacaacagatcactacaaatagaaataaaattcatccttaccactccattaacagagaggagttgatctccacgtttgaggcccccatgtctatcagcaattccacctggaattattcgggatatatagattggagagttttgttctttgcctcccataatattgaatccaaggccctcttctgtttttggtagctcaacaactcgaggatgagaatgtccttcactggcagcaaatgcagcaacagtagcctgaaagaaagttttacatattaaaaatatgacttttatttacttcagttctttcatcttttgtttccccccgagatggagtctcgctctgtcgcacaggctggagtgcagtggcgtgatcttggctcactgcaagctccacctcctggcttcacgccattctcctgcctcagcctcctgagtagctgagactacaggcgcctgccaccacgcccggctaatttttttgtatttttttttagtagagatggggtttcaccacattagccaggatggtctcgatctcctgacctcgtgatccgcccgccttggcctcccaaagtgctgggattacaggcgtgagccactgcgcctggcctcttttgtctctttttaaaaactacttttgagcacgtatttttgacgtctgaatgctcacaaattcactggtgattctgagaaggtaagctaaacagaaggtattttagagacgacaaatgaataatttcgagttatgcaggaaatgttacgattttttgttatgattttttaggtcattcctagcccattcagtgcccactcttttgtgcagtcctgtatgcgcagggcttggcaagcagacttactgggcagactgatattgtacatggtaaggaggaaaaccccttccccagcatgctagcagccctgggctttagatctggatctcccaactccttcaggagcctttgtgcaggacacaacctacctatataatcaacatggagttgcccttatatgtaatcattttggcttctgtactatttgtactatatactaaatatctaagatgtcaagaaataactcaatattgagaaaaagagaggtacatatagccaatctgaatgttttgttgctttagttaactagacacaactaaaaatccccacagaagatgaaacagagccgtatcttctttaaagctcaactttagactaatccaaactaattataaagttgagattttgtttcactttgctttaaagggtaattatctagtaccatttttttgtgatggatcacaaaaatggggaggaggaaagaaatcaagatttactgaacacccgttatctttgaagaaatcaagatttactgaatacccgttatcttcgaagctctgaaaaaggcctcatttttcagataatggaattaaggctcagaaattcagtaggctatcaaactcacacaactcagcaattaaaaccatgtttctctggtcttttctacactgataaactatatccacatgtttaagtatttgtattcaacaaagaatccaccatttccttttgtgagccagtaactatccataaaaaactatctgctgatgattaatttaagtcaccgactgctgatattaccctgttcaaaccccctatcatgaatagtgaggtcaatacctaaattatttgaggaaaacaatggcacagaaatgcagataatgtaaagaagaaagcaaaaatcaactcggggaagtaccccagctctatcatatgctatttgtgtggtttgcggcaaatcacctcatgcttcctcatcaataagatgaggatagtaattcatatcttaaaattctgattagattttgtataatgaatattatatagtatcatatatataacatatacaacacaattatatattgcatgatacatattgtatgcaagtacatttctattgcattatctaaactgcatgataaaatagcttatgtaagctatttatcatgcagcatttatgtaaaggcaatagaaacaaatgtcttatttcttagtacttgagaaatttggtgtagcttgaaagatacatgttagtcttcaaagtaagtttattatgaatttaataactccatattttaaacttctaatttatgaagaattcttacttttggaaaacaaaaaaatttacctttgcagtagcgttcgctctcacttcaggactgctactgatgtccacagtctcatagacatgttcatatacctgtaaaagccaaagttatatctcagaatataccatgcttgagttctctgtgaagttaaaatttcaggcaaagttatgcatctttataaaatggttttatcagaaattccaaaaatgagagggactggttttaatgttttctaaagtttttcttaagaaatgttgaacccaaatttagagtattatctgacctaattaactcaaatttttgtaaattttaatgatgtttactcacctctctcacagcattgcagaattcactttgaaggactctttgcaaagcctgaagtttctgtggtggtacttctccactcctttgtagtttttccaataattcaattgctctacaaatatctagagttaaacacacacacagataattttctccaagggttttctcaatgcctatgtaacagtggggcagttaggattcattcctcaagggcaaataatatacagacaatcgaggggaaaaaaagcattgaatttgcacatttggtgggaaggagactgtgtgtgtgtacacacatggagggtgagaatgtaaaatgtaagaacactaaattttacagtagataggaaaaactactgagattacagaagcataaaataagaccttggagaaacacaggcaaattgaacacaaaataccaaatgtcatcggaaaggactgtgactcaaatgtgaccgatacatgaacattgtactgcttcagaaaagctagcaatattgtcagaaactagtcaataaaaatttacctaattattattagtaaccaaagcactgaacagtacaaggcactataagctagtaaaatcactggtcattcctcgaaagaaacatgatacataggtagataaccactcgagagcagatgcagttagtggcagggacacatttaaaacaaccataaaaatgcaaaaaacaagcagtacaaatgaaataaactgattttttttcaacttaattaacactgttaattcaaacaagctccaacacttatgtttacaaaaaagaaaaataaaaacaattagctttatcaatctggtctcaataccacctgtgtgaccttgggcaagttacatgatgtccttatgtctcagtttctttcactgtacaatggaaataacagtaccttccatataagggttatgaggaagagttatgagttcagttaacaactgaaccacaaaatacataaaaaagggcttagcaagcaaaagtgttatgttacattggtaccaattaatcataagaaatattggctgggaatagtggcttatgcctgtaatcccagcactttgggaggccgaggcgggtggatcacctgaggtcaagagttcaagaccagcctggccaacatggtgaaaccccaactctactaaaaaaaatacaaaaattagccaggcatggtggcgggtgcctgtaatcccagctacttgggaggccgaggcaggagaagcgcttgatcccaggaggtggaggttgcagtgagctgagattgtgccactgcactccagcctgggtgacaagagtgaaactccatctacaaaaaaccaaacaaaacaaaaacaaacaaacaaacaaaaaaaaccctaagaggttgtatacatttatacaaatgtatgaagcacattagggaattctcactgagaagtgtgaggataagtgttttatgaattgagacattttagaagattcaggaagtcagctataacactgttaactatctctacttttatttttccaaaaactgttttggtatactgtttttgtacccctggtactacaatgcccagtattctattattgctttgcttccttttgacttaagtagaagttcctgatttcgttacactcaaggactggaaatttttctttatagagttagtatggccttcttcgtgtttgcagatagaaaactatgaataaatgtagtaaagaaagatatttatttatttatttgagatggagtctcactctgttgcccaggctggagtgcagtggcgcaatctccactcactgcaacctctgcctcccaggttcaagcaagtctcctgcctcagcctcctgagtagctgggattacaggagtccaccaccatgctcggctaatttttgtatttttagtagagacagggtttcaccctgttggtcaggctggcctcaaactcctgacttcatgatccacccacctcagcttcccaaggtgctgggattacaggcttgggccatcacacctggcagaaagattatttatttatttatttgagatggagtctccctctgttgctgaggctggggtgcagtggtacgatcttggctcactgcaacctctgcctccagggttcaagtgattctcgtgcctcagtctcccgagtagctgggactacaggtacctgccaccaggcccagctaatttttgtatttttagtagagacagggtttcaccatgttggccaggctagtctcaaactcctgacctcaagtgatctgcttgcctcggcctcccaaagtgctgggattacaggcgtgagccactgcgcctggccagaaagcagatttttaaatttgaggtaaagaaagcttaaacttaaaaagttaatcaaatgcaatggaagcaaatagaccttcaccattctgatttcccatcaccagaatgaccgatacatggggactgttggttcatcaattattttgatttataaagttataatatataagccatataaaaatttccagtgaagaaaaaaatggaaaaaagtaaaatgcttttgactaaatctaaaatgtacctactatgtgctcaaatttgtgtttcattaaatcatagtttgatgatttagaaggcactctaaatcatcatatgtgatcaggcactgtattgtaattgtactgtaggattttctactttaggatcgttgggagtgtttgttaatagagtctgttagaattctaaacaagaatcagaggtgatgtaatctgactttcttaccctgctaaatggcaaccactagtacagctgtcttggtaacagtgggggattcattaggaccttcttcagataccacagatatcaagatctgcagatgctcaagtctctgatataaaatgatatagtattggcataaaacctatgcatatcccccctctatactttaaataatctctagattacttacaatatctgacgctacgtaaacagttgttatatcacattgtttagggaataaggacaagaaaaaaatgtctgtacatgttctatacagacacgatttttttctgagtattttcaatctgcagttggttgaaatatggaacccatggatatggagggctgactgtaattcatcctactaagaggtggagtcttctactgaagaacagaaaagaaatctgtaacagcaaaaaacaaagccaagactatcaaaactaaatgccacagaagttccacattttgtgttgcatttaaaaatacaaagaccggccgggtgcagtggctcacgcctgtaatcctagcactttgggaagccgaggcgggcggacttcctaagctcaagagttcgagaccagcctgggcaacacggtgaaaccccgtctctactaaaatacaaaaaacagccgggtttggcggcgttcgcctgcagtcccagctactcgggaggctgaggcaggagaattgcttgaacccgggaggcagaggttgcagtgagccgagatcgcgccactgcactccagcctgggcgacagagcaagactacgtctccaaacagcaacaacaaaaacacaaaagaccaatacgttagaatcttaactagctttcaaagaaaaaacttactcctgttaacaccaaacagatttgctcccatctataaaacacagtgccactgtgctcaagaggaagatgtcagagacttaggcctaactcggcaagtcttcccagagtagctagtcctctaaaatgatgctttaataggcttaacggaaacaatctcatttacagtgaggcttccaaatggtgaacacggtaaagagcaaatcagcaacattaagtgcacatttgtttgtgggaaggcattaggaaagaggtttttctaagtacagtaattctaaaaatgtgttttcttagggaacaatagtaatatttagactaattgcaaatgttaatatgtgcaatataatttcagtctccatcctacatatacatttttttttaccaccagtactcaaaatgtttatttgtacttctcaattcctatcaatgatttctaatgctggtgtatgaaaagcatgcttgaaattgtttgaaataaaggacttagggacagagtggaatgctggaaatctgtaaaaggactggaaacgctggaatgctggaaatcatggtaggcgcatagccagttattttcgtaggcttctctatctctaattactcagcagaggtggttttattttccttgacagtctgctctaggaagcaatcagccaaccagtttgcaattgtagggtttgtaagaaatgaaaaacactgcacctgcaagtgttttagcatctaccactattcggcttacttacgtaacctccttcccaagaccaagtcagtaggattgtttttaaagcaacctctccatttctaggaggggcacaaaagctagcaaataccccaacccgaatacaagcgaggttgtggagaaagtaatgaaggagtttgtgtgcaaacagcggggaaaggaggttctgttgaattgtaccgtgtgtccgttctcgtgctgtacaggcaatgagtgtagtctgtgcgaaccgggtgtgtgacgtttgcttttcgggtgtacgggtctccgaatgctgcttctgctgtgctcaccaagggagcgcgtgtgcggcgtgtgtctgcgaagcgggcaggttgtgtttagttgtgctgtgccttggaacagtccgtgtgaacagaggagggcttacggttaacagacaaaataccgtaagcgcccttcctagagccaggcacagagacaacggcggcctctggcgccggcacaagggacagcgtggcccggatctcagagcctgggtcactcctcctcccctccagcgacacagcactcccccaacccttccgcccacctccgccgagcctcggctgcactcacctctctccagccgcacgggttcccctagcgccgccatcttctcccttaacctacagacccacaggaaatgacgacagaagggctgaggtgggggggcggggcctaggggaagccggaaaagtgagtaccggctagtatcgcgagatcaggaaggtggccgagtgtgtcgccgcggccatcagggtaagggtacctggacttgcggctttttaggtcggcctggctccgctccttccgcggtgacgaggtcccccggcctcctagggttgggaagagctgctttcctgactctcgttccctgcctcaggcttcccttatcccaatcgcttcgaacccttggctcagcgtagaggagtcaagcctggattctagtcccaccttgcccattagcagctctgtgacctgggactgttcacttaccctctctcagcctcagtttccgcatctgtacaacgagaggtcctatctcttaggtccttacaatttttaaactctgggattcggtggcaattaaatgtgtaatgacatgttgtcagttctcaatttgtgacagcattgctttaaatttaaaaatccacggcttgaatcttccctccaaatctgttaaggggtggaaagtacaaagagcatgaaacatatctgggtgagggagagaacaaggtgctttggtgcaccacaaagtaacaattttataagcagctgattcttataaaatcttaagtaaatgaaatattgtgaagcaaataatattcttaatgcattacagatttttgagccacttctgaaattttcgcgaaccaagaagaattttagtacttggatttgactaacatttatccaagcccttagtctgtactgatactgtggtaggtgtgtttacatccagcatttcaacacttcatgatgggactgttttaataacctgtttgcccctggtccaccctttccattcacctttagtattttcttctccaaatccatcatggatgccaccactatgctcctttttctccccttgaattctgatttcatcatcacaagttctgttcagaaactttcaatggtttctctcctgtttcctatttctaaagccttgcatactctgaccctaactcatccaactaacttcatttctcattaccactaagtgcaaccaccacttcagtccagatagtatagtttcaaccatatttattcctgattccaagtctttttgtttgttttagagacagagtttctctctgttgtccagactggagtgcagtggtgcaatcacagctcaagagagcctcctgtctcagtcttgccagtagcgaggactacaggcaagcaccaccatgcctggcaaatttttaaatttttagtagagatgggggtcttgctatgttgcccaggctggtctcaaactcctgagctcaagcagtcctcctgctttggcctcccgaagtgctgggattacaggcgtgggccactgtgccaggctccaaatcttcatttgtgttgttcttgtgtggaatgcccttcttcatcccttcctagtctccaaactttgtacacactcagttgaacccatttcgtgggtccctgctgaaggcatgccacttctaccaagccttttctccatattattccccttttttgtcctctgatggcctaaatacgttgcagtaacactcaggtgcttatctcttactcgttgtcatttttttttgctgcaaatgtgttcaagaaatgtttattaaacacctaatatataccaggtgccttgataggaataccaggtagagcaagacaaatgcaaacattgcccttatttcttcaaatattttttctttccattctcttgctcctctcctttggtgtgactattggagtcatgtgcatgtacataatatacatgtatattgaactaactggcattgtctcacagctcagtgacgctctgttcatttttttttcaagattttctttatgtttccttttggataattgctatgttttcatattcattaatcttttttcaatatctaatattgaaatcctgtccagttcattcttcatataaaacattgtagttgttgcctctaccagtttgatttgggtgtgggtgtgtgtcttacatcttttatgtcttaacatgctcaacttttctgcagcttcttaaacacatagactacaattataatgacagttttaatatccttgtctactaattctatgatctatgctatttctggcatagtttctattgattgatttttctcttcattacagttcataatttcctgcttcttgcatgcctggaaatttttttttttttaacaagatgctagactttgtaaaatttacttacttgaaaaacaattttgttcttttgggttttgattttttttaggtggaaccaattcagtcatttatgtagggttaattgtatcccactactaagacagtacccttcaaagttccttaccccatacccaaagtgaattatgtggtttttctactttggtaggaacgggaactattcttaggaactgagtttgtggactttttttttgctcttttcctttccctgtctggtaatttatttcttcttctttcttccttctccttcttcttcttctttcttcttcttcttcagatggagtcttgctctgtcacccaggctggaatgcagtgacgcagtctcggctcactgcagcctctgcctcctgggttcaagtgattctcatgcgtcagccacccgagtagctaggtttacaggcacctgccaccgcaccctgctaatttttgtatttttcgtagagatgggatttcaccatgtttggctagctggcctcaaactcttgtcctcaagtgattcacccaccttgatttcccaaagtgctggattacaggcgtgagccgccacacccgggtggatgtttaacacatgtaatcatcataaaatttcagaatcctaggaatagatagaagatcctagaagtttccagagaggataaaaaattatattctaaggattggaaatcagaacaagattgtacttctcctcagcagcactggaagctaagacacagagagcaactaaatttttagaaaaaattatttgcaaactagaattctatatccaactgtattaggtttctagggctgccataacaagatacaacaaactgggtgacttaaaacaatagatagtcactgtctcacacttctggaggcgagaaatcagaagccaagatgtcatgtgctctctgaaagtgtagaggattccttccttgtctcttcctagctttctggtagtttgctggcaggctttggtgttccttggtctgcaactgtattacttcaatctctgttgtcattatcacatggcgtcttcccttgtgttatctgttgtcagctggaaatcatcttacaagaacttcctatttcggtgtgaccttaccctaaattagttgcatcatcagtgacctcatttccatataaagtcacattttggggttctgggagttagaactttaattttttttttgaagggaagagatacagttcaccccgtaacaccaaccagagtatcaatcaggtgtgaaggaataatgaaaaatattttacacatgtaagttctaaaaattgttaaccttccatacatactttctcaagagctactagaaaatgtgctccatcaatagtaggaagtgagccaagccaagtacagtagctcatacctgtagttcaaacaactcagaaggctgaggtgggagaatcacttgagcccaggagtttgaggctgcagtgagctatgattgtgccactgcactccagcctgggtgacagagtgagatcccatctttaagaaaaaaagttagctggccagggctggtggctcatgcctgtaatcccagcacttcgggaggctgagacatgtttatcacttgaggtcaggagtttgaacccagcctggccaacattgcgaaactccatctctactaaaaatacaaaaattagccaggggtggtaatcccagcccctcgggaggctgaggcaggagaatcacttgaacccgggaggtgcagtgagccaagattgcgccactgcactccagcctgggcaacagtgcaagaatctgtctcaaaaaaaaaaaaaaaaaaagttagccagtaaaggtatgtgtaatccaagaaaaagaggatccaatatagaggagattaaggtgatttcaaaatgattagtgtatcagggtgcctcacagaaacagaaccaatagaatatatttagatatatagaaaggatttattatgatggattggctcaggagactacagaagccaagaaatcccataatttgctgtcttcaagtgggagacccagaaaagatgctttagttccagtccaagcatgaagaaccaaggcctgagaaccagaagagcctctggtgtaagtactagtctgagtccgaaggcctgagaactgagaacactggagtccaagggcaggagaaagatatctgagctcaaacagaaagggcaaatatgccctccctctgtctttttgctctatttgggccctcagtggattggatgatgtctgttcacattagtgagagtgatctttactcagtttgctgattaaaatgctaatctcttctagaaacttcctgacacactcagaaatattgttttaccagctatctgagcatcacttagcccagtcaaattgacacataaaattaatccaccacaattgtgaagggaagcctagggtagcagacatgcagctggcaaagagagcaatccattcacactgaagcagggcagaagtggaggtgaggtgttgccaagaaaaaaatgaaatatgtagttcaccagtgtgggtgagcatactgataacacatttatgcattttagtggagagtttgggaataaattggtgataggcacatagaaaactaagcaaacgggaggaaataaagcaattattaactccaaaaaaacctgaaaagccatgtaataaaggaaatgtttatgagtataaggtggatcagctgcatacaacatattcagcaacttttaatttttttgagtataaaccctgtaatgctgtttgcatttttaaagacattttaataaaaatgaaaattaataaataggaatcacaatactaaagataatatttgatatattttattttgaaatatttaatttgtattggcctcatcttttcaatttgaaatctttgctcttgggaaggggaataagaaaacttaattataagcacaatttgctgaaaaagcacagacttactaggtttaaagtagtgtttaatgattagacaattttcatttaatagatttgtacatctgctttgtttggtatttgaatctcattgtgctgtagtctatggatttgctacccttgatcagatactcacccttggttcaatcaattctatctggtacagtggaagtaatggttcacccaggtccctgataagtctgggggtagaatatcttcccttagaaaaggctagagtacagcaggcaatgtatttggcctgtctaatatagtacattacatatacatttgggaaaaatgttgcaaattccataagagtagcagcctgacattatgggaagagcacaggactaagtgtcaggagctctggttactaatcatagatgagccaccttgtgatagtgtgatcttgacaatgtcacattctcactctggacctgtttccttatttggcacgaccactgaataagatctgtctgagccagctgcagtgacatccacctgtatgtagtcccagttcttggaagactgaggcaggaggatggaggccgggagtttgaggctgtatgattgcgcctgtaaatagccacttttcttcagcctgagcatcacagcaacaccccaaatctttaaaaaaaatctgtcagcacattaaaaattactttactctatgtcaataaagtaattaatataaatacagattcccttgaacttcatggacttatcaaatcagaatccttaggagaaggctctgggaatctatattttaaaaaatccctagtgattctgacacagctagcctgacacagggacctgtgttcaggatttaaaagattatttctagggcctttttctactaaaattcagtttccctataaaactgcagagaaaaattattgagaaaatgattttcattataaaagaatatgtagctcttgcataaagggcagcatttctagctaattttaaaatttattttatattattttaggcatagataaggaagaaaaaagttttggaaactacttctgagagggaaaaatatgcctgaaattaaccaacagccagcttgtacttaacatacaaaataaacaaaagaatcaactattgtgtaaggagagaaccccgaaatgttcctcgttaatcgaaattcaagagtattagcgtcgggaaagatctagagagtcaactccctcatattaaagaagagaagatggattgctgtcctacattcaaaggaggccattaggagcatgaaccaagggaagctggttttccttctatgcctctgccaggttattaaatcaccaggcctcctaatcaagaattgctcttcgtgtggaagaactcctcttcacctgttgcttcctcatattatttcctgcctcagagatgtagaggaactgtaaaattagaataggatgtttgggtctagacaaatcccagtgaaagctaaattatggaaatttagtctttgtataacaaatgaaaaccctaagtaggctgccaaggtacaaaagctttcttaacccgagacattgcaaatacaacgtactaagtgaaaaaaggagtgggtggggaacagtgggagtagaaggctgtctaaagggaagctaggaaaatggaaagtaatatggagaagcaacatgctccaagtggagtgttttactatttcattgcctgttgaactgtacacaaataggcactactacataaaatagctatttgaaacagttatgccattgcagggtagaacattactctcaagtaaaggcttctaactgtacaattaaagtctcaatcttctttttttaacagaatttctctgatgtactcagcaaagtaaaattttgaatagattattttatttgaagtgaatgatattgtcaaatgttaaagagtctgcattttaaaataatttaaacaatatataaaaacacttggcctaattaagtaatcataacagtatggaaaaatctcttcaagagcacctttgaagggaaattttatcacagatctcagatcagaacatagaaacccatctgtgagttccagagatctaacataaaccctacttttccttgtaggatgagttgcagattctattaaagtgtaagggttgacttttttaatgtcacttgtttcatcatcactctgtagtacatgtaaaggcacagattgatgtatttttctggcatcttcctgacgcacccttgccctatataaatcggtttgccaggatcttgttgcttaaattagcgattgcaaactcttggtcctgccaacacagccgattgtgccaaggttctcagcatctactggcacatgaactgttgccttttctttggctttctgcatgtacctggggccatcatccttccttcacaaagcagcagtctggcttagttgtccctgagaaagacttcaggattggttggactcaactctggccctcttcaggttgtgcatcctgcacaatgtattttcagccacacaatgtattgttcaggatttgtcgtgcacatacttgcagattggcagagccaactgccagagatgagaaccttttaagttgttgtcaaacgtcataaaatgtgttccgtgattaattttgtgggcacagattggtttttgcacagagtccaaaatttaggatatgtcacagtgactaaatggcaccggcatgctgaatgaatttggaatttgttttgtcaagtgtgggagcaggcacacagatgggctttgatccagtggtgctgcttggaattctcattatagcaatgatgtcacttgtcacgtggagtaagtgataatgctgccaaattgtggaaaaagcaaggcaaataggaaagtacacagaccaagagaaaggacttaggtagcacagtaagctttcactatcagatgaatggacataaacattgcttttgggctgccaaaaatatgcatagtaaaaatacaggcagaaaggaaaacttccaactgaaagggcccttaaagtagggcccctgtaatccaagaagtcttcacttcttagagaaaatcaagtaaagcaaacatgtccttgatttttatattaggctatgaaagaaatttctgagctgcaatcaagagtctttctgcaatatctaaccaaaccaaagccaaagtattttgctttataaaaaaaacctttgtctatgaagaagatcagcagtcatgctgggaaattgaaaaaaacaaaaaccttatagtggcaaagaagtacagtatactctcaccaagcatgcacatcagaattctctgtagggctttaaaaatatattcttgatgcagctacagcagtgcttagagggaaatttatagctataagtgcctatattaaaaaaaagaaaaatatcaaattaacaacctaaacttctatcttaagacacttaaagcaaaacaaactaaactcaaactaagtagcagaaaggaaacaacaaaagttagggcagaactagaataaaataacgatacagaataggaaaacatagaatataaataaaaacaattgagaaagatgatgaaaccaaaatctggttccttgaaaagatcaacaaaattgacaatgctttaactagactgaccaggaaaaaaagaggaattactaaaatcaggaatgaaacgggacatttctactaaccttacaagaataaaaaagaatattaggaaatactataaaaatctctctctcttgccacacacgcagtatatactatatataactgaatgtatgtcatgtaacttatctaatttgttgaaaaatatatttgtcacacaattcacgtcagagggtcaccatgtaaattttgattcaaaaactcgagtatggcatgaacatttgtattttctgaaaatataaaggtttttgtgagtgacatgtactttttgttgagaaccattgatctaccacatggaaggcataaaaattgtggaattacaattaaatatgcatcaattagaattaggtatagctgcatataaacacaaaaatccaggctgggcatgttggctcatgcctataatcccaactttggcatgatctcagctcactgcaacctccgcctcccgggttcaagcaattctcctgcctcagcctccccattagctggcattacaggcgcctgccacgacgctcagctaattttttgtgtttttagtagagattggatttcatcatgttgaccaggctggtctcgaactcctgacctcaagtgacccacccaccttgaccttccagagtgctgggattacaggtgtgagccaccgcgcccagctattcccagtattctgggaggctaaggcaggaggatcacttgaggccaggagtttgagatcagcttgggcaacatagcaagaccctgtctctacaaaaataaaaaataaaaaaaattagctagtcataatagtgtgtgcttgtagtcctaactacttaggaggctggggcgggaagattgctcaggcccagaagttcaaggttgtagtgtaccactacactccagcttcggtggcagagcaagaccctgttttggaaaacaaacaaaaaactattttgaaaaaaaaaaaaaaactcacaaaagtccaaaataatagtgcatttaaagtgaatgaaagaaatccatagataggtaacttggtgcaagtatgacagccccatggtatcaccaggatcccagcttttttcattttgcatcaccatcctaggacatggcttccatagtcaagttcactcataatctgagatggctgcaggaatttcagtcattacatgtgagttgcatgccagaaaaaaagaataaggaattgcagaagggtaaaaatcaccctttccagttgaataagcatctttaaagcacccttttcagatgtccaacataatattttgacctatatcttcttagccagactcagttacatgtctccatcttactgcaaaagaactaggaagtaaaatcttttattttgagtgacaaagagcccagctacaaaatctcaactctgtccccaaggaagaaaggtaaaataaatatggggataagccttcagcaagctttgccatactacaccacaacttctggaaattacctttaaacctagttcctgcagcattcccggtcaatagatttatttcccttcattggaaagttttcaacttaactcaaaaacgtttactagcaggtgctacaggagagaggagaaatgtcagatgtgttcatgtccttgaggaactttcaggcaatttcagcaaacggaaactacaccaatgagacagtaggaatgttatctacctgtatgtactgcaatgctatgttttatggtttggaccactactttatattttaaacctaaaaacccattgtctgcaaactgactcaaactaaattgaaataagccacattactgttttaacccaaactgattctgaaagctagtatttactcaactacaaaccattcagtagtgtgaagattaaacaaacaagcaaacaaaaaaaccctctccagatcctccagatccatgtttccccttccttcctttcctgtctgtctctctctttctttctttctttctttccttctttctttctttctttcttttctttctttccttccttccttcctttctttctttctttttctctttccttctttcattctctttctttccttcttccttccttctttccttctctttctttccttcttccttccttccttctttccttctctttctttccttcttccttccttccttctttccttctttctttcttcctttcttcctttctcgcccaggctgaagtgcagtggtccaatcttggctcactgcaacctctgccttgattctcctgcctcagcctcccgagtagctaggattacaggcacctgtgaccatgccagggtaatttattttttatttttagtagagacgggatatcaccttgttggctaggctggtctcaagctcctgatctcaagtgatttgcctgcctcagcctcccaaaatgctaggattacaggcatgaaccaccattccctgttcttagtgtttcttataacttcccagatatgaacaaaaccttgcaaaagagcatttcaataatctttagcttctcgatcttccaactgatgtggccatcaaatggctagtcagaagacaaatagatgaagacaatagctttattaaagtcaattcaaattatgacctactatggtaagacactgtgctggggtctagaggcaccaggacttcacccttctctcaacagctcacaaacccagtggaaagggtcagacatataagcaaccaacagaaacaaaggagatggcattaaatattattctgctcttgttgctttagttgttgctgcttattgttggtcttgttgttgctttagttataggggtttttaacagagttgcaaagtgttgtggagtaatgagtggggagaaatgatttctcactggaggtaaccagaaaacagattagagagcagtgattctcaaccaggggcaattttcaaacccataggacatttggcaatatttggagatatttttaatggttatgacaatggatagatggatagtcagggtgagggttggtactggcacgtagtgagtagaggtcagagatgctgctaagcatttttcaatgcataagacaactccctacaacaaagacttactcagcataaaatgtcagtagtacctaggttgagaaaccctgcttgaataagatggatacgttgtacaagaaggatcagaattttcacaagtggatgaatggggacaagaatcccagagagagtactaaatgagcaaagccccattggaaaaaaaatataggccctgttcaggaagtaggagggagggcttcagtggggtataggttacacaacggaacctgaggaagctgtaaaaggaaagggggcttagcatttagattgaggctgagtgcaagctgctaaagtttggattttattcttttggccagagtgagctattgaaggatttaaaaaatggaagcaataggattaaaagtgtgttttagaaataaaatcagagggaaaagctttgattctcatagcagattgtaagaaaattcctttaagggagtcacccttattttgggtgttgtctgatgtttattaacctctggttgttggaaaatagcaaaactgcagagaagggagaaattctgcatatttgggcctgggttggatgggcagtgaggggtgaggaaggccaagggaatgagagagtggtgcaatgctgatgtttgtgctgtgagacccttcttcatggcttccagagctttggtaatctttacaaaaattataatatgcttgtgcttggatttcttgtgcaaaatgactatatttgggttgattgtgaagattgggagaggaggttggtgacaatggtgcaatggtagcatagaagtaataatttggatgcttctataatgggcagtttcttctcctacttcttcctttcagatcctgtagtcctgtcccacagaactgctcatgcttctccagtacgccagtctgcatcatacttacatgctcttctttctgcttggcacgctttccttttctaacaaacttctgctcatccttcaagacccacttcaaatgttccattctctgctctgccctgtatacaaaatatcaatattgtattgtgtttgctaaagtgtttattttccccaaccagagagtgagccccttcacggctaagaatggcattgtaatcatcactgactctccagcaggtagcaaagcatattaccgaagctccttgatcatttgctgaatgaaccatgggtaataaaatcagtgagtggcagaaagattgtggctctgggcctacatagcctttgcctggttgctgttagaactacattttcttctctttattaattttatattttaaacttcatccccaagcttaaacatttccttccaatagatgatattctatcaggaagagaaaaaaaaaaaaacccaaagtacaactttaatccttgagtgaatgggctaaaatcaggtttcaatatgctttttagaatacttccatgtaattaatttaacattgacctgcttattaagagtccattattaaggaaacaattgtaaaagtcattaagggcatttccacagatcttagctactgactcatcttgctagttctcaataaacgtgacctgaaaatctctcattcgcagtatcaggtaaaatgttatttttctaaccattaggaaacatttactcttgggctgatttttatgtgtttttattgttgttgttaatgtgaagaaagtcctatacaggaacagctgcgcatatgggtaaatgcctgggaatggtttaaagatgccttttcaaaacatcttccccacactggtattatgcaatgcctctgtctcaacaattaataagtatttccttttgagttaaaccatgaagtatatagtcacactagctcattttgagatagggcaagactcttctggcatcagaaacccatatttggaatgtggatattttgtcttttctgtttgttatttcatcttatgttttccttcaggatttagtaaaattctttatgaaagtataagctggcttaggttaggggttttcaactctgctagggggcaagtttaatgagggagccattcatcctggatctgaggaagtcgtaaagatgacaccaaagtttcaaagggccccagaaccctggcaaggttctggcatgaccctcatccctcgtcccccaacactgacagcctctccaccacaatctgcctaagagacaatccaggacaatctcgccactcccttcatcccatataccaaactataaggtcattcctaatagtctagatctacatcctgtttgtttattccctattctgaccccattgcccatttcccacttccaccccttttctgtgctctgtggcccattatcggctaaagccctcatattctcaaccttttctcttagtgtctcctacacattatttttttaactgaaacctggacctctgagtcctgctttcttgtagcctggttgagtggtgcttattttcttttccacacccctttgagttaaggcaggaagcctgtaattattccaggttcctttaggatagagtatgactcttgtgagaccagaaacatatagcctatatttggaatgtgaatttgaatagaattccggacttagagatggggagatgtctccctggtttttattgctcctattagaccaagttctcttctcccttggtgtgaaatttagacatcattaccagctaccctttcttattgcagttatctgctgactgggttactttccacgttctttgaagatgtaaactcccagcttatccgcacttgtttgtgacaacaatttttctgtcacaattcctagatgatcatttcaatactctctggcatctgagtcccttgacctcttctcctataatgatttcattctcttccaacctcagccactcatgctcatggaatgagccattcatagcctcccctcaactttgtccttatcaataactcctcatcttccataatctccatctcccatccaagaactaaccaggtccgaccatgcttagcttctgagctcagacaagatcaagcatgttcagggtggtatagccatagatcaaaatctcaatctcaagcattctaccctaggcccaccacctcatatctttccagctcactgtccctcacattctgacttaaaaatccgttgacctaacaatgaatttgtcctaccatcttttcactgtcctttacatcctgtgtatccttacctccttatccatcctagatcttatagtctatcataatcatcactcactttatacaactgtaactccctggagcctctttcatgttttttttccttctttggaaaacccccaatcctagttatttgcagcccttttcttactctgtacctgttttctggttgctgaacttggctggaggaaagtacccaatctactgcttggtatcactttaaactcatgagcccccaaatttaagtgggcccagcaattctaattcattcaaagagtttgtgaactcttgcttcacaaacatgatctcaaaccttctgctctctcctcaaacttttgcgacttcttggttctttattctcagctgatggccttgatttcttttacacggcgaaaatggaaacaatcagaggagaccttccacatgtggttcccatcacttcttccaaacctgcttgcatcttcgcctgtgtcccctcatccattctgtcctctgaggaactgtccatgggtctgtccaaggcacagccctcctgttctacactaggtcccaggatctcacatctactcaaggagatcactctagcaattttactctagccattttggagaggctctctcttcctgtttgtttttttttttaatttttttaatttttatttatttatttatttattttagatggaatcttgctctgtcacccaggctggagtgcagtggcatgatcgtggctcactgcaacctccacctcccgggttcaagaggttttcctgccttagcctcccgagtagctgagattacaggtgtgcaccaccactcctggctaatttttgtatttttagtagagacggggtttcaccatgttggccaggctggtctcaaactcctgacctcaaatgatccacgtgcctcggcctcccaaaatgctgggattacaggcatacgtgatgacgcccagccaaggctctctcttcttcctcctgatcaatttatgtccatcagtatataaatatgctttatttctatattaaaatactttcccttgatctcaagcttccctgcagctacctttgcatttttcttatcttctttataacaaaacttcttcaaagtattgttcatacttgtagtatccatttctgctctcttactctctcttcaataactctaagtagacttttatctacaccactccaccaaaacaaccccgtcagcatctccagtgacttccacgttgtcaaagcgaattgtcagttttcagtccttatctcactcgaaacaattgatcactgcctccttgatacattttcttcatttgatttcttggatatcatcctttcaagtctgagcacttacagtgtggccatctcaaatagagatgtctgagtcttctatcaaaatcttcgctgaccttattgggtactttctcaatctttctaatggtttctcttacttggcttcttaattttggaggaccctgagaattctatccttagacctgttctttgtctacactcactcactagatgacctcatttggtctaataactacatactatctaataactatatactatcagtgctatcccatacaaatataatgcaagccacattgtagataggtgagtcacagatataattttgaattttctaatggccacattaaaaaatgaaaaggaaacaggttagattaatttggtaacatattttattcagcccaacatattaaaaaattaacatttcaacatgtaatcaatgtaaaatgagtaatgagatgtttttcattttttaaaaatattatttgaatttcagtgtgcattggcatttatagcacatctcaatttgaactagccacgttttaagtgctcagtagctgcatgtggctagtggctactatattagatagcacagacctatatgctggacattggcttttactgagtgagatagccaatggaaaggttttttatatacaaagttttaaatttaaaaatatatatacagatagggtcttactatgttgaccaggctggtctcaaactcctggcctcatgtgatcctcccatctcagcttcccaaagtgctgggatttacaggcatgagccactgtgcccagcccaaatggaaagtgttggggagggaaatgacatgactactctttttttttttttttttttgagatggagtttcacttttgttgcccaggctggagtgcaatggcacgatctcggctcactgcaacctctgcctcctgggttcaagcgattcttctgcccagcctcccaagtagctgggattacaggcgtgtgccaccatgcctggctaattttgtatttttttttttttttagtaaagacggggtttcaccatgttgggcaggctggtcttgaactcctgacctcaagcgagtcacccgcctctgcctcccagaattctggcattacaggcatgagccagcatgcccagccatactactcatttttaaaaggccatcctggctgctccgttgaaaataaacaatgtgggagtaagggggcagcagagagaccagctagaaggttagtataggtcaaagatgaaggagagagtgggatagactggaagaaaagtggtatgttgaaggtagaacatgttgaagaataggatttccagatgaattgtacagaaagaaagcagtccagggtgatccctggatttttaatctgaaccactggaggaattggaagaatagagttgcctttaggtgagatggggaggactgagatcaataaattttggagaagcagagatcagtagtttgaattttggatttgttaagtttgagttttccattaaacgaacagacgaaaaccacaaacaacaacaaaaaaatgaagatagcttctgatagcaacatgtgtcatgaagaaaagaaaatagccatagagtgactgaggaggagtttcttagacaagcttgtcagtgaaagcgtctctgaagaaggggcatttgaactgagtcctgaatgatgaaatgaggccagccaaacaaaaatctggaagaaaatcatttttagttagagggtactacaaagataaaagcttggaggcaggaatatctgagagacagaaaagcggccaatgtgtctgaagtgggtaagatggagaagcagatagggaccagtcatacagtgccttgtcagtcacagtgaaggagtttggatgctattttatgcactgaaggaagcctttgggaggttttaagctagacgtagcatgatctgatttatgtattacaaagaaaactctggctcctggatggcgcatggatttgtattatactaattattattgctattattattacaggagacaaaagtagaagcaaggagagcaattagaagcttttacactaactgggcaatacattatggttctttccactacacagctcttcttctcttgcctctaagtcttttcttgatttcaacgaattcctggagtgagagaatgtgtattcttagtctctgtgccctctgacatgcccagcactatgtcctgcccacagcagaaggctcagtacttatttttgagtgaattatatggctcttctcatcaaggctgaggagcacatttttaaaaaatatatatttgtattttttgtacatagcatattgtctgtcccatagttaagactcaatgaatgtctgttggagtggggcaagacctcacttcagataaccagtttactgagagagatccttggataggcagaggcagcaaagagggtttgggccttgctagcatggagggtaggaggaaggcagggaaggtggagcatgttgagagaagagaggtggataaagtcacccagctctgagcaggccaagggtagatttggtctatattttaatttaaggctggcctggtttcattgatggtgatatgatccctatgtgtgggaataggtgaaatggtttgatcacaatgggaccataatccattacccaaagccttcattaaggagataattctgttcagcctcacacatagccaggcctacaggaatttgccatccagcaccaatactgatgctacaagtcccagcaaacacaggatggcaggccaaattcaagctttctggcactcctcctcttctggctgagcccgatgtcctcaggcctaatctcaggctggcagagagttaagtgctgggctgagtctgtgctttgctgcatgtgctggacttgcatttgattctgtccaaaagaggtctgtggaccagagggatgacatttggcaccaagaaagtaacccaggtgtctgtctctttttcagtcccaaagccttattcttttccctcaagtctatgcaatcgtttggaatccatcactcatcacctagaggtttcagtgcctttagattagggttctgcacccatagctgatgatccactggactaccacacttggcacctgaacagagccaacaggactggttacaaattcgttgttaattactgtgtgtaattacactagacccaaggttggagggagacaccctactctgttgttgtcttatatacgaattctgtataattttttaaaagcccaccatttttactttctaattaggatatggggatttggggcagcaacctttgttatttaatcatgctttttctggggaggggaggagaggaaaatattttcctttttctatcaacaattgctctcttttccgcattaagagggtggaaacttggttcctccctcatcccctttaggcaaagagtccatggctcagattcataaaggttgttgattttgactttgggttgccctactctgtttttccccacctttcatgctaactaacacaatacataagtcttcctagccagcactccctaagggtggggtagaaacacagcccattaaaaaaattttttttaaagctttgagtaatctcctttttatattcacccaaatgaaccaggttggtggcatattctcctttgtttttacatctgagacgtacttaaagtttaaatagtgccagaatgaatcacattgcttgtgttcttatacccagctgcaaatcatgccaggctcaagcccaggaacacaagattgcatgcacgcagagagggtcactgctgtcttatctactcctgctctgctaaaaaattgcatttatttatttatttgtttttgagatggagtcttgctctgttgcccaggctggagtggcagtggcatgatttcagctcactgcaacctctgcctcctgggttcaagcaattctcctgcctcagtctcccaagtagctgggactacagggggcctgccaccatgcctggctaatttttttgtatttttagtaaagacgggttttcaccatgttggccgggctggtctggaactcctgacctcaagtgatccacctgccccggcctcccaaagtgctgggattacaggcgtgagccaccacagctgaccagaaaattgcatttattatatactgccccgtccccatcttggcattctgatatcattgttgcccatcctttccttcccattgagagagtcaacatttcccctttcccatcctattctcattcctacttctagctttactatctactgtataacctgctgagcctcagtttcctcaggagtaaaatggagataataagaaacacctgccttgccagtgtcacacagctattgaggatcaaatgagataatgggataggaaagtgctttatttctacaaatgcaagctattgtcagtatcatttacttaactattcttcgttagctagctacgtagtctagcttaccttgtcgtgttccaaatgtggaaggcttgctgtttctggtaagttgaggaccatttcaaagcctcaagaaaatgattagaaatgaaccaatgtgagaacattttctttgttgggtagttcatccgattattatgtatgttgtttgtcttcttttaatttggatataggttgccttcagctgccagtactgtgaaataagagacgatattataaatcctttggagattaagcatttccatcctaatagctgctgctcaaaatttgatttccccttgattttcaataaaaggaggataacagaatgttattcattctaattataaagcaacgggaattctaggcattactttacaaatagctgctttcatgtcagaataatgagtgttgagaggaagagctctgagccctttactatattctttgttttcattatttttgtacctgtaaggaagatggacacattgagggacagagactccacagaagttgtctgagttgtgacagcttctcatcttctttttcatttccgcatttaacatattttctacaggctttgtaaagaaaataactcagtctatgtttacaattttcacactggctttaacttattttaacttattttatttttggttggtgttcaccctgggtttctgagggttttaagctgtctgcaaaaagctgctatctttgtctccaaagaatggttaagccacttttgtagaatcagaatgttaggtgaagcccatctttacataggaaaaagcaaaaggaactaatattaattgaatgttcactacatgctgggtctcatgcgaggctctttacacatatcattttacataatcctcatagcagctctatattatataatatgatctacatttttttcacaagtaaaaaaatatttaaagggagcaagttacatcatcagagcttaaagatacctgtgctatacccctataaaaaatctaattcactatgtgttttggtctatggcatttacatttttgaaacattttatctttcctaaattgtagttacttccccctaccttgacagatagatattgtattgtaaaaatacaatagaacaagtatcttttaaaaaatatgaaaacaaaacatttctagtcaattgttgaacttctttcaaagttctgggttaatatcaggtaggccttttactaatgcattttatttccttctgtctgccaccagctggagctactgtataaaagccaaccattttgagttcaaaatataactctgcaatatgaaggtagactacttttgctcctaaacaatttgagaataaattgcaaggaattaaagattgagaaatgcaatgtcatagatggttaagtaattgctattgatcacttactagttatgcaatttgggcaaattattttgactgtgactcccagtttagttagttatgaaatggttataactaccaatcttgtggggatcactgtagggaaaattaaatgttaagaaattagtaaggagcctaccacatagtatgtactccacatgtgttcattagtatcattggcagttattattattcattttgttatcagtatcacagccccagggatgctcaattcattgtaattacaattcatattattactcattatcgtgtgcctggcaaatggcaagtgccacttgacctcccattgctcagtgtgtgatttttgggtttcagtgtggtggactgtaggatggcacccacacaaagaggcattctgcttggatgtcaaaggaaaggaacctgtgagaggcatttttgaggttgatcgggtcattttgggtcagagcagtatttcccaatatatgttctgtaggattcttgtctcaatggatcaaataagaatgagaaatataccatatatatcccttttccacttcacggagccacagtgcatgtaagtatatttaaggctctgaaaaatactgtgagaatcaacccttcttctatttatacctaatcataagtgatttctccattttctccatgaaattttaaaaagttgatatgtaatatataaatttagatgaatataggtattcatgatttcatattatagaaaaatatgtttagaaatatggcttttaactcaaattttatgtcttttttccacttaaattttatgagaaagacatcagtgttttcctccttattagcaccacctttggagtcatgtaattttctggagcacttactggctcactggtttgagtcacagcggtttttaaatgtgtatgatttgccacagtagattttatttctagttataagtatccgtttgtataatacctgaattaaaaaattcatcctagtgtatttttataattgttataataaatgatctttaaaaggttttttttttaaaaaaaaaagcaagtaaaattgtgaggttgtaatttcagaaataattgtgaattttagttaaatttactggccttccatttaatactttttgtcaggtaacctctactaatttgacaccaaaactagcatttatttggttaatatgttcgccctaaataatacgtggttgataaagcaattataagagagcccagtaatacaggagctgctataagaactggaatatatgacaattctttcttttctgagggataatttgaggaaaaaccttgtctcatatctatatttacataacccagtgttgtttgtgtgtgaatgtgtatatgtgtgctgaaatacctgtttacgtgctagaaacaccctcgtggtaatggtggcatagtgggtaattgttttcatcaggatttttcttgagaataggctgctagcaagtgctgtatgtgacagaaactttggccaaaaatctgtatttataactatatcaatttcttgtattttcttgttcattttaacttgcttttccctcagaatttaatcaagtcttcaaaaaaaattatggcagagtcactcccatccctgagacacttggtcaggagctttacagaaggttagatactccattaaggttagaatggtggtggattggtggttagaccacagaagaacccccaggggaaggtaaaggcctggggataaagacatggccctttttattctgtcatccttctctccttgtaatctcagcactgatgaaccattagaatctccatggaaggttttaaaaaaacacatgctgtcacctgagaacatttaagtcagaatgtctgggagtggaccccaagcattagtgtctctcaaagtcttcttcaggcttaaaagggttaaaccttctagacaatcatcagtccttttgtgtcttcctcctaaaaatttgaacagtagtgacctattagaagtcaagagttggatctaaactgagaaagcatctgtgcattgtgctctatttcttcgtgtagcttctccccactcccaagtcactcctaatatttccattatagatttagacacagaaaacccagatgaagaagctgcatgctcccgatgggatgggatgatattggtaatgggaagtctcatttctgaattgaatttgagtgctgggaaagcatattggctaatgtttcagtcctttggttgaatttgtgtctttgacaacaaatgcttgtggttgaagttatacaattctcatctctttccatttcccctcactggggcaggcttcctctgtgtatttttttcctctgatgggaaagagcatctgcagctacttttcttctcagccaatagactaccttcttgtgagttataaagaggataatatgtgaatcagaagccaagactagaacccttctcctatggacatggtctattcaggaggcaattttagagataaaaatcaggaacaccagttcaataataataataataccttagaagttaacataccttttaaaacactttcatatttgtcccttttctcttgaacattccaaagagattgacaggacaaataccaatcgcctcattttaagattaagaaacgcagatgctgtgaagataactcagttccccatgataacatggacagggacagaggtcggactaataactggttcttcagtaattactcaccttgagcagctctgaaggtcatagagtagaccagtgagtggttcccaaacttggctgcttactagaatggcatgggaggattataaaataacacaattatgccaacttgcctctggggctctaattcaatacacctgggatggggctcagggaatctgtcatttaaaataatttcttcatagttgttctcaattttgactaaatattagaattacctggcagggaggggctttagaaaatcccactggagaatcacttgagcccaggaggttgaggctgcagtgagctgtgatcatgctgctgcacttcagcctgggtgacagagtgagactctgtttaaaaaacaaacaacagcaacaacaaaaaacatttcccagattgtattccagacaaattaagttagaatttctagtgctgggacccaggcatcagagggtttgtaagtatctccaggtgattccaatgtggaactaaggttgagaaacactgctatagactagagctttacaaactctgtttttcagaatttcagcacagcaagaaggaaaagacaagtgtagaattgtcacatgtctggagtaagaagaccaggattcaagtcctggctctgcctcttgggaatgtcacttcatctctctgagcctcagttttttatttcataaaatgaggaaaatgagcagtacatacctctcagggaggccatgagggttagatgggatattgcaggtggaataaccaagcaccagctattcctgctgttttccaaagaactccattaagattgtgtgtgtgtgtgtgtgtgcgtgtgtgtgtgtttccccctagatgttccctttgtgttcaaagtttccaccctcaaccttacacagagttagacttgtagggcatgaaacagagctccaaaagtttccactaatgaaataaggtttggaaattaaaggaatgtcgttaaggcttctttttgctgttgctattggcatgttcagccctctgaaccttggagttatgaatctgccagtttgctaaatgcatactcagaagggcaatttcgttttcagaatacaaggacactttagctattactactcaccctccccattgctcctttctagctctttgagctcccctgaatgtgcccccaagcacctcttgtttattcccattcagcaaattaaggaaggttctagtatgcgtttcttatgcagcaaatgctgagttcactggaactcaggcctgctggagaacaaattaacccatactataaacacccactctcttgcctgacaatttgcactggttagaacagaaccttctaatattaggaatggtggtgtgaggatcatttcataaccacaaacacagcaaaagcaatcatgaaattatggatgactcattgtcaaaggaacacttggatcattttgagcaaccccctaggttgatcaaatgaggaaacttctgcaccaaactcacaccgtgccattagtcttctctgtaattgattgttattgccagatttgtctcaaccacatcagacctatttttaaacctctcataattgccttctcactaagtaaaatattgttttttgagcacctttcttttatttcatatgtgtctatttgtttctttcttaaactggacagtgcattgagaacagagattatttcttatttatcctaaataaaatagtacctggtgcacagtaggttctagtacataaatgttaaatgtaccataaattgtacattctttcccaatgaaagaggttgtttctaacaagctaaggaaactaagatttgctttgtataccactttctctagggttccatgaacaaataaattttgccatgatatatacacatatatattttagagaaagaaaggagcggggaggaaaagggaatggagaggaggggaagggaggagagaggaacaaaaggaagggtgagagagagataatactaagttcttgatactatttaaggtgttgggatacaaaaatgaacaaaactgcccaaaatacttgctctcagagtttccactcttgcgtgtttatgtgtgtgtgtgtgtgtgtgcatgcatgtaatgaggaaacagacaaaaaacaaaaaagtaagtacaatataatagtgttagatcatgatcaatgctgtagagaaaaataagttagagtaagggaatagagagtgctggatggagtgggctattggattttaaaatggagtagacagggaaggcctcgctgtgaagatgaaacttgagcaaagacttggaggtgaggctgagagtcttgaagctatttgggtgaagaatattccaggtgggaggaataggaagtgtaaagtctctgaggtgagacagaaattcaggagtttccaggatgacgcaggcagttggcctggagtggagcagtgcaggttagagtgtaggataagagatcacgggagtggctggacagctgagtggcagtgttgggagagctttggagggacctgtcattgtaaagaccagcctttactctgactgagatgggaaaccattgaagaatttgatttgatttaaggttgaaagggttatttttgctgccaggataaaaatggtgggtgggaaggtaaagagggaaacaagaaaatcagttaggaaattatggtaataagacaggtgtctcagaccatgatgatagaagaggaagtagtgtatgttaaagaatctgaatagatgttgaagatagaactaatagaattaaccctcagattgatcatgaatcatgggaaagagtgaaaaattatcccaagttgtttgatctgaatagctcagtggatggatggagttgccagtaattgagaaagggattcctaaagaagaggttttgaggtaaaggggaagatgatctatctgtctctttctctttctctagctatttatctacttatctatctatgtatctgtctagctgtctacatacttacctgtctgtgtctatctatctatctatctatctatctaatcagatgttttatatatgaggtattaaaactcaagatgttaggtatctggctgaagatctcatagctaacatgggtgatgctgagtttgaagtgaagtattcctgtatagacttcaaaatccctagtttccctaccctaccagacctttttcatatatcattgcttttaatcttcacaacagcttttatccacactttaaaattataaaacctaaagtttagagagtttacacaactggcctaagtcatgcagctagtgagacagcagagattcaaacttggtctctgactccaaaattcatattctttttttttcacttttattttaggttcaggggtacatgtgcaggtttgttatataggtaaattgcatgtcacagggatttggcgtgcagattattttgtcatcaagcatagcaccaaataggtagttttttattcttacccgcttcccactctctaccctcaagtaggccccagtgtctgttgttgccttttttgtgtctatatatactcaagtgttcagctcccacttagaagtgagaacatgctatttgattttctgttcttgtgttagtttgcttatgataaaggcctccagctccatccatattacactataaaagacaagatattgttctttttatggctacatagtattccatggtatatatgtaccatattttctttatccattctactattgctgggcatttaggtttattccatgtctttgctattgtgaatagtgccacaatgaacatatacatgcatgtgtctttatggtagaacaatttacattccttcaggtatataattaataatgggatttgctgggtcaagtggtaattttgttttaagttctttgagaaattgccaaactgctttccatatggctgaactaatttacattcccaccggcagtgtataagcattcccttctctttacaacctcgtcagcatctgttattttttgactttttaatcatagccattctgactgggtgagatggtatctcactgtggttttgaattgcatttctctaatgattagtgatgttgagccttttttcacgtgcttgttgactgcatttatgtcttcttttgaaaagtgtctattcgtgttctttgcccactctgtgggctttttgtttgtggggttgttttttgcttgtaaatttgtttgagttccttatagattctggactttattgtcagatgcatagtttgtaaatattttctcccattctgtaggttgtctgtttactctgttgatagtttcttttgctgtgcagaaagtttttagtttaattaggttccatttgtcaatttttgctttcattgttattgcttttggcattttcatcatgaaatctttgtctgctcctatgtccagaatagtgttgcctaggttatcttccagggtttttatagttttgagttttacatttaagtctttaatccgtcttgagtttttgtgtatggtgtaaggaaggggtctaatttcaaacttctgcatgtgactagccagttatcacagcaccatttactgaatagggagtcctttcctcattacttgtttttgttgattttgtcaaagatcagatagttctaggtgtgtggcatagtttatgggttctctattccgttccatttgtctatatgtctgtttttgtaccagtaccatgctattttggttactgtaggcttgtagtataatttgaagttacgtagtgtgatgcttgttgttttgttctttttgcttaggattgctttggttatttgggctcctttttggttccgtatggattttagaatagtttttctcattctgtgaagaatgtcattggtagtttataggaatagcattgaatctataaattgcttcgggcagcatggccatttttatgatattgattcttcctatccataagcatggaatgtttttccatttatttgaataagctctcatttctttgagcagtgttttgtagttctccttgtagagatctttcacctccctggttagctgtattcctaggtgtttattctttttatgcctgttgtgaatggaactgcattcttcatttggctttcagtttagattttcttggtgtataggaatgctactgatttttgtacattgattttgtatcctgaaactttgctgaagttgtttatcagatctaggagcttttgggcagagactatgaggttttctaggtatagaatcatattgtctgcaaacagaaatagtttgacttcctctctttctatttggatgccttctttctttctttctttttttttttttttaaaagagtttcactcttgttgcccaggctgaagtgcagtggtgcaatctcagctcactgtaacccccacctcccagctacaagcgattctcctgcctcagcctcccaagtagctgagattacaggcatgtaccaccaggcccagctaattttgtaaatttttagtagggattgggtttcaccatgttggtcaggctggtctcgagctcctgacctcaagtgatccacccatctcggcctcccaaagtgttgggattacatttgtgagccactgcgcctgacctggattccttttatttctttctgttgcctgattgttctggttaggacttccactactatgttgaataggagtaatgagagagggcatccttgtcttgttcaaattttcagggggtttgcttccagcttttgcctattcagtatgatattggcttggatttttcatagctgactcttactatttttatgtatgttcctccaatgcttaatttgttgagggattataacatgaagagatgttgaattttattgaaagccttttctgtatttattgagacgatcatgtggtttctgtttttagttctgtttatatagtggatcacatttattgatttgcatatgttgaaccaaccttgcatcccagagataaggcctacttgattgtggtggattagctttttgatgtgttgctgggtttgctttgccagtattttgttgaggatttttgcatctatttccattaaggatattggcctgaagttttcctttttagttgtgtctctgccaggtttgggtatcaggatgatactgacttcacttagagaggagtccctcctcctcaattttttggaatagtttcagtaggaatggtaccagttcttcttcatacatctggtagaatttggctgtgaatctggtcctgggctttttctggttggttggctttctttctacgaaactatcctccctattatttatgccttgcaaaaaggtggtaaagattaaatgtatgtaacatacccagcatatacaacgtctggtgcatagtatatttaaattaaaggatagctattagagattaatatagatttcatttgtgtatattgtgcttctacctaagggaactataaattcattaaaatacgggacttaaaataattatttagtggcctcaaggacatcataaatatttattatttattgagtatgtacaactactatatttccataataattagaaataataactttttaaaaaacaaagatgatagcaaccacaaaaaacatttattgagtgaatcacgttgggtacaaatgagtatattgtaaaaagtataccatcaacacactgacaatctttatcagtatttcctagtagaagaaacatgaaagtcggagcaggtaggactaaagaatgctagtgtacacaggaccatcagatgccttttagtagaagaggtctagagccttgcggaagagcttcccaccctgtacagagaatgtgttgcctgttctttgctttctgaaaactcttgcctattatcactctgtgattaattctgcactaggctgtctagagctttcacatttgggatcattttatccccgtctctcaaataagttcatgggttcattatgtcgcacatatcttatcttacatgcaaatgtaaatctgttgcacccttaactcacaggtctgagtattttttctaccacacaaagttttttgcaaaaattaaaaaaattgataacattaaatggttacctgagaaaagaagaaagtcctcaaacccttcactttaaacaactagaaaaataaaactaaaataaacccaaacaagcagatggaagaatataacaaagacaagagcagagagcaattaaattaaaaccagaaaaacaatagaaaaaaataaataaaaacaaaagctgattttttgacattaatgacattagcaaaactgaccaaaaaaagagataagccataaattattaatatcaagaatgaaagagggggtatcattacagatcccataaacactaaacagataataaaggaatactaagaacaactctatagacatagatttgaaaacctagatgaaattaaattaaaattatattagtgaactgaactttcagttaaaagtttccaaaaaagcaaccttctagctcagatggttacactggcaaattctaccaattatttgtggaaaattaataccaattccatacaatctcttccagaaataagaagagaacactctcaatttatgaggccagcattaccctgatgcaaaagacagcgtaagaaaaaaatcttttaaacacaaccaaatatacctaattaacataaatgtaaaaatcttcagtaaaatattaaccagctgaattcttaaacatataaaaacaataataatacaccatgaccaagtagagattgtagggggaatataagactggctcaatactggaaaatttttcattgtagtacaccatattaacagtctaaagaagaaaaatcacatgatcatatcaattgttgcaggaaaagtatttgacaaaattcaacattcattcgtgataaagactctctgcaaactagaaataaaaactttctcaacctaataaaaggcatacagaaaagctaacattatacttaatggtgaaagatgaatgctttttccctcaatttaggaataaggcaaggatattgatactttttgtctctgtgtccccacctaaatctcaccttgaattgtagttcccataatccccatgtatcatgggagggacccagtgggaggtaatttaatcatggaggtgtttaccctcatgttgttcttgtgatagggagtgagttctcatgagatctgatggttttatatggcgattttttcccttttgctcagcacttctccttcctgcccttgtatgaagaaggatgtgtttgcttccccttgtgccatgattgtaaatttcctgaggcctcctcagccctgcagaactgtgagtcaattaaacttctttcctttataaattacccagtcttgggtatgtttttattagcagcatgagaacagactaatacagatatctactcccatcattcaacaaacattttactgggtgccctatccagttaataaagttaggaaattaaataaaaggcatgcagattttcagatgatatgattgtctatgccaaaaatttcaaggaattcataagcaaattccaagtactaaaaagtgagtttaatgagattacagggtacagggttcaacacacaagaatcaaatgtatttctttatactagcaatgaataattggcaactaaacatttttaaaaaatttacattagctccaaaaaatgaaacacataggtgtaagtgaaacaaagcatgaacagggtctgtatgctgaaaattacaaaaacttagtgaaataaagcaaaaaagacctaaataaatggagagatacacagttttatggattgaaagaattaacatagaaaaaatgtaactcagctgggcgcagtggctcatgcctgtaatcccagcactttgggaggctgaggcggatggatcacctgagctcgggagttcgagaccaccctgaccaacatagagaaaccctgtctctactaaaaatacaaaattagccaggcatggtggctcatgcctgtaatcccagctacggaggctgaggcaggagaatcacttgaacccgggaggcagaggttgcagtgagctgagactgtgccatttcactccagcctggacaacaagagcgaaactcagtctcaaaaaaaaaaaaagaaagaaaagaaaatatgtaactctgcacaaattgatctatagatttaatgcaattccaagcaaacctcaggagtatttttacagatccagacaagctgattctaaaatttatatggaaagtcaagggaactgtaataaccaaaacaattttgaagcagactagtaaagttggagaaatcacactatcagattttaagatttaatataaagctgtagcaatcaattcagtgtgatattggcaaaaggatagacatagatcagtggaacagagaagccagaagcagacccacacaaatatattctagttatttttcagaaagttgcaaaagcaatttcataaaggaatgatagccattcaacaaatggtgttggaacagccagacaatcatgggcaaaaaaatgaaccttcatcttaatttcaaatcttacataagaattaactaaaagatttacatgtaaaatacaaaattatacaaatttaaaggaaaaaatttaggagaaaaactggcccagagttagacaaagagttattagacatgataccaagagcacaatcatgaaagaaaagatttatgtattggatttcaacaaaatgaaaacttttgctctatcaaagacactgtataagaatgaaaagacaggctacagactgggataaaatatttgcaaatcacatatccaataaaggacttgtatctggaacacaaaaaaactctcataacccaaccataagaaaataaactacccacattaaagaaagtactgcgttcatcaactagaagtctcaatatagtaaagatttagttctcctcaaattgattcatagattcaactcaattcaaatcaaaatcccaacaggactttttgtaggtatataaagctgattctggaatttatatgaaaagaccgtatagcatagggacaatagttaaaaatactgtattgtatacttgcaatctgctaagaagatagatcttaaatctcctcactatacacatacacaaatagtaactgtagaggtaatagatgtgttcattatggggaatgtggtcattatttcgcaatgtatacatatatcagaacatcaagttgtataccttaaatatatgctattttttcatgtcagtgatagttcaataaaactgttgaaaagtagaaaataaaaataggttatgtgaaagacaaaggaactaaaatatgacaaacaatttgggcaaaaggaatgcaaataagcaaattaacaaatgttaatttgctattcagaaaatgaaagttaaaaccaccatgaggtaccatggcacatctattagaatagctgaaataaaaaaatattgacaagggctggtagggatgtggagcaactggaacttgtatacattgctggtagcaaaatgaaaaacagccactctggataacagtttggcagtctcttgtaaaactaaacaaacactttccatatgacccagcagtcccatttctaggtacttgccttaaataaatgaaaacatgttcacacaaaaacctgtacatgaatgtttatagcagctctattcataatcacccaaaatggaaatacctaaatgtctttcaacaagtgaatgtataaacaatctctgttacatttatccaacggaatactactcagcaataaaaggaacaaactatttgtttacaaaacaacttggatgattctgaaaggtattatagtagttggaagaagccagtttcatgaggctgcatacgtataattagttccattcatatgccattttctaaaagacagaactgtaatgatagggaaaagatcagtcatttccagggattaggaatagagagaggatatgactacaaaagggataacaagagaatttatcttttggttatatggaactcttctgtatcattattgtggaggtagttacagaaacctatatatgtgttaaactctaaaactggacacaaaaacatcagttacattgtatggtaatctaaaaataaaatatttacttgaacttttggtgctgaagaacttgatttgtgtcttaaaatcagactttccaaattttggtttcatttgctccctgggttgtctgtattcatctatcaccagcagagagacagagagagaaagagggagaaagaaagttgattagtttatatacttatacacactaatgaagttggaaaaactttgggtgaaatataatgattttgtgggatgatttatgcattaaggtatatgtggaatatttctggtagagatatttgttatagatgtatctaaaattcaagtaagggtggggaattttatttagaaagtaagagatgtagatgtagatgaaagagaatacatagggcgagaaaaaaaactgagaatagaactcaaggatactaatatttgagggaaaatgagaaaaggaactcataaaggaactcatgagtgtaggaggagaaacagggcattgaagaaaagaaaaaggccatggaggctataatagttcattctcacactgctatgaagaactacccgagactgggtaaattataaaggaaagaggtttaattgactcacagttccacagggctggggaggcctgtggaaacttacaatcatagcagaaaaggaagcaaacacatccttcttcacatggtagcaggaaggagaagaatgagagccaagcaatgggggatacccttataaaaccatcagatctcctgagaacttactttcaggagaataccatggagaagctgcccctatgactaaattacctccaaccgggcccctcccaccagacgtggggattataggaactataattcaagatgagatttggatggggacacatatcagaggccaagaaagttgagaaagaagaggcagcactctccaatggcatggagaagttgagtaagatgaggtttgaaaagtctcagtgtgtttgtccaatagaacagcagttctcaacctttttggcaccaaggaccggttttgtggaatataattttttcatggaggtgaggggatgggatggtttggggatgaaactgttctgcctcagatcatcaggcattatttagattctcagaaggaatggacaacctagatctcccacatgcacatttcacaatagagttcacactcctatgagaatctaatgcccagctgatctgacaggaggcagagctcaggcagtaatgctcgctggcccactgctcacctcatgctgtgcatctcaatttttaacaggccatggaccagtatctgtcagtgtcccagtggttggggacccctgctctagaaggtcatcggtaatgttgcaaaagcacttttagggttgatgtgggggcaagaatcttagggacatagctttagaaatacatgagaggtaaggaagtgccctcataaagctttggcttacctgtatttggattcttgaataaagttttggtgggaagattactcttatgtcaaatcattaggccaagctaagtaagaattttagtgaaattttgcatttctggcaaaacttaaagccaagtaatagtggcctggacttaagctttagacataatctttttttttttttggtagtactcaaaattaataagtcagttcaacactagctgagtacctacagtgttgcagatggtgaaaggtatacaaacatgtacaagaaataagaactgaatttatttaacccaaccttctcattttaaagataaagaagctgagacttaggaaggaaataacttggcccaaggacatgcttaatctgcctccctcctctcccattgccatattttgctagttccccaatttttccctttacataagctactctccaccacaaatatagtacacatgcagaagatactcataactacatggctagtccatttctaaatgtattcatgtagtttgttgaatcagatttttttttttttttttttgagacagagtcttgctctgtcacccaggctggagtgcagtggtaagatctcagctcactgaaacctctgcttcccgggttcaagtgatccttgtgcctcagcctcctgagtagctgggattacaggcatgcgccaccatgcccagctagtttttgtatttatagtagagactgagtttcaccatgttggcgaggctggtctcgaactcctgacctcaagtgatctgcccacctcagcttcccaaagtgttgggattacaggcatgagccaccgcacctggccttgaatcagatatttatgagaaaagagaaagtacctacctaggcagtagctggcaacaaattcagtgtgcagagggtatgattgcaaatggttgtgtaaaggaagaagaggtattaggaaatagattgccttttgaaaacaaaacaagacctttggcagaaaaatattggggtagataggtacatattaacagatatttgactctctccctacctggggattattcttctagaattctttgctaaaactctaaaggattcttggtttgctctaatgagacaggcagtttctttaccatacttccagttagtgttttgagggaacatggaataggacaatatggctggagtttgcctccaagatgaattggagaggaagagtggatggcctttaaagcaagactaagtttagaagcacagtgaataagcatgttcatgctcaggttcggtgggtggatgtctgcttgagttcattcagttacttatggggtgtgtaaccttaaaaaagtatcttgacctctttaagactcagtttccccctctgtaaaatgggttccttgtgagtacaaaagatatacaatatacctagtgcagtgccagacttattaaacaaaatacttcatattagattttaattttatgattaattagaaatgtggttctattctttaggaaatggccaaggacacggcaagccaacattttcagacagaaatagttcctgtcttttgtaaattgatctttgtgtggcttcagctggcatgactaggcccctcgatgggaattgcagagatatttagagttgaatgcaaagcctgagctcaaatgggataaatgatgaagcactactaaagatataaatggataggcacactacaccagggggctggtgggtgggagtggaggcattatttgtcaagtggcatcaatgtacacagctgactgtgtctgtgtgaggagaggagatggcagttgctgttgcaaaagggacctggaaacagagagcagcatgagcaaactgctgatcaggtttctttaggaggatgaggggattataatgttctgagagattactgaagcttagaaagaggaagtagtagaatcacatcttcctgcccctgggaatttatgctgctggataccatgtttccaatgcttcttattttatccattcctttacaaagttattttaaaataaagatgaaaacataggtgaaaaaatgtctaacttgtttgtttattgtagatttactcttggattccaaagtaaagaggcaatggcacagggggtgctgtttatattcctttcatcaatcattgctgcaacttagatatttagtatatttatgcctatacacagatacatatgggcaaaagatattctataaaattcatttatgaggactcacagttgcacctctcagaaaaatttctcctccagtcattaaaaaaatttttttatgggcttgtaattcagttacctcttccctggaagtaaaattccagggtagaccagaaaactcactaacaaggcccagtggtcttaaaccccggctgcatgcaaaatcagcagtaaacttaaaacaaacaaacaaaaacaaaaacaaaaacaaaaaaagtatgtgcctggcctgggtctcattccagagcatttaagttagactctctagaagtaattgtcttcagtttacgctataaaaatttaagattttaaaaaaccaggccgggcatggtggctcatgcctgtaatcccagcactttgggaggccgaggtgggcagatcactttaggtcaggagttcgagaccagcctggccaacatggtaaaacaccatctctactaaaaatacaaaaatcagccaggcttggtgacgcatgcctgtaatcccagctacttcggagactgaggcatgggaatcacctgaacctgggaagcagaggttgcagtgagctgagatcctaccactgcactccagcctgggtgacagagtgagactccatctcaaaaaataataataaaaataaaattcaagttggcacaacatttttagctcttataacaaaattcttgacttaatgaatcttctgtgaataactttgggagtattaaaactttgtaaactctgacccagcatatccatcctgggtaatagagcaggaggaaatggtcatggatgcatgcaaaaatgtatcaatcttgagtcattacaataatacttttaataataaaaatcagacgcattataaatgtgcaataagaagagatttttctttcaagcatggtacatccatttagaggtctactttctagccattaaaaataatgtaagagaagaatttaatgcatataacatgcatgcaattcataaagagaaaagaaagatattattcaagtatggggagatatacttctttgaaaaaaatccatttgaatagaaaaaagaccaaatgaatatattccaaaatagtaatatgcattataaagaaatagcatgagaaatgtgatgatttttatactcttccttaggcctcatattatttttcagattttctatactaagcatgaattatttttataaagagaaaaatgctattaaattaaaagcagttatagaactctaaagatttatattaaaatactactctgtggagctgcccacttcatatgtttaaagtaactgacaccattttgcatatgctacctgtgtgaatagattccataaataaaataggcttataaaaacactgttgatttttgtgtgaaagtaaccataggtaagtccttcttcaatgtatgactttgatttaggaagtggagtctggaacaactggcttaatttgacaaaggtagaggaagatgaaattttatgctctgtgattggtttttgcagttgttctgaactaataggttgctttcttctttaatgtgttataatgaggaacagctgctatgagctgtgcagttcgtttttttccctcctttcaaacctccatctcctgaagttaaatcaatctctgtaattaaagaattggtgaaataggcaaggaggtgggctggcaaatttatatattctgttttaaaatgtttaatttaagtatcatgtggaagaactggactgttgtgacatggtggaataacatttacattttccaaaaaagtgtctttcaacatgtgttgttagacctggagaacacaataatattaattaattgggcattcgatgtaaaccacaaaagtgagcagactcacttctccttcaagttgatgggagttcagatcaaccaagaagctaaagatgagatgaattcaagactacactgtttgaagatatatcattatcccttgtgaaagagtaggtgaggtgtggttgatcctagtaacttcatggactaaaaggaaaaaaaaaagtctcattccttgagtatatttcctagttgttttggtgttttgataggtttgttcccaaactgaactgaaccagaaagcccctatgacacctctttccaagggaaagatgcacctagaaggagctgggcctctggtgacagctggaggagtcattctgaagcctcacctcccacatcactgtcatctctaatagtggagactggttgaacttcggaaagggaaaaatcgatggctgaagatgagccttggtgattgtattagtcaggattctccagagaaccagaactaattggaggcccagaagatccatgattgtttctttgcaaactggagaaccagaaacgccagtggtgcagtttggtccatgtccaaaggcctgagaaccaggatgaggtggctgatgctagtcctggagtctgaagacctgagaaccaggcgctctgatgtcgaagggcaggagaaaatggatatcccagctcaagaagagggcaaattcttcctttctccaccttttagttctatgtgtgccctcaacagattgggaaccttaatgggggtgattattcttatcctgtgaggtaagaattagtgaaagtgattattcttaccctatcaattcaaatgctaatctcttctggaaacactctcacagacacacccagaaataatgttttaccaactatcttggcatcctttagcccaatcaagttaacacataaaattaatcatcacaagttcactaaccccttgtcaagtccgcacttatgcatatctctttaaaccatacttaatctccaagtaaatacaataacaaggtcaaaatcccatgtaacatcatacaactaacctgtgtacaaccaaaaacacactaatcccttccctcaaagaggaggtaaaattcttgagtgatgttttctcttctcctggaatcctgtaacttaaatactatgatgtaaaattaacaccatttaaatatggatgtaaagtcaatatatcttttgttactatgataagggaataggaaagaatacaaagatattttctttacacatacacacatgcacaaatatatttataacagaaggagaatatatgcaggacaattacagttctcatttctgtaactggttacatggttgtaagctgatatttataaggaccttcttctactaccattctgtattctcactgctttcagcaagcacctcagctggttgtggttctttaccacaggataaaggtgacccaaacctttattcttgaagggtctgggccattcatagttttgcctggactgggttgttgtagttcctattgaccttaatcacaggacatggcaatactcagaaactctttaagaaatctgtattccacacatactcttctttacctccattgtttaggagtagttcaattttggtggtttggatcaatcactccagccaacactgtaactcccttctttgcttattgacatagaggcattaggagcccaacatggttgggtggcagtcttaacttccagttcaatggagtcattgttgtatctcctggtggaagcagtcttccctctagaactatgacctctaggccagtagagcataaagtcatggaaacaagaagcaaaaattttgccagtgtgtctccagggataatagtgaatgttgccacaaccatgttcaccccttgattcctggacctgtgattctggctatgggagaaacagcaccatatattggttgctgattcaaagtatatggagccttatggaggaccatgcccaagcactgcacctagctggagctgtaacgtgagtctcaaaaggccattccaccattttatcaagacagctgcttcaggatggtagggaacaaggtaacaccagtgaattccctgagtgtgggcccattgctgcaattcttttgctgtgatcagaagtaatgcctggtagaataccatgatggtggataaggcattttgtaaatccatggacagtagttttgtgtgcagggaaggaaaatccatatgcactgttgtctattccagtaaggacaaaatgctgctccttccatggtagaagtggtcagtgtaatgaatctgccaccaggtagctggctaattaccctggagaatggtgccatactggaggctctgtgttggtccctgctgctgacacattaggcacttagcactggccataacaaggtcagcctaggtgagcggaagtccatgttgctaagttcattcatgacctccatccctgccaccatggccactttgttcatgagcccactgcgtgatgacaggagtagcaagggaaagaggctgattagtatccacagaacaggtcatcctattcacttgactattaaaataccctttggccgaagtcaccttttggtgagcattcttgtgggctacaaatatcttcatattttttgctcaaagagatctatccatatatctcttccccaaatttcttgtcaccaattttctaattatgtaccttccaagttcctgaccatccagccaaaccattgactatagttcttcaatcagtatataatcacatgtctggacatttttccttttaagcaaagtgcacaaccaagtgcactgcctgaaattctgcccactgggagaatatcccttcaacactgcctttcagagatgtcccagagagatgttatagtgctacagctgtccactcttgggtagtgcctgtatatcacacagaaccatctgtaaaccatagccaagtcttcacttcctctgtcaactgactgtggggaactccccatggagccatgggtgcagctggaagaagagaaggcagtagcaggaatgaggaccatggatcacttgatgtgacttctttgtgtcttcagggcttgcttgggcccaattacatatataccacttccacttgatgatagagtgttgctgtgcatgcccaattttatgatttgatgggtcagataatacccagttcatgataggcagctcaggttgcgtagtaacttgttgactcctggtcaagtattcagtttccactaaagcccagtagcaggcccagagctgtctctcaaaagaagaatcattacctgcagatgatggcatagctttgctctaaaatcctgaaggcttaaactgcaattcacctatgggagcttgccaaaggatctaaacagcatccctgtctgccattgacacctcaagtaccattggatctgctggatcatatggcctaagtggcagagcagcttacgtagtctcctggatctgttgcagagccttttcctgttctgggacctactcaaaactagtagttttttttgagtcagttggtaaatgggccagaataacatgcttaaataagaaatgcattgcctccaaaatccacataggcccgctagccattgtgccttttttttttttggttagaggccaggtgcaacaacttagccttctccttggaagggctatttcaacatgcccacaccatagacccctagaaatttaactgaggtagatagatcacacctaaactttaattggatttatatcccaccctgtaacacgtaaatgattaccaatcaaatctaaagcggttgctactttttgctcactaggtccaatcagcataatgtcatcaacgtaatgaaccagtatgatgtcttgtggaaggggaaggtgatcaagatccctgtgtgcttgacattgtctaaattatgacatataactggagagttaatataaccctgaggtaggaaaatgaaggtgtattgctggccttgccagctgaaagaaaactgcttctggtgggccttattgacagagatggagaagggggcatctgccagatgatagctacataccaggtaccaaggggtgtgttactttgctcaagcagtgaaactaaatctagtacagcagctgcaattgtagtcaccacttggttaagcttaccataatccactgttattctccaagctccatctgtcttctgcatagaccaaataggagtgttgaatgggaatgtgatgggaatcgccacccctgcatctttcaagtccttaacggtagcactaatctctgcagtccctccaggaatgcagtattgctttttatttactattttttgaggtggaagcaattctaggaactgcttctccttggccctcttcatcatagcccccagtccacaagtcaaggaaccaatgtggagattctgccagtggctaagtatgtcattccaattatttcttctggaactgggaaataactacaggatggattctgacacctattgtgagatgaacttgagctaaaacttccattgatcacctgacctatataagcccctcctctgaatgagaggctacagtgacattttgggtttcctggaatcagtgtcagttcaaatctagtgttcagtagtcccccaaaggtctgattatatgttttaccctggtgcacagttaccctgctaaaattctgtaggtcctttcggagaaagctgggagaaagattcacagtataaattttcatttgagggcttctgggtctgtaaactggctcaagtctgaaaattgattgaggggctctgactctctaattttatgattcaatttaaactttggttcatttgacctggaacttttctgtttatacagatcaagtaaaaatttaataggctttctatctatttcacttctaggaacaccatgattaactagcccacgccacagatctgtgtgagtcagactattctaattgctgctttgactctgccacccaacacagtaactacgcccacctcgcctttggcagtggaatgctgccacttggcctcaccactctggatccaattactcccattgcatttagattttccaattaagtggctgtggttcccactataaggtctggcctacaaagagtaatcacagagttcttcaagaatactggggcttcctttagtaatttatttcttaaagtattgataaaagtgtgtcttctagatcttctcagtgttggggaatatatcataaattataaatccactctttctaatctccctaagcctgtgaatcccttcctctacattaaacctagggagagccgacatttccaatttgcttacaatgggccatcttttgattgtgtttcagccaaccaatcaaccacattattagagccttaactcccaagctgtaatattaaatgcagaatctctgcttagtgggcccacatcaataaatttgacctgatccaacattatgttccttccttcattatcccacacccttaatatcaattcccagacatgtttcctagatttctgcttgtataaattagaaaggttaggtagttcttttggaatatagcatgcctcctcatgggccacactttgtacttcccctttaagggcctgctagggtcttgagtctagttatttgtctagaagaaaagaggagtgttggaggtagctcttgtggagaatcagcagtgtcttgcatggcagctgcctcagaggaggccattcctcaggcaatgcagggctaatcccttcagatggaggtaaatgactcagaccaatgtgaatgaggagatggctcctactggaggtggggatgctgttgacactgggagtagggggtcatttctgctggtattagggatgccacttttgctgggattagggagaccaactactctgggggtgggacctaagctctactgagggtggggagacttctttcactgccaaaatagataatcacagtttagggactcagtgtccccagcttctttagagtcttcccacatacccccatcccaacttgcaagatcccattttttcacagtgtcctcactttacagtatataccttgtgaggctgagagtttcacttgtgttgtaattcagccaattacaggatgagatcctacatttgattttcagcaattttagccctgcactgcaggagataatgctgtccctcagggcacacctataagctcttaggtcatttatgtagcacttgaggtgggaatttgaatcccttagctcatttttttttttgtaaactactttttccagtgattcagtgtcatattccttagttttccaaaagtgttcaaagctaatatatacagagttactaagctccttgcatcttagaagtgtttgattaggaatatccatattttgtatatatctacagtttgtgccacgaactgtttgcctctttactactggaaaaggaatcattatcatctttaaactgtgtcagattagaaagccaatttcagaaactgcagaatgattttttttttaaaaaaccctcacttttgaaaatctgtttctccagagccaatctcaataccaaaatctgtattagccaacgttctccagagaaacagaaccaatatgtactatgtggtggtggtgtgtgtgtgtgtgtgtgtgtgtgtatgtatgtgtgtgtagtcatcccttggtatctgtggggtattggtttcaggaccctctagtggataccaaaatctgaagatgctcaagtcctttatgtgaaattatgtagaatctgcatataacccacataatcctcccatatactttaagtcatctctagattactgactatctaatattgtattgcttagggaataatgatgtgacaaaagtctgtatatgttcagtacagatgcaaccatccatttttttctgaatatttttggtttgcaattggttgaatctacagatttggaacccacagatacagagggctgactagagaaccaataaaagccagtggtataattcagttttaagtacagaggcctaagaaccaaagaaccgatgatgtaactcccagtctaagtccaaaggcctgagaactagggtggttggttggggtggtggctgatgttagtcagtcctagagtctgaaggcctgagaacaaggagctgtccaagggcaggagaagatggatgtcccagctaaagaaagagataatttgtcctgattctgcctttttgttttatgtgggccctcaatggaatggataatgcccacccacataggtgagtgtgatcttctttacctagtctaccaattcagatgctaatctcttctggaaacaccctcagagatacacccataaataatgtgttgccagctatctgggcgtctcttaccccagttaagttgacatataaagttaagaggtcatctgcttacctgtgccatttcccagttgatgaagcttgccacagtttatccaagaatacacggagtgggaaaggtagaatttagtttgcccaggtaatgttctcgcagtgatttccctctgggcctcccaccaacgctgtctcttgtgatgaaactggggagaactgtagggaggaagataatttctgcctctcaaaactcacaggctgatggaaggagatcccataaagcatttattgtagaaaaggaagaagtggcagaggaaaatgctggagaaaagaagatagaagaacaaagcaattgccaagcccaggtgtaaggtgaccaggtctgcctgggatgatggcagcttgaatggtgaggaaagacaaaatgtgagaagaacatgtaagaagatttgaccatgtttgtatagagactatcttccttggttcatccttaaatgaaatgaaaatcctgtagcaccatttctagcatttggtaagtactcaagaaacgtgagcttttactgaccatagactgaacatataggctactaatgagaaaattcctatacttgaagaagcctaacttgctaggccaattttatatttttgctgggctgccatagggttagaattaaaggcacattaaaatatgtattaaaaggccaatagtggtggctcatgcctgtagtcctagcactttaggagggtgagacaggtggaacacttgaggagtttaagaccagtctgggcaacatggtgaaaccctgtctctacaaaaaatacaaaaattagcctggcatagtggtgcatgcctatagtcccagctatttggaggtgagatgattgcttgagcctggaagtcgaggctacagtgagctatgatcatgccactgcactccagcctaggcaacagagtgagaccctgtcccccccaaaaaattgtattaaagatacattataatgtgaatgtgtctgtagtatacattaagtctttatgtctgtaaagacatgccacattctttctttttctctctcagcatatgtacacacatacatacacacttaaatctctgtgtgtgtacgtgtgtgtacatatgtacacaaatggcacattagctttatctagaaatggatacatatgcattaagctactgtaaagtttatgcacacttaaaggcacattaattctatccaggcatatttctctataatgtactgtatatctgtatgtatactaatacattattctatcatccatcataaatttctggcccccccacaggaaatgaccttgtattttatgatcaatgcaaggacaaaagattttgcatccttaaattatattcaatacatactctgtgaataaaaatgccataacttaaaatattgcccttggtatttgcatagtgcctttcattactgttgaacaaaaactaatctatgcattcattctgtggagataagttgtataaatgtgataagtgagatattttcttccttagtccttaaaatgatagtgtaaggaaatggaattcttttgcctggagatgagattacccaagggtataatatttccagaatggatactatgaagttgtaggaagttgctgtatctcattttcagtgaggccacaagagaaaattgttgtagcaagaagttgtggtttaggctttaaaatgcctttgctgtgaggttaacatagaaggaatgggccattaaagaagtttgtatattcttccttttttcgatgtttcaataaagtaaccagttctttgaggttaagtcagtctgttcgacagcctattctaagaagaaatggcgccttcctacccacagtgggtgagtctagggaagtagttttatatcaccacaaccctgatacacctttctttcccccacaacatgtgctgattggaccagggatgggaattgtaatgacgggaaaccaattagaaaactggtcagagacaccatgtagcctgacattaaagaatgaactgcacctatcctgtttactttttcagtaaattactctaagagaaaatgtattttaacaatgggagctgaagttgaagggaagccatgaaatagaggggagttgtctctagccatttgcttagaaaagtagcagggacacacacacacacacacacaaaataaaaacaataagacataagacctacttactatttgataacacaacagggtgactatagtcaataatttaattgtacatttataaataactaaaagagtataactgattgtttgtaacacaatggataaatagttgaggggatgggtactccattttccacgatgtgattattacgcattgcatgcccgtatcaaagtatctcatgcaccccataaatatatgcattatataccccataaacctaatatgtacccacaaaaattaaaaataaaaatgaaaaaagtagcaggtaatattaacaagcagaggaaattatgactagaaagcggaggttggatagacgcaggagagagaaaaatgagcaagaatgctcatgtgactaatgagagacctgctttaattcgtgtcttcccagacctcatgccatgcaccctattcccattttttcttaaagaacttgagagtctgtatcagttagatgatttgggctgcaagaaataaaaatagtcatctgaaagcagtgtaaactagggacatttattatctcacataacatgaagtgtggagaccagcacggttttaggctgtctcagtgatgtcatcagggatacagttccgttctatctttcctatgtgctgtactcatcattttggctgactttggtgcattcttgtgaaattgagttgcttctcagctttctccacggagggcttacattcagctcattcagctttcttgggtctgcaagtcagttctacttgtctgtatgcttcctactttgtaaaattttcttggtcttctctcccctcctattttcctcattattacaaatttatgccttaaaggaaataatactattattttagtggtgttttgagaggaaccagtggtaaatacatgtatttaatcatttaatctgatctgccaactttattgtgaagtcccttgcgtctctcttttaagatgaaagacatttacttgagaagttttctcactagacttcccctcccatatcattggccaagatggagctatatgctgtatgcagaagacagagtcataagccaatcactggcaaggggaatgaggtcactttggcttggacaaattgccattcacttttggcaatgagaaggagcaccttcctttgagcacatagctgtatggaggatgaacaactagagaatgatcttcaaaatactgaacaatggatggagcatggaccaaccagtcaaaatgggcatgctacccaaatagagcaaagaaaaccctataaatacccaaatgaaatctggttcaaccaacaaggaagaagatggaaacaaaagtcttggtttctagcacctaaataacaattgcagaaaataaagtacacaactgcttcagaggaaggaccaaatcacctcataaggaccattccagcctgtaaatttttacgcagaagagaattgttccatttaatgaatattttattaaaggagtctacaacctgaactgagtatcactgcagggagccagagtacatgtaaattacagggttgtgggcactttccaattctggcacaacctttatgtaaaaggttaccctagtcctttaagagtgaacttttagagaaaggttctacctcaatggtatttgcaactaattggctttatcttacttgccagctcttgattgatgaagctggctgaagggttggattgaatagaactcggaggttgagttggaatcagctggaaagagcactatgttcatttggcagtgtgtgtgtgtgtgtgtgtgtgtgtgtgtgtgtgtgtgtttattggcatggggaatggcagcacttgggccatgtattttctctcttctttcaggtcagttttgtatgggctgagactccatggagtcacctaagctggaggcttccaaattacaaactgtacctaagacaaggagacgacctttcttagtgggtgacattcttagtctaggaagaggagcattcctgtggaagagttctcagggatttgggtaacatcagagtcagaaggaaaaggaagttttgttgagtttcatatttgagaagaaagctagaaggcagaagtccaagggtgtgtcagttattttgaaaagtaaaacatgaagaagagaagtataaaatatttccaaagctctgggtttaatgacaccaagtttgctagttttgtttcctggtggtaattagcagtcaaacaacatgtgtgctttgggtcatcaaatattattgtgggtagggagagcagccagtcttgagcaacatgatttcaagggattgagtgagtgatgaaaattattgcaggataggaaagcaagttggatttctggtaactacagtaaagaggaaaagagaatgtgaagaatagactgacagggaagctctaggttgagcgacagaaaggcctgtgtggaggtttccaaatatagtgccttatactactcaaagcccttcctattgtcttgtataattctcttactactctttggattgggtacacttgatatttttagttctgtttttctgaataagttaattttcagagaaggtaaagtaacccaaaagtacacagctagatggaagctgatctaggaccagaaatgagttctttcaacttatagatcagggcctttcctactatcctgcaaggccactgagatctaaaacagaactgtctgatctgcaggatatctagaagtatattaggcacaggtgggggtgtatgggtggggaagacagtattccaagtagaggaaatagcacttgcaagaccctggggaatgagagagaatggtggttcctaagaacacagagcagacccgtagagcaagagcaggaaaagcaatatggacactggtgtaagatgaggctaaacatgtagcaggggccagattctgaagcctttgagggctagcattttacttatttagctaaatctcacactcaccagcagtttcctttctaaataggatcaacatgcatttctttggacctttgctgacaccaaatggtaccagtctttgagcctctcaagtgaggtgggaggtggggaaaggaggacataaaattagcataagtacataaacctagttgcacaccagtcttagtatgagtaaataacatgttctgcattttcatgtgctactactttccaaatgaatatagatgttatgatgaataaaactcaaattcatttcaatgtactcctgaattcctgggagcttttagctgttatgcatataacccttctgcctcttgccttatcggtctgtgacaacaaatacagttacaactccttttgctctacaaattattgtggcttgaaagttgaccccactcaaagtatcatccagctatttctgggtatttccatggggatggaatagatcccttgggctcttcctacctgagtttctccacctcttctcttcttctctgagtttcatgctattgtccatgctctgttctccttgtggttcactgcttttctgtgcctatctttgttcattcccacctcccatgaacccatcactacctttctttattcccgccactcctgaaccccttactatgtttgttcatttccattggtcatgtcagcactgctattgttgggctcaaaggctgagatagtttgttttctacatggaatggaactgtgacagaatctcctgagggttgagggtggctctgtcacttccctgagactggcctcttctccagccatcatctctgcacttctacacccacagctgcagctgatgtaagaggaccagcatatatgcttgtggaaagcccagacttgctcttactacactcttctagcctccccagttgtacaagggctgcttactcccaatgatgaaatttctctgagggtttgatacctaggatttcagtacaaatggcccaacagaaatagaggaattcctttcttcctctagtccggggatcagcaaactaactcaggggccaaatccacttgtttttataaataaaatttcactgaaacccagcaacacctattttatttatatattgtttatgactgctattatactacactggcagagttgaggttatgacagagatggtatgacctacaaagtcaaaaatatttactatctggaattttacagaaaaagattctcagttctttatctcatccataaaatcattcaaggaattgttttaaaatgaaaagtgggtgatatgatcagatttatacttttcaaaggtcactccagttgtagtgacaagagtggactcagggtgggaaaataaaactgtagacagagaccagataagaagctgttccagtaattcagagaagaggtgatggtggcctgaaccgaaggaacaacagtgaaaatgcagagaggtgatggatttgagaactattgaggaggtagaaatgataaaacgtgataatggatcaggtgcttcatgcctcttctctgacactcagccgccaggctctaggtactagaagtctgatcatggatttgcttctttgtttctgtggtctcctgattcctgtctgggtcttcttctaaccccactggagcattagagttctattttcctacttttgcctgattgctagggctctgctgcctcttgactatcctctgtgaggcaattaggggaattcagtattaggatccatgtatcttgtctttgtccaccaatagaagatactgctaacttggacttgcattgccttctgatattataggcagaaacctctgtgagaggttctgtgatttctctgtcaggctgaactttctgctagcagttgtgtattccaggaaatgaatatagctctaaatccaaattctcacagtttgcttggttcttttacagtacttgagatgtgctgggccaattccaaaggtaaagaagagtaggtgggtatcctggggcttcattatattaaaagtgctaattctttgatttttattcacttatctcaactgattaataatttttgatggaatgagaaaagataactctgttttagtcttccctctagggttctgtctttgtttattctatatccctatatgctgataacttcctagtttctgtcctagaatctagcatatatccagcttccactgaattcctccacctggatgttaccaaaacactcaaggttcaatctgtctaaaacctgaaacctttatcttattgctccttttccttttcttcttcccatatcctttgtgctaatgaatggccccaccaatcaatcctgtcacacaagcaaaagatgtggaagtcatcttggagttataaattcttcctatttccttactctacaatctatcaggattctgtctcttaaatacattttaaaaatccttatctcttctacattcttgctgccttagtttagtctttttatgtctcataatgactagtcatttcctggcttgtctctctgcctcttgtcctgttctgatctaatccttcaaggacaggaacaaaatgaccatcattttagtagcctcagaactgaggatgagatgggaacacagaaggtccttgttgaatatgcaccaatctaaataaagaggaaaatcaggatcacatgtgtcttttccttttgatactcctgatctaagattttctcttgtcggtatcttccttctggttcctagaaaattcctcctatgctatggaagacctcaaatgaggtttctaccaagactttgagaagatttgaagcttttttaaaataaaaagtttagctttttcacaggcactgttatggctcactggggaggtgggaaggccttctgctggggtgagaatacaagtcaggctcctaaattttcataacggaatgtcagccttgccacctgacagtctaaaacatatgcccaaagcatatggatctcttttcaatcaacacaacgtcttcacttcctctaaagagctcaatcttggactgactgatattcagccctatccaagaagctcagctaaaaagagtgatatttgagagatatttggagctaatcattcagtctctaagtttggactacaagttaaaaattcgtttggaccacagctctaattccattagaaatgtcatcagtgaataacatttaagtaatgtgctttctgatttttttccctttttttttttgagacggagtctcgcactgtcacccagactggagtgcagtggcgcaatctcggctcactgcaacctcctcctcctaggttcaagtgattctcctgcctcagcgtcccgagtagctgggactataggtgtgcaccaccagggccagctaatttttgtatttttagtagagatggggtttcacaatattggccaggatggtctcaatctcttgacctcgtgatccgcctgcctgggcttcccaaagtgctgggattacaggcgtgagccactggtgcccggcctgtgctttctgattttgtgcaggattgataaaaagatgcctactactgaagaatcacccccaaagtatttttccattatcttaatgtgtctttgagaaaaaaaaaacttctaaagaagtagcatgcttcttatattgggtaatgagaactactatagttctgttcaagacaaagtttcaacatctgagctatccctcttctttggataatagtaactatagataaaataacaaaagagaaaatttaaaatacaataacactttaaggaacaaactaaatatgtctttgactagaaaagaacagaaatgcaaagcagtagggctggagatgagtgtctgctgggctgtagcactgtaggcaggcagagatgattaggagttcagcactcacaaggtgacaggatctaaaagtgccaagcaggtggcaaccagacattggatcattgtttgaaatcagggtctgaggtggagtaccactgcataaaaggaagcttaaaaaaaacaaaaacaaaaaactgctgtctaatactaccagaatatcaagaaaggaagtaaagatgaagctacagttttgaagccagagcttctgtgaagctgccttctggctcagtgacgagtgataatgtcacaattatcccaatgaggcaggaacactgatataacaatataagatgtatttctaatttgggatcctaacagggttggctgagggccattgaaaacccaccagaaagggaggaaagagatggaggaagaaaagcctaaataattgacaaagcttccgcctacccaagacaaacctgaaaatctaaattccataattaatgaagaaaaaaatgctaaaaatagctgtgaagataaattattgacatcaattccttctcagatgaagtgaaaataattatacaatctgaaaaatgctttataataagacatttatgatctttcacagataagataaaaaggaaaaacattcataatgaagactaagaaaatataaaacaaaaccatgcaaaaatgatatgataacaggcagatctaaaaatagcttattaaaaattagagaaataacatggcataaacttttgaaaaggcaaaagcaaagagagaattagtaaatcaaaaaaatagacctgagacattatgaaaaagcagttcagagaaagggaaggaggattgaggaggtgaaaggtatagcagaagctccagaagaagagagaaaagagtgaagtagcaacagttgaagagactttggctatgcatttttcagtgttgaagacacaagtctcagatgacaaatgtaatccaggttctaagaaggatgaatgaaaataaatgcatacttagatacatcttagtaaacttgaagataaggagaaaatattataaagttttagttatgcaagatgaataagttctagagatcaggtgtacaacattgtgcctgtagttaacagtactgtgttttgtacataaacatttgttgagagagtagatctcatgctatgttcttaccacaataaaacacaaagcaaaacaaaaaactatttgaaggaaaaatcagattcttaaagaatggccttggccgggcgcggtggctcatgcctgttatcccagcactttgggagcccaaggcgggcggatcacctgagatcgggcgttcgagaccagcctgaccaacatggagaaaccctgtctctactaaaaatacaaaataaaaatacaaaattagccgggcatggtggcacatgcctgtaattccatctactagggaggctgaggcaggagaattgcttgaacctgggaggaggaggttgtggcgagctgagatggtgccattgcactccagcctgggcaacaagaatgaaacaccgtctcaaaaaaaaaaaaaaaaaaaaaaaaaaaagcatggccactagcagacagttgacttccaattagcaactgtccaatagagcaatatctacaaattgctgagggaaagccactgtcaatctagaattatatgcctggcaaaaccacctatgtgtaaaaggttacatcaggccaggtacctaaacataacaaggctttcccgggaaggaaacatcggttctcacaacatcatttccttggatgcttactgagttaacataaatatggaaggccaggcacggtggctcatgtctgtaatccgagcactgtgggaggccgaggcaggtggatcactagaggtcaggagttcgagaccagcctggccaacattgcgaaaccctatctctactaaaaatataaaaatgtgctgggcatggtggcaggcatctatacccagctactcaggagaatcccttgaacctgggaggcagaggttgcagtgagccgagatcacaccattgtactccaacctgggtgacaagagtgaaactacgtctcaagaaaaaaaacccaaaaagataaatatggaatactgcatgctaagagctaatgatctgtcttgtttactctgaaattcctgattagagagagcatatctggactgagattattctatgtgggcctacaagttttgggcctatatgacaggaacaatatataagagaggtgggaaactaaggcagtagcttctctgtgctaagtgaaaccatatatgtgttgaagtcatccccattttctgtacacatgctgtgtaggtaaggggagataaaggaagctgtgcatacatatacttttaggacctctaagtagtaataaggctgtttttcttgacttctatgcttctataaatctgaataatttaatgatagattaaatcctattgtgttacatgaatttgattccagtcttaacttgtgatcactgctagtaaaataaaacattttttcacatacaaaaattaggagacttttccactcacaaactattatggaatgaactataaaggatgtactttagcaagaagaaaattgaactcaaggaggaagactgagatgcaagaaacaaaaccaagtagagaaacttaaaaattaagtggataactaatggttatctacccaaaggaaaataagtaattatacgaaaaaagatacttgcacacacatgtttatagcagcacagttcacaattgcaaaaatgtaagccaacccaaatgcccaccaatcaatgagtagataaagaaactgtgagatatatatatctagatatatctatatttatatctagtatctagatatttctatatttatatctagtatctagatatatctatatttatatctagtatctagatatatctatatttatatctagtatctagatatatctatatttatatctagtatctagatatatctatatttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatctttatatctagtatctagatatatatatggatatatatgtggtaactgtgatatatacatacatatatatataaaatggaatactactcagcccaaaaaggaatgaattaatggcatctgcagcaacctggatgggactggagaccattattggagtaactcaggaatggagaggcaaacatcatatgttctcactcataagtggcagctaagctatgagaatgcaaaggcataagaattgacacaataaaatttggggacctggggaaagggtgagaagggtctgagggataaacgagtacaaattgggttcagtgtatactactctggtgatgggtgcaccaaaatctcacaaatcaccactaaagaacttgctcatgtaaccaaacaccatctgttccccaataacctatggaaatgaaaaaattttttaaaaagttgaatggaaactcaaaaaaaattaagtggataaggttttttttttttcaattaaaaagtgaaacaaattgctaaaccacaataatagaagataaggtgagtcttcactggatacttaatgtgttaacatctttgtcctatttgagaggaagatagagatactatgctgaatgactttatactctccaaaaaaaaacactgaaaaaaggatacagttttaaaattataaagtatatatttttaaaacttatttaaatacatattttatcattttaaaacttaagaataaccattaaaatgagagtaatattctccatagcttctgaattcacagagcaaaaaggagtatagaaaattttatcagtaccccaggaggtagaaaaggaggaaaaaaagaagcaaaaagaaaggaggagaattagataaccaatgagttttcgtttttcctatggctggcaggaagaccagataaaaaatattttccaagtatttcatcctatattcctaatatgattattttcacttttcataagatagtttcatttcttttgccttcattttggatatctatatagtcaagtttaaaaaaagccacaagaaaatcacatggggggttagggcttcaacatatgaattttgggggatataattcagtccataactaccctgaacccctgtcctgcagtaatgccctgccctctctggtggagcctgtgtgtgaaaccctgacttccatctctgccctgcattaacaaggaaacaaaactggtaaattaaacttcatcaaaattacagtattttgctctgtaaaatacctgctacaaagatgaaaaaacaagctgcagactgagagaaaatacttgcaaattacttacctaataaaggacttatatccagaatatataaaggactctctaaattcagtagtaagaaaacaaacaatgcaattagaatatggtcaaaatcttaaacagacacttttctaaagatgacatactggtggcaaatcagtatacgaaaaaatagcctctaggaaaatgcgaattaaagctatatgtgctaccacacctattagaataaccaaaataaaaattactgatagtaccaagtgctgatgaggaatgttaaatggcatagccaatttggaaaatagtttggcagtttcctataaacatacacacaccataggacccagcaatctctttcatcagtgtttatcttagaaaaatgaaaagttatgttcacacaaaaacctgtacatgaatgtttatagcagctttatactgtaccggtcaacactggaaacaacccaaatgtcctacaactgatgaatacaaaaacaaactgtgggccatctatactatagaatactgctcaaaaattaaatggaattaactggttcatgtaacatcttggatggatctcaaaagagttatgcatagtgaaagaggccagtctcaaaaggttgcatattgtatgattccatttatataatattattgatgtggcaaaatcataatgctgcatagatctatgattgccaggagttaggattgggggtaggatatgatcattaaggtgtaactcaagggagtttctttgtggtgataaaacagttctgtatactgactggtgatggttacaccaatcatagaacgatatacacatgcacatacccccaaaagaagtccacacaaaatctggtgaaatccaaataatgtattgtactgttgtgatacacattattattgtattgtatgtaacaatgtcagtttcttacttttgacaacgttctatggttatgcaagatattatcattaggaaaggctgaatgaggggtacatgaaaattctctgtactatatatggaattacttttgcatctaaaactatttcaaagtaagagttataattttaaaaaatcagttgtaagaaattttaaaaaatgttctagcctcaagcctgtctgacttcaaagccagtgtgattaaaccactacaccacatggtaaagatcccttagaaaaatgcctatgtcagcaggcacaaataagggacactcctagctattcaaaattatttttgtctccttaaaccctaaaataaaaaagcacaaaacaagaaatggctaactgagataactataacatttgaggtgggatgattttaatagaccttatataccattttaactcttttaggttaaatcccacttcgttgttcagtgatctcaaaatgtgttatgaattctttttggtagattttcacatcagtatttcaaatcaccttactctagatgtttttctcttgggtgttctttttgttaatatttttaacttcacaaagctcttttctatcattttagtcagttaattgaaagcaaagcttaaaggaaaccaacatgtttaaaataaactttttagggttggagactacatgctttttgttatttttcttgctctgatatctcattagtgttattacattcctgaaatacctaaaatggttaaaagcatgaaaagcacaagtattgaaagaccttaggagactgcattttgaagccctcaaaaatgtgaaccgggaaatacataaaacaactttgtttgttggggttaaggtcatgggaaatacatctgtttgcatttgtggagtatactgtcgtagaaaactacgccgcatgaagcaatggagcaaaaagcacagcagcaatatgcggttacatcatctgctaagcatgtatattacaaattacttgaaagcaataatcatgatattctggatcccaccaaaatgttatgatttaaacatccacaacaaaggctgtgcccagaagcctttgttctgagcagggtttatttgaagaaaatggaatgtgattgtaataagaagcctgggctggctgtgtctctccaactcattaggctgcatgaggtggtagggtgaagggagatgggctggggagaggctggtgagttccacacaacaccctggggcttcacaagggaagaggaatgacaggtgcagaggagatatatgaagttctccatcagatagctcctgcagagttggagtcctagccttcagggcagaactctcaggaggtgcactctatcatagtcaaaaattccagtgatacattgttcatgagaaaaatcagacaaggcaattacaggaaagagcaggaagccacctccgtcttccaatcagattttcaatatttaaccatcacttcctaagtacagttgggctctctgaattatgcagcatccacaagactgtcggagaagatttgttcctaataatggatttttgcatcacaaatgaatagagttctttgtctttatattcatctctcttctctgtggttacttcttcctaatttgcgtttttacctgtcactttgcctataagaaatgtgaaaaatatgaagaatcctcttttattatcatggcctatgagtgcccaaactgtttgaccctatatgaattaaatacacttttttggatattttgttctccctgtatgtagggtttcaaatgggtgcaaataatatacagttaaatctaaatgtgctctttccaccagaagaataaagtctgttaccagctgaagatgagaaagtggaaataggcatagctgagataaattaaaaaaaaatgggagccttgggcatttttcataacagccctggagttagtggttggctgggaggagggactgtcctgtgtgtggctttgaagttatgtggaagtcattcacatttagcacattattctcaggctatgggggtaagggtgatgctcatatctcgtagagagagaatgttcacttactgaaagcctgcctggactttgtccttttccaggcaccatttaactattaggagttctagatcatacttggcattaaggatgtcataacaaactccactttctaaggtttctgatccttaaatataatcaagagaagtaatggtttattttcatctgcatgcattctcatgcctttgttgagactatgccagggaaaagcaagaacatccatttaatgggaagtgtcatatcttcctccgacccaccctcccttcctttcttcattccttccttcagcagaggttttcaagtgcttgccatgtgccagataggcactgtgctaggctctggggaaatcacaactaacgacatgcagcctgtgtttcagggatgattttacattccagtatggaatacagaaaagtgaacaggcaattgcaactcagtgtaataagtagaatacatcttctgattataattataacaataatagggatgtatttcttaggtcattctctcaactatcccttgagctaggtagtaattttattcctgttttactgaaaaagcttgaggcttggtcaattttgcaagttcataaacttagcaagtgtaaagctggaatttgaatcctggcctgtggaatttgaatcctgtttgtgcagtcctagaactcaagcacttaactttgacactaattggttgctatgggaaaacatggtggtgggaatgtacatctggcatggtcttggaagtcccagagggtggttacagaaggcttcttagaggaagttacaactaatctgaggattgaagagagaataatagtgaaaagaataaggcatgaagaataagctatatttaggttggaaacctggccattcctacctcttagcttgggtaaaatgtttaacttctcagcctcaactgccttatctatttaaaaaaatgaggctaatattatccctatttcagagttgttagaatgaaatgagatagcatagcatatgtgaaagttttagcataaggcttggcattaggaagacacccagtaaatgtttattttctacacttttccaagcaataatagcgttctgcattttaccgtgtgtaccatggaatgtgtgatctgccttaacccaaaagccatgggataattcagatagtttaaaatgagagtttagattatttattctaatttatattagtactaaccctaatattgccttggttattttgggtatttcacttatctacttgcctaacaactcattcagctattactgggtgtattttagaataaacattcctggaggaaaaagatgtttggctatttctcagaaataacggagcttgaaaggagcatttatcaaaacaactaaaaaaaaatctctgtgactggttgctggattaaaggaagaagacatgaatctacaacataataaattactaattgtttctcaagttcatggccatttgtaacatttaaaaataattatgtacattatgatagaattactttcagatgtaagaaacccctcttctccacaccatttaattaaacattaggtactgttgaaacaaatggatggaattggtttaggataaatggttgtaccactgttactgcaagatgaatactcataagcaagattcataatctttctcattaaatctcttttcctcttatgtgtcatatctcagttcatatctcagttaatattatcactatcctctaaattactcaggctaaaaactttgacttatttttgtcttctctttatatcaaaccagctgttaaatgtggtaggcagaattctaagatggtccccaagattcctgcaacctggtttaacactttctatataatttcttccctttaagcgtaggtgggacctatgaatatgatgatgtcactttagcgattaggttacattatatggcaaaggcaaagggatttcacagatggaattaaggtccctagtcacttgattttgacttaatcaaagtggattatcctaggtgggcctgacctaatcagatgagccctttaaaacagggatttagccttcctgagtccagacatttggagtagcagatgtactcttgctggttctgaagaaataaactgtaatgtgatcagaagaaagagcatgcggtgagaatatgagagtgacctctaggagctaagaggtggtttccagccagtaagtaccaagaaaaatggggaagtcagtcatataactacaaaaaaaaatgaattctgccaacaacccaattaagcttggaagcagattcttccctagtcaaaccttcagataggaatgtaacccaactgaaacctttactgcagccttgtgagacctgagcagacacctagctaagccacacctgaactcaacccacaaactgtgagatagcaaatgtatgttgctttaactgactacacttgcattagcttgctatgcagcatagaaaactaacacattaagttctcttcattctccccttccagtgtctttatctatccccttttctctattactatggccctcatttatgtcttcatgtctctcacctgaactaataactttctaactagtcttgtcattttcaatttttcacttctccaggaaatccactgcccctatatccactgtattctgtcttatagaatgtagttttgattatatctccccctttaaaaattctcattgctcccagttttctccactgtcaagggagtatagctttgtcatttgggctacgagtttttgatttagagagctatggatttgaatttaaattccaacacttaactaactttatgaacatgggcagtgaataaacatctttaagcctcagtttgtaaagcagagattataattttcccttccttatagggttattgtgagaattaaatgagataatgcatgtaaagattatgttacatagtatgtgctcaataaatcatagctattattgtggttattatgtaattaaattcaaactcttattctggtactcaaagttactaatgatcctcaatagctttttcagccacatctcgtacatctttatgcaaatcttgtggatcagccatgacaacctatcaaaaaacttgaagtccttggttgcatattatgcaatactttttttggtctattttcttccctcaaattagagtccctcccaaccctccactctacacttatcaaaattttgttactcttttgaggcctcccctctaactagggctagctttcagctagcacctgtaagtattcctttactgagtacttacaacccaagtgtgttctgctttgttggaggcccattctgatttgtggtgccatataacttgttggtttttctatcaaccctacctacaaccttccttttcttttatcttttgactcagaatttatctttgtgttcctgcagcagttttcttgcccctatgcttagtatgtcaaactatgttttgaactccaacctgctcacatagttgggtacctccccatataaaaaagggatcattttttatattcccagttcgcttggcacataataagtactcaaaaccttgttggatgattaagaattagtttcactgacctccttgtcagtcctaagaatgatggagcaaatttttgtaatggataataactactaatggttgactggctttagaaacatcttatttggcttaaataattaaatattctacataagaatgcatcaaagtaaactatgtgtgctttataaagcacaataaaatccatgaagaatctagatggccaatttatttaaataaacatatctctatctttatatatgcttctttgacggaataatttcagatcttcattgttccaacaaatctttttattccaaacaattgcatttattatcctgcaaaaagtcttgagataccacctagtgtagaggtctggagacctgaatccatgtaaagtaggaactgtgtcttccctttctctctgttaacatacgcctgttgatacatacactctgcctggcttcttcttccatagccagttgaggaccattcttgctggaaaatgtagacctcaaatagaaattatgcagccttgccttcttttcatctggtaattatgcatagatgttcccaagaagtatttgaatgctgaggaaatcattttgtcttgagaaatataatcttttactttctttttctctccccgtctccctccctccctccctgtccccctcctttctcactctctttccttttgaggcagggtctcactctgtcacgcaggctggagtgcagtggtgcgatctcagcttactgcagccttggcctcttgggctcaaagcgatccttccacctcagcctccatagtagctgcaactacaggcacacaccaccaagcccagctaatttttatgttatttatagagacagagttttgccatgttacccatgctggtctcgaactcctggactccggtaatacacctgcctcagcctcccaaagtacaggtgtgagccactgtgcccggctcactgtacaggattacaggtgtgagccactgtgcccggccaacctcatttctttctgagcaatagctttttaaaactttattcttagaagataataatagcaatgatatccttttgtgttattagttgtatcctcctttatttcactttatatttattttaaatcggagctaggcagactagtttctttcatgaatttcttacttctttcttagaattttagagtccatgaaatactgtaaataatgtgtgtgtgtgtgtgtgtgtgtgtgtgtgtgtgtgtgtgtctttaaaaatgttcactttttgttaaactcagtgctaggtattttatgtgcattttcttagttaatattcccaacaaacctacatggtatatactattacttccttcatttttccaagtgaaaacaacaagcttaggttaagtgattttcctaggcactttcctttgctttacaaaggaaaactctgagacttaaagaggttaaatatcttgctcaatgtcacacaactggtaagtctcgcacctgggattcaaacttatatgtttcttgagtctatagtctgagcttttaccctctgtgctatagctccttcctttcctttgaagttcttgacatctgctttcttaacatcttcagcacatgccagcctctgccctatattttctttcttattacaaattccaagatgacatggtaaccattcagttcttccttgtaagacagaaattggtccaaaaatagcagtctctttgctgtatctgctatcatttcagagatgatattgtcagtaaggtaagtaaaacagtttttaactactttactttgagctgcaaagacttctagtaaatgttgtgagagtttcccatgaacatatagcttacctctgtgccagttttgtcatagaagcagtccattatatttagtacatgaatgtccccaagactgtgcaggaaatcagatccacacatattgaatcgtagacttaggcattataatggaggactctgtttccagaagaataaagaatccttaattataccacaacttttagaaaagacaaaagttgacaggacatagtggttgacatctgtaatccaagcactttgggaggctgagatgagaggattggttaagcccagaagttcgagaccagcctgatcaatggtaagaccctatctctacaaaaaaaagcaaatgggcatggaggtgcattcctgtagtctcagctacttgggaggctgaggtgggaggattgcttgagcctgggaggttgaagctgcagtgagctatgattgcaccactgcactccagcctggatgacagagtgaaagaaaagataaaataaaagttgatgatgttctactttttaattcaatttctttaatattagtttgttcctttataaccaagcatcagtttggcgtcttgaccccaatgacctcagttgatggcaaaggctctgctatttttgttttcagacaggatttcactctgtcacttatgctggagtgcagtggtatgatcacagctcactgcaggcttgacctcctgggttcaagtgatcctcctacctcaccttccagggtaactgggactacaggcatgtgccaccaccccaggctaatttttaattttttgcagaaacagggtctcactatgttgcccaggctgggatgggctacttttgacatacctaatgacctcaatcttggttttaattgtaataagtttaggaaaatatattctttattagtagcattaatatgttcacccttttattccacactcatattttagaaaataactacagagatataatagatactcataattgcatatacactgtattaaggtcaaaggtggctacattgttaaaactaagctgttttggccaaccaatggccaatttcacccaatgatagcttgaaacatttttcaaaagttcatggatagcttaatacttaggtggtgggttcacaggtgcagtaaaccaccatggcacaagtttacctgtgtaacaaacccacacatcctgcgcatgtatcctggaacttaaattaaaaattttaaaaagttcatggatgaatgtccaaattcaagtattaaagtaaatttaggagtataaatatgtcattatgaaaactcagggctgccagtatattttaaaaatgaattaattatctgtaatttttatttgattgaataggctgtagcattcttctataatgattaactctgtttctctctcactttgtcttaacccaaatggtcttcactatgctcctggtgacaagtttaagaattcccattaagattatatcttatgtatcactgggctttcccccttccttttatatttaatccattcatttccagaagaaattctctttagttgtcatattcttcactggaattataccaaatattaataataactcatttattattgttagcatcaatggtagagttaccatataatttcttacctacatcagaaaatgtgtgagagtgaaagggaacactattaattgttactttcttatattaaaatatcaaattcacccttgttatctgtcttaaggtctttatttgcaacaaacataaatccactgaaattaatttaagtaaatgaagaatttattggaagggaatggggatggcttattaaaccctaggataagaaatgaagctgagacttttgaggatctgaacccagcacatggaaagccaagagcttgacgtgttgctctgcttttgaggggtcatagattactaacttagtgattaagtccatgccttttttaggagccataagtaatgaaccattctcagaatgaatagatcaaggatgccatgaggtgtctttccattaccattatatacctatttattgctgtcgtagttcatttttcacgttttcacaaacacccgtaatttgccacgtaagcatgctgccatgtacataatagaagatgagtaaacatttgttgaatgaataagtattataactcacttttagaatgctgtcacattccttcttttacatgaagatgtgacagtgacatttgttcccccattgactgattatgcacatcagtattgccctgggcaggattgatgtgactgatctgacactttatctttgtgttccttgcagactttaattttccacctaacacatgaaaatcttagaagatcaaataacactagtccaggataattatcttcaaaaaccatttgattggttttctttgaaagtcaggcttactgacttgaaaaaaaattttttttaagtaattgagcagtttgaattaattaaaagtctgaattaacaaaatctgccagaatagacttcatttaattttttttttgtagaaattacaaaagtgccaggaatttaattctctgagtgacatccttgtggtgagattaggtcaataaaaagctggagaaaacagccagaagtttcttcgcacaattgttctataccagaccctccctggctcctgtctggggtttttccctccccttattgttcctcatcagaattggtccctgggaccctggtctttggatctgctttcctcccagcgtcttagcaagtcatttctgattcccacccaaactcttctgctcccattaccaacaattccaactggatttctagcatctatctttaaatatctcttgacatccctttgtgaaaacattaattgttgcctctactgcatgatttagctccgcctcccacaccacagactaagactgattaccaattatgcactgctggtaaagatttggttcctaattgtgaggatacattgtttttgtttgttcgtttgtttgtttgttttttgttgttgtggatgttgttgagatggagtctcgctctattgcccaggctggagtgcagcgacacaatctcggctcactgcaacctctgcctcccgggttcaagcgattatcctgcctcagcctcccaagtagctgggactacaggcgcacgccgcaacacctggctaatttttgtatttttagtagagatgaggttttgccatgttggccaggctgggcttgaactcccgatctcaggttatctgcccgcctctgcctcccaaagtgctgagattacaggcgtcagccactgcacccggcctcattgttcatcgttaatatatttccaagcatggatctttgtatctgctctaatgaagagatacaactcgtttattattgttagcatcaaaagtagagttaccatataatttcttacctacatcagaaaatatgtaagagtgaaagggaacactattaataattactctggaataacaggtgcacatcaggattgccctgggcaaactgagactattgtcaccctaatcattactgattatctggcttctctaggaaaatattttgtttctgtattgagattcatttatttttcttcatgtgtttaaatctctttttgagtttgctaatttctggaaataagcagttcagtaagtagattagagatcagtcttattgaaatgctctttagtcctttttgtccgacatctcagcgaggctgcggtgtctgctgctgctgtccgagcttcacaatgccacccaaggatgacaagaagaaggatgctggaaagtcggccaagaaagacaaagacccagttaacaaatccgggggcaaggccaaaaagaagaagtggtccaaaggcaaagttcgggacaagctcaataacttagtcttgtttgacaaagctacctatgacaaactctgtaaggaagttcccaattataaacttataaccccagctgtggtctctgagagactgaagattcgaggctccctggccagggcagcccttcaggagctccttagtaaaggacttatcaaactggtttcaaagcacagagctaaagtaatttacaccagaaataccaagggcggagatgctgcagctgctggtgaagatgcatgaataggtccaaccaactgtacatttggaaaaataaaactttattaaaaaaaaaaaaggaaagaaatgctctttaaaagcgaacaaacgccatgccaaaaccttagactttcaaaactaaggaacatttgacattttacaaatacttgacatggacacttttcttttaaaagtaaggaattgattaccttgtcagaagaagttacctacttttttctttattcacaaataagtactagtttatgtacatcaggatggcattaagtctttaggtttttttttttttagaagcccctgtgacgtagaccagtatggaccataattcaaagttctgtaatagaaacatgcatccaaaattgactaagtagttttgcctcttttatgtagcaatttctaaatttttaagttttggataattctttatatatacattatatacatatatatttatagaatatctgaattgataattacctcacaaaccatctaatttggtggttttcccccttggctgcatatctgaatatttggagagctttaaaaaaatactgtcttttctatctccagaaattctaatttaagtggtctgggatggaacccaggcatagacgttaaaaaaaatgcctcaggtgattctcatgagcagtcagggctgaggcgtctctgatttaattcaaccctggtgtttcacatctgagaaaattgaggcccctcttacttagctgttactgtgggttaacaatctaaatatctctgtgaatctctagatgtttttaaaagggctctgcaaatgtgacatcaccttctttatttagaactgatcataatttttatggcttccaacagatgtcttggtttcttgaattatcctttcacgtcatggggcttctaaggcacttgctgccaaaggagccggaaggtatgcctctttttctgttctccaggtagtagagcatattttagctttttatttcttgccagtattcttgcttcactttcttcatttatcttttgtgcactaaagtttgtcttctaacactttagattatgtggattacatgcctgaagatgtcaaacttcaaaaatgcttctcttttgcctttatatttgaatgatagtttagctcagggatcagcaaattatggcccaagggccaaatgcaataagctgcctgtctttataaagttttattagaacacaaccatgccctttgatttatatgttgtccacagctgctttcaggcacaacagcagaattgagtagctgtgacagagattgtacgagctgaaaatatttaccatctggtcctttactttaaaagttttctaactgattagctaattaaactctctggactgcaagaaatttgtaagcattgcgcctctatcttctaaaggtaaataaagctgtagagataccagaggtcaacttgattcccacctacacttccattacctacattaatgacttggtctttttgcatgattaaagggttttttcctttatctctgaaatctcataacttttaggctaatcttagtgtcactcattcttcatcagtttttcttatcacactgtacatttgattcttttttgttatttttgaatgttgttttgaacacctataatccaaggatgccagttatctacattttcatttaactttgatgggcttgtatagttctatctttttgcatatatattcctattgcttacttttttagccccgtattctgtgtatcttatagtattttcagtaatgcctattcatcttttccctggctcttgtatctctgctttaagattgttaaaaattcttaaaatatatgacaatatgcttgatcataattttgtctgcctggtgacaacatttttttttttaaaaaaacaaatgttccttcttcatctgccatttgttttttctgtttccttcctcctttttttcttgcaatatctttacatagtttgtatactggtttctttttaatcactgtttatctttcaatgagataagttctttctgactatttgcaggagataggacagggttatgttttgagctgtaaagaattttctatggttcatagttgtggcataaactactaattgtatctttcaacactcatttctcctttcttctaaaacaatagaaaccaggttctattcattgtcactgtgctcagctatagccctaaaattctcaactttccttgcagggggttatagccatgtgactgatcttcgtccaagaatatgtaaagaaaaagtgttgagttggcttttaggtaagtaccttaaatgtgagagggaaatggagccttcttcctcatctctgcagcctagaatatggatttaatgaccagagctccagaagccatctaaaaccatgaggcgtgcttgaagatggaagccatgtacggagggtaacagagcagaaagttaggagcctggcttcctgatgacaccatgaagccactatacaaatcttattcctcgaaattttaaaacaaaaaatagcttttttgagatataacttatatatacagttcaccccttgaaagtgtacaatccaatggtttttagtttgttcacagagttgtgcaaccatcaccacaatcaattttagaacatttgaaattcttttaaatgagagaaaaataatcatgttaaagttttttgggtttttttgatacgtagttgaacttcatcttaactgatatggtaataaagctttttataacacagagttgtgttagtgtgagtacgtgggtatgcaagagaatcgctttgcctttattttttcactgcttaccaaaagtgccagcttggagttcaggatcttcctctatcctgcctcatctcaccaataacttgcttcctgttgaaatgtcatgtctgtgcggttctgctttcagtcccagcttccctacttctctaaggtgccaaacaagcaccaaagaagtttcccctctaagcctgcatgttccagcaccattgtttagacaaggaattggtggttgctgtcccacttcttaggagagcacatgctctgcagggttgtctgggctctgcattttccggtgggtcctggctttgtcttcctcatgggccaatttaatgggctcttcccactgggctcttcccagtagactctacattaggcagccccttcctcatagcatgcttcagatttacagtcatttcctagttttctcaaggatggaacttgcattctgttttccttcttctgcttgttgcagtgtgactttggagaagagaaaggagacagatgtttttactccaccattttaaaaccagaagtctccttgcttaattttaaaataactcttttttatttatttagcagaggatatatggtcaccaatcagtggtaactactattaacttttgggagaatatttttccaaattttctctctgtcaatctctctctctctctctctctctctctctctgtctctatctatctatattaacctatttaatttctggaaaacatgatatagaattattaaatagtctacaactttgtttttaattggcctttggcatctcagtgtatgaatataccgtgagttattaaccagtcccctagtttgggccacaggccacagggttgaagagcattacctcaactctagtggtgaggttgacatatgagctctaggctctcatatgaactctaggcacaaaaggccacagactttcaaggactgggatacctgctctgctgggggttcccaacatcataagacccaatggccctctctacttcccattgaagtcttttaaaaaatacttttaaaattttaaaccaattttagacttatgaaatagtaaaagtagtacagaattccttatattccttaccccatgttccttaaagttaacatcttacataagcctaataaaatgatcaggaacggggtattaacattggtacaatactggcaactaaacagaagaccttatttgaatttcatcaatgtttccattaatgcctgttttctgtgctaggatgctaacagtgatcccagattgcatttatttatttctccttagtttctttcagtctataagtctataacagttcctcagtctttccttttttttttttttgtgacattcacacttttaataagtaccagtcagttaatttgtagaatgtcattcaatttggaatgttttctcatgattggattgaggctgtgtgtttttggcaagagcactacaaaaatacacctatatctttctcaaggtatcattatccaggagtaatgatcttgatatgtcttattgctggaggactttatcttgatcagttgttttaagtcggtgtctgatcagttaggccaaattaatgttttttagccacacagtggcctatcgagacactatctcccatatttacttaggttagttacccatccatttcagtgtggttatgttattcatttgtgtatgattaggttcatttgttagtgtttctactcggttctgggttctcctttccttgcatcctggttgattttaagtttttgtttattttgaggatatgtgaagggtttgtgaaactgtggttctaagagtcagagctatacaaaaatagtacttggagaagtgtgactccctcctcatccctaaaactctgtttccattcacctcttttcttctctttttccacttgcttccttaggtaaccacactactaagcttctatttatccttcttttagatcttttgcacaaaagagcagacaccttggtattttctatcttcttcttatgtcctagagatactctttcgggccttgcctttttcacttaacagtatgtcctggaaatcatgccatgcctgttcagagaccttcttcattctttttttaccactgcatagtatttcatggtgtggatgtatcatagtttattcaaccactttactatgtatgggcatttgggtcgcttccagtattgtacagctacaaacaaagctgcaatgaataaccttgcatatatgtattaatgcgtagttgaaagtatatctttggggtagattcctagaagtgggattgctgttgaaaggtaaaaatgtatgtagttttgttaggtattgccaaatttatttccagaagggttgtaccatttgtataattggtacataaaacccataaaaatgactttttcctcacagcatcaccaacagaatgtgtcgtcaagtttttaaactttaaccagtctggtgagaaatgatacttactgtgttttaatttgtatttctctaattatgaatgaatttcagcattttcccatatatctgaaggccatttttaatgtccagtttttgtgaattgcccattcatgtcttttcccattttttatattcttaattttaattttttttttttgagacagaatttctctattgcccacgctggaatgccctggtgtgatcatggctcgtggcagcctccaactcctgggttcaagtgatcattttgcctcggcttccccagtagctggaactatagggacataccaccatgctctattattattattattttggtagtgatgggggtctcactattttgcccaggctggtcctgaattcctgggctcaagtgatcctccttccttggcctcccaaagtgctgggattataggtatgacccaccacgcctgtcctcctatttttttaaattgagttttcagtcttttgtgtctcagttattaagagttcttcatatgttaaaactattagccctttgtctgtggtatatgctgtaaatcttttctctcagttttatcagtcgcttttgactttctttgtggtgcttttgttatataaaatattttttattttcaagtagtaaaatttataaattttgttttttattgcctctgattttttttattttttattgccttgggattttgagtcatccttagaaaacttttccctacactgagattaaaaatgagtttactcatagtttcttctagtacttttacagttttatttttaaatatttagatccctaatttatttgaagtttattaatatggatgatgtgagagatggatctaattttgtctttctccaaatgactacccaggaccatttgtttaagagtgtccatctttactccagtgatttgagcttataaatgagaacatgatattttgttttctgttcctgcattaattctcttggaataatggcctccagccgcatccatgttgctgcaaaggacgtgatttcattccttttatgactgtatagtattctatggtatatatgtactatattttctttatctagttcagtgtggatggacacctagtttgattccatgtctttgcttttgtgaatagtgctgcgatgaacacacaagtgtatatgtctttttggtggaacaacctattttcttttggatatatacctagtaatggcattgctgagttgattggtggatctgttttaagttttttgaaaaatctcggccaggcaaagtggctgacgcctgtaatcccagcactttgggacactgaaggtaggcggatcacttgaggtcaggagttccagaccagaccagcctggtcaacatggcaaaatcccatctctacaaaaatacaaaaattagctgggtgtggtggcacatgtctgtaatcccagctactcaggaggctgaggcaggagaatcacttgaacccgggaggcggaggttgcagtgagccaagaccatgctactgcactccaccctgggcaaaagagtgagattccatatttaaaaaaaaatatcaaaactgctttccacagtggctgaactaatttacattctcatcaacagtgtataagcattcccttttctccacagccctgccagcatttgttttttgactttttaatgattgccattttgactgctatgacatggtatctcattgtggttttgatttgcattatctctgatgattactgatgtggagcattttcccgtttatttgttggccacttatatgtcttctttttagaagtgtccatgtcttttgcccactttttcatgagttttttttttcttgttgagttttttaggtcccttatagattctggatattaggcatttgttggatgcatagtttgtcgtattttctcccattatgtaggttatctctgtactctgttgatagtttcttttgctttgcagaagctctttagtttaattaggtcctacttgtcaacttttgtttttgttgcaattgcttttgaggacttagtcataaattctttcccaacactgatgtccagaatggtgttttctaggttttctcctaggattcttagagtttgaggtcttacatttaaatctttaattcattttaatttttgtaaatggtaaaaggtagcagactggtttcattcttctgcatatggctagctagctataccaggaccatttattgaacaggaagtcctttctccattgcttatttttgttgattttgttgaagatcagatggctgtaggtgtgcagctttatttctgggttctctattctgtttcattggtctatgtgtctgtttttgtaccagtacaatgctgctttggttaccgtagccttatagtcaggtaatgtacctttgaagtcaggtaatgtgatgcctctggctttattcttttttgcttaggattgctttggctatttgggctcttttctggttccacgtgaattttagaatagtttttttctaatactgtgaaaaatgacattggtagtttgataggaataagtgctgaatctgcagatggctttgagctgtatggccgttttaacaatattaattcttccaatccatgaggttggaatgtttttccatttgtttgtgtaatctttgatttctttcagcagtgagaaaactgacatctttatactgttcacttacctaaaccaagaacattttatttgattttattttagtttttctggagtaatttacaattttttgtggagtcttttggttgatctagaactaggaaaagactgtcctaggccataagtggtcaggaaagaaaaaatacactagaaaatgtatcaaagatctggtaaatatgcttacattgtctcaaagttcttcacaaccactctgtgaagcaggcattgttagctacattttacaaatggttacaatgagccttaagtattaaataaatagaaagtggtcaatagtgaaggcaggatataaatttatgtgcctgtatgtcaccactccatatattatttgcaagagcatgccaggtaatggaacatctagggaaggaagcattgataataaagtttaaaatcttcagaatgaggctagaatggtggttagcttagatccagtattagaacccagtgttgagccttgtatttagttctgcacacttcacttttagagggacatggctaggcttggatagcaacaagatttcaccctcttgttaacactacttgattgatcagagctagagagctgtgctgaaattgattacaagacttcatctgggcatattagtaaagtacatagggatcaatatgcaatgttttccatgagtatgaagatagggaaatggggtgtgtcagctatctgtcagtcaaccttgggctatacaacaagtccaaagggaagtgacaaagatggggtgggaactttataagcatgccatggaatggaaggtttgaaatccaggattgggatggaagaagttttgctagttttttgttgttgttgttgttgttgttgtttttaacgttcgaaaaaaaagtcatgtcaactttttatgtgtgattcctgtggttagaacaatgatactgtgtagagtgccaactcaggttccatagaaggaagaactcttctaataatcagagttgcctaaatatgggggaaaatggcctggcagcgatcatgcacttgctgacttttcagtgtgacatagacattgagagttcaggctttgggatcataagatcatgggttacttgtgttgaatatattacagaagtcaaatccctccattatatatactcctaaccctctagagcatgatgtgggacttattttacatttatttgtgtgatcctttgcttaaaatacatctttctcagcacatgagtactctaatgatggcagtgactgttttgctcatagtacctggcacagaataaatgctcaataaatgtttgctgaatgaatgaatgaatgaatgtaggtttgtcactctcagttgttccctcctgggagctactatcaagcttgtgcttgagtcacttgctttgatgtgccaaaatatgttaaccaataggggccccaagagacacagaagtcacagaatggtgacactcaggctttgtgtccccgatgccagtttcactcatggatcaagggagggatgaggcaggggaggagggatgttcagaagataagtgagggaggggtggtaatctcccgatagttgttctttcagactttgcacttcccttttagaaacctcatcatacttctattagttgttcaatattgtcttttctatcagatcctccctgttcaatttctaatttttctgttatgcagtatgccccatgagggtagggaccatgttttccttaattatttccgtaacccgagcacctagaacagtgcctggtgtatagtaagtactcaataaatttttgtgagatgaataaatacataaatgaaatgtggtctagaatctgtgtgcccaataaagtagtgtatgagatattaggacatgcaatacacagtctctgttttcaagttgcttgtggcctaggtagatacttagtaatatgcagacaaaactctaatacacaaagaaaaaaggcactgaagcagaaattaagtttgaatctttgcctgcagtgatttgcctgtgaataggatttcagtgaccaataaaaattaccctgctcctttatggtgagttgtcataaagtatatgtgcccctgccttttcttgtatcttctagtagcaaaagaacacaaggctgcagcttaaaagtccagaatgtagtctcttcagtttccctcaactgtgacaagttagtggggagcaataattcaaaaggatctttctagaggtaatcttgcaaaattcttagaaaaatctaaattgcaaagtgaatgtacaagggggtaatggtgcaagcatcttcagcccaagatgcttcaaaaatactgagtcatcaccaaggccagaaaaatagaccttatcttatataaccacacactgaacttaaaatatgtaaagggaaattaaaaattttttgcatattacacaaaacaagtccctgagaagccagagaatgatatcttggctaaaggagtatttgatgttagttgaactgtaaatttttaggaatttaatattgattacagttatatgcaaagaggacatgaggaatgtgatgggctgccatcagccaggagagactgttgtacttggaaccataagaaacatgtgtgagtggtcagggtgctgaaagaataggactgaaatgggctgtcaagaatgcatgaatgattaatgtgtaagtgcagtgatgtggattggaatatattgcaaatttgattgagtgggaaaagtgggaggggagacttagtgcctctaaatgtatgtgggattgttttaatatcatgcattaatagatactagccagatccattaagaggttgtcaccaagactcatcaatttttcttaccttatatttcttgtattcactcttcatttcctctgccttttctctagtttggaccacacatttcatgtcttggctatttcaatagttttccagttaatcaacatgactagtattccccaaattgggttaacaacatctaaaaccaccaggtcagtatttctaaaacaacacttttctatcttaatccttcattgtccttctccccaaccccccaatattacccagaatagtgggtttcaaactgtgtcctacgatcatacatagaatgctccagaaagagagattatgtttgtttttactcaacgaatatctttctatcacttagcacaatgtggaggcagaaatattcaatgaatatttgttgaatgagtgaacgaggtggctcattggttgctgggaaatggaattagagaaagacaagaaattggattctggggctcctacttcctatcaaatcagcagctccattattatctgcttattatgtaggtgttttgagtaagttttgtctgaaaaagagtcctgttgctctaagtatttgaaagccaattaactaaaaatattttaactcgtacacctaacatacaaatcctaaattaatctttcaaaggaacctgctagtactccccaaaatacagagaatataatgtggtttgttgttgttgttgttgttgcttctgctgttttttttttgttaaatgtttttttgtccagcaatcctctccaaaaccccatgggtctatggggctgccatatttgttagtatatgatcccattcctgagaaataggttttgacccaggcctggcctgttataatgtcttgacatccaggcctgaatttgtttgtgggtagatacctgaccccagctgggccatttgttatcctttcctgggattttaaacagtttttatcagaaaccaagcaataacaatctgatcatttctgtggctaacgtttttcccccggtggctaacattaagagaaactcttcatgatcagatttcccagtgtttggagaagcaaactagagtggaagagtcagaagcaaagatccagaaagatggagatatgagagacagagagagcatcctactggtatttgagttcatttccaaggctgtcgaaggttgggttttactgaaacagtccctgtgatagaatttgtggtgtaggatatttattagggaccagcacttatgggaaggaggaagagaaagcaagattgggaagaggaagaaactgaactcaatgcaagtctgacaactccacagagaattattgagcataataagtccattgagcataaatggcccattgaaattgtgctgcatgagctgagatgttctggcctttatacttccacagtgattagtcactggatatgggctacccagggaagggcaagctcttggacaaggcaactctcagcatctgaggcaaaccctgaagtagatgatagatgaaggctgtctactgaccacatggccagcatctgggaaaacatattgttctgtgaaagggtatctgagcggcacttctccatgtccaccatgtaggcccacctttaccctgccttcaacatgtttgatcttcaacttcttttaatgatgtgagatattccaatatgcttccaatacatttcctttttttttgttttttcgcattctttttttattatgattatacttaagttctgggatacatgtgcagaatgtgcaggtttgttacatagctatacatgtgccatggaggtttgctgcacccatcaacccatcatctatattaggtatttctcctaatgttatccctcccctagccccccacccccctcataggccatagtgtgtgatgttccccttcctgtgcccgtgtgttctcattgttcaactcccacttatgagtgagagcatgtggtgtctggttttctgttcctgtgttagtttgctgagaatgatggtttccagcttcatccatgtccctacaaaggacatgaactcatccttttttatggctgcatagtattgcatggtgtatatgcgccacattttctttatccaatctatcattgatgggcatttggattggttccaagtctttgctattgtgaacagtgctgtaataaacatacgtgtgcatgtgtctttatagtagaatgatttataatcctttgggtatgtacccagtaatgagattgctgggtcaaatggtatttctggttctagatgcttgaggaatcgccacactgtcttccacaatggttgaactaatttacactcccaccaacagtgtaaaagcattcctatttctgtacttcctctccagcatccgttgtttcctaaatttttaatgatcacccttctaactggtgtgagatggtatctcattgtggttttgatttgcatttttctaatgaccagtgatgatgagctttttttcatgtttgttggccgcataaatgtcttcttttgagaagtgtctgttcatatccttcaccgactttttgatggggttgtttgtttttttcttgtaaatttgtttatgttccttatagattctgtatattagcccttcatcatatggatagtttgcaaaaattttctcccattctgtaggttgcctgttcactctgatgatagtttcttttgttgtgccgaagctctttagtttaattagatctcatttgtcaattttggcttttgttgccgttgcttttggtgttttagtcatgaagtctttgcctatgcctatgtcctggatggtatacatttccattttttaaaaatcaaggtcaagttagattgttgtcacttgctatgaacatcctgactgatatccttcagccagccagattgccctccagaatactcttctatccttttggttttgaaatacgtgtgtgtgtgtgtgtgtgtgtgtgtgtgtgtgtgtgtgtgtgttattctctactgctaaggtctgaatgttggtgccttctccaaattcatatgttggaactggaaaaccagtgtgatagtattaagaggtgcagccttggccaggtgcagtggctcaagcctgtaatcccagcactttgagaggctgaggcaggtggatcacgaggtcaggagtttgagaccagcttgaccaacatggtgaaaccccatctctactaaaaatacaaaaattagcgggacatggtggtgggcgcctgtaatcccagcttcttaggaggctgaggcaggagaattgcttgaagccagaaggcggaggttgcagtgagctgagatcatgccactgcactccagcctgggcaacaagagcgagactccacctcaggaaaaaaaaaaaaaaaggtggggggaggtggagcctttgggaagtgaataaataaatcatgcagtttccaccctcatggatgagattagcactcttataaaacagccttcaatggactcccttgttccttctgccacatgaggacacaggtagaaggcgtagttcatgaagcagacgttgaatctgctgcaccatgaacttggacttcccaggctccagaactgtgagaaataaatttctgttgtttataaactgcccagtctaaggtgttttgttacagcatcctgaatggactaggacatctatacagtcattcgtgcgacaaatacttccagtgtacccaccatggatcaggcaagaatctaaaccctccctttcctaaagcttcagcccactgcctttcttcgcacatgactccttatgaagtctgctctcctttgaatgacaatagcactcacattcctcatcacctctaccattcgtccagcactactttgtcttccactggatggctggcctctggcagaactgttttttgtgacactgttttatgaaataatgggtctcaaatgaaggatggggtgagaaaaattccatgggactttgtcccaacctctaaggatgttgttcactacattgcagtgttctttctacaagaccctcaggagatatttcttttctatctcaatatcaataccacatgtgcttctgaataactgcttggtttttatctcactaccttgtgaactgtgcaactggctaaatttctcttttcacattggctgctggataactcaagccaaacttgcacacccttagcaaatgtgtaacatactatgtcagatgccagtaactgttgcctccaggtcattgagactgaggacgtgattgtttgtttaagtgtgttgatatggtttggctgtgtccccaccaaaatctcaccttgagttgtaataatcctcacatgtcaagcatggagccgggggggataactgaatcatgggggcactttcccccatactgttctcatggtagtaagtaagtctcagaagatctgacggttttatagaggggcattcccctgcacaagctcttttgcctgctgccatgtaagatgtccctttgctctctgactttgtcttctaccatgattgtctggcctccccagccatgtagaactgtgagtccattaaacctctttcctttataagttacccagttttggttatgtctttattagcagcatgagaacagaccaacacatggggtttcttaaaaatttaacctgggccaggcacagtggctcacgcctgtaatcccaggactttgggaggccgaggtgggtggatcacgaggtcaggagatcgagaccatcctggccaacatggtgaacccccatctctactaaaactacaaaaaaattagccaggcatggagacatatgactgtagtcccagctattctggaggctgaggcaggagaattgcttgaacccaggagctggaggttgctgtgagccaagattgcaccactgcactccagcctgggcgacagagtgagactccgtctcaaaaagaaaataaataaataaataaaataaattaacctgaatgcattgaggttgggcatagagtcttggttgcctcaaacatactcaccccctgttgtaaacatcacttgtcacttcatatatgtatgcacacgctggcccccttgaagttctttgattttattattcttcctctatagcttgcattaaaaaaatttttaagaataatatttttaatttaacccaccgtattcaaaatgttatcatatcaacttgcaatcaatgcagaaaaaaagtattaatgagatatttttcatttttttgtactaaacctttagagtccaatctgttttttattgttgtaaaacatatataacataaaattgaccttttaaccatttttaagtatacagtttactgaaattaagtacattcgcattgttgtgcaaccatcaccactatctaccagcagaactttttcatctttccaagagaaaactccataccattaaacaataactcctcatactcccctctccccagcccatggcaaccaccattctattttctgtctctatgaatttgacttctccaaatacctcatgtaagaggaattgtacaccatttgtccttttgcgtctagcttattttactcagcataatgtcctcaagattcgtcagcgttgtggcatgtgtaagaacctccttccttttaaggctgaataatatttgatttatatatattccatattccacgttttgtttatctattcatctacggtttccatttttatattagccaattttatgttgttgcccttgttttctctgtaaactgcctttaattattttatgagcagtgtgcagcttaaatacattcatagttttcatcttcaataagacaataagctccttaaaggtagtgtccaacacatgttttgcacaaaggggatgtttgacacgtgtgttcattggcacaagtaacactctgttctaacctataggtgaggtgaatgcagtggggagtcaggggatgcctgcaccttggcttggggtgatgtagaacacagaacatttgtgtccctgtgtccaagcctttggtaatcttatctatctgttctatgctcctgcatttacttttcttccccaatatctttttaatgatcattttagtaacagtactgtcaacatatattacactgaaaatgctgaaaggagtccctttgggaggaggcacacaggctgaaaaattgctcttcttattttcctctccttgctattccagcctcaactgctcttcttggtggagacaaccactatgggaccagagtagattaaaatataaggctgctttaatggtaaaaagtttcccagtattcaaattcagtgaaaaatgcccttaagctttaaaatatagagatataattcagtgatttttggggaaaacctttaaacagcaatctaaaaagaaaagtttggaaagaacctataatcagagcctggttgtcccaggaggtaaggttatatgggcatggtggcttcttctatggtataactaaagaacatgaaagtccttctgaacttacacccagcagaccaggagaattttcccttgtgtagtgacacttgattggcattcatgccaaagggctcttgtgaaatggttgcctgagcagagtgaggtggcgctatagtagcacatcaacactgattccccatgtgctccctgcactgtcagtccctaacaggcaggcataaagcctctgctggagccactgcagggatgggagctcaagaccactcatgcctaccctcacctgagtagcccactgtggtttgggacagccttgttgttagaaaaatctttgttttattgagaccaaaactttctctataaacatcacctttggcttaaaatttgccttaatcacatctaatcttttttttttttttttttttttaaagacagggtcttgcttcattgcccaagcaagcaagagtgcagtggtgcaatcatagctcactgcagcctcaaacacctgggctcaagtgatcctcccacctcagcctcccaagtagctggaactacagccatgggctaccatgcttcctggctaatttttaaattttttgtagagatgggaggtctcactgtgttgcccaggctggtcttgaactcctggccccaagtgatcctcccacctcagcctcccagttccataaaaaggagaactcaccaggagttgctgcacagttcatgttcacaggatgcacgttctttcctattcagcactaagaaagccattggctttaccactgaggtgaggcctgtgaacgagttagggtacagcccaatatatggcttccttttattttcttgttttaaaatggccatctgtagagtcttctggaagccaccatatgtctcctgtgttcttgacaacaaccatgaaaggtggggtaggctggctcctgttctgcagatggtgagatggcacatggggagatggtgttgtacagtgggaaatgcaggctgaagccaaacagacctgggttgaatgcaaggtccaccaagcatctgggtccacactccctgtctggccttggcctagtcatttaaactctccgagcccaggttcctcatctattaagtgggggaaaataatagtagctacagaacagggttgtaataacaatgaatgtataaagttgtatagccctaagcttaaagcttggcttgtgttattgttgttaataaactattctccacccactccctttcatttgagtaaatctgcagcccaagctttactcaaaagaaaatattttgcattatgggaaaaggggaatttttaaaaaatcccttctctatgatacctggagtctgttttatgaacctagaaactaaatattcttatcaacttggcaggtaaatgaaaacaaaattatgtcacaccaaactgaaaaggcgaatgcatctttttgcatctgactttaaaagctgtcaggtctaagccacctagatttcattctaatgaggattcagggccagcttgtgaatcgtgagtcatgtgcaggctctgaacccaacagttggtaagctgggcttcaacaaagaacttaattaaggagaaccaccctcttcccaccccccacttattaccaccctcaatccccacccacaaaccacaaagggatatgcaccttgcactaggtttttgaccttattatgcacagtgtaacatttattacttcactcagcactgctggatgaaaacagtcctctttcaatttacaaaaacgcactttacaggaaatgtaggagaaaggccagagtacagattaatgaatgctatcaaatacatccacctgaaagtgtcaccaattttgctgtgacacagttcctggaattgcctcagagatttaaacttgtggataccccagtattgtatccccaaagactttgaaagaagtgcaaaaaatatgttctgttcataaagcattgtcaaggttatttgcaagggggtttggtttgttttattcctagggcctccaagaaatttggcccccctgccttttccatttttttttgttcctttttggtttagccaacctggcctttttgtttcctgaaccagcaaaggtagccttgcctcaggatatttgcccttggtgttacttttggttagaaaatcctttggttgggggggttttttccccatacaggttttagccaaaaaaccccctccttagagaagcattttttcatcccttctatgaagtagcagccctcagcttttttttagaacatacttttttttttttttttgccttcattgtacagtcttcccttggtatctgtaagagatttgtcccagtacccctggaggatactaaaatcctaggatgctcaagtcctttatgtaaaatagcatagtatttgcatataacatacacacatcctcctgtatacttgacatcatctctagattacttataatacctaatacaatgcttacacatcatttcatttgcttgaattaaacatagcacttggcatgtggcaaattcaagttttgctttttggaactttgtggaacttttttttcccgaacatttttgacccgcaggcagttgaatccatgaatgcagaacccacgaatgtggagggccaagtgtatttaccactatgtctcagtgattttagttaatggaggtgacaacatggagaggtcaatgccattggaacaagacttattacttacatttcccaagagaaggggatatacgacaccacgcagggccacagagaaagcaccaggttttggtaggaggcagaagccagaaaggggagagtctaggccacggtctttatcagagattccatgggaaagtcaagacagggcagaataaatactttaggactggctagttttgataatttctgtgggctttgggctataaaggtggtctctaattgcctcatacgtggttccaggataatttagggcagggaaaatattagcttggtgtgtgagggttagataaagggggtagttggggatatagactctggataggttggttggcatgtgaaaggaatgcctttcataagagctcaatcctgagcttttaactatctctaagaattggctagtgttgcaggaaaagtctctttccagacaacaagatttttcaggtgtcaaaatgtcataagatatacaaaataaaaaaatatgattaatacaaactatatgaaataatctcatttatttttgtctgtctactttaacagaaggtaagccccatgaaggtagggaccgtgtccttattgttcatgaccatatggccagcacaaagtaggtgttcaataaatatttgttgcatgaataaggaaatacgagctcctagagtctgggactgtgtggtcttcacagttgtatctccctgttccaactccatccttattctttctctagcacagtgcagaatacatagtaactgtcatttaaaaagggttgttgaattaatttgaactgagaagggtaatataccattttaatttgtgtagtttaaaatagttttagcaaatgtattcatttgtcacagataaagtggatggcacaaaaaatcatacattttagtaagaagaaataagatcaaacagattcaaaacatatgctccttttaatcagggattagcaatagcatattcaaatatcaaggacaacacatcatggattatagtgacccgatctctgcataaaatagatatttaaattcacctttaaaaacaggagcacagccagacagggttgtatacagctgtagtccaagcttcttgagaggctgaggtgggaggattgcttgagcccaggagtttgagtcttgcctgggcaacacagcaagactctgcctctaaaataataaaaataaataagtaaataggaatgtaatataccaagatgttaaaagcattaatctctagacagcaggagaagtatctttttagttttccacattttccttattttttacaatgaatgtacatgacttttaaaataagaaaaaaaatcattcaaaagaaattagcactttggttatattttattctgacttcctcattagagtatgccagcagattaatagaactaacaaaggagcctaaattctgcaacatttttttctagctccttttttatttatttatgcctcagaagcaatgtgaattctcaaattatcctttattaaatctaatcagagttttgatggactccaacaaacgagagcacagcatgttagttaccatgtcatgcaagaacagaaaataacctggtagattctccatgtcccgctaccaatgtcagccctgccaacgatccttactgacgttcccaaaactgacattcccctttcattgatgtcactgaatcaggaagccgaaaagctgttgcaaaatgactgtttctattgcaaaggtttaaaactttagagattgaaaggttaaagttaaaaatatgtattttaatttgaacaacagatggccttggagtgactacaaggctgaattaactctcaagtctctatggctgtttgtggaaagaaaaaataaaaaagacaaccaaaacccttaaaaagcccacactggaacacacagctcaagtgctggtgacatcagcagaatctctctgttgaattagagtcccgaatttggcttcagagccatctgttagcctccagatagaataatcttctatgaaattatactgcatagtttcactaatgaacatttccaattgtcagggcctcagtctcatagctgtcccacctcttggagcctccatggctccctaagcccctgtgatacacggagggatcctacttgctaaagttcacaatggatctgtcctttgaaaagatgtgtcttatcttagattgagttctatgaaaacagtctttgagatggagagctgcatgcagaaggtttattagaaagtgctcttgggaaatacagctataaggaaatgaggaaggctgcattgtgcaaagggaaaagctgacctacaaggcagttctaactcaggccttgctgtcctgtggcgagctctgttgctgggaagggccgtcagagttgtcccagattgaatcacagaatcttgggtctttgcatcttcatatcagctgtcattggatatcagctgctccctgagaaaatatttagtaaatgattgctttattattattactattgtttgctctagactgaatgtttgtgtcccctcaaaattaatatgtcgaaacctaacccccaaggtgatggtattaggaggtggagctgtggggaactggttaggtcatgaacatagggccctcatgatggaattagtgcccttataaggtgctaataactctggtcaccctttcaccatgtgagaacacagcaaggtggcactgttgatgagccagaaggcaggccctcaccagacaccaccaaatctgccttgatcttggacagcccggcttccagagctgtgtgaaataaatttctgttgcttataaggtacccagtttataatattttgttatgagggtcaaatgggctaagatattattaatcccaaagtgagtggatccttctgctcaacaccaggcaccagttggggagctttggggccatttgtatgggtgatgaggaaggataaagggctgagtagaacacaagtcagatgtgcagtgctggaattaacagaaaggcaatgtcaccctggcatgcctatgcacatgtacggaatatcaaaatgtggggagaaggcagccaccctacccagcagcgatgaagtcctagagtctactggcttgggcatcttgctgctctaaccagaaagctccgcgtctgggctgctgccagagtgggtataagtagtccctttttaggcagaacattatctagattggattacatgcttgtaaactgatcagtgcatcttcatatgctgtcaagcatctgagttcaaacaattgaactattttaataagattagcaacttggccctttcctatagtttttctctctacaggattccattcagaatcctctggagaagagtgtcttagggaagtagtaggatttcaggatgccctgcatctgccttcctgaggcagatacagctaaaaaagaccttcatgtccactagaaccacctgtacaccccaaaatgtgccagagaaatgtgcccaaagtcaagggagtggtattgtggacaggaggtttaataggattaatatgtattcttggttggtaaaccttgcaatgagtgtgcttataactcacccatggattgagagccaatctctgcctccaaaggctagagtgtaaaaaatggccagatggccaataatgaggcagaatttcataataatataatgattaagggtttgaaataaaggttatggaattgcacagatctgcttttcaaatttcagttcctccacttactaattttgaaaacttgatgaagtgatttaacatctctaaatcttactagtttcctcctctttaaagtgggataacaatgcctacttgtggcaaatggacctaagccagtttgctcattcacaaatactagatccttcgaggattatgattgggttctttttagtagatggtaggtagatggtagatgttataatcgttgcaggtagaaggctttcagtttcctcctcaaaatttctctaccaggtgctacttgctacatgaaagcaagtctcaggccagattctcaaattcttccagataggtaggcacaaaaacagtcatctaactcattctgtaagtgtgacaaaatcccagctctctctgtaattctctattggttaataggacaatttttagaggtagaattcaacttaaatttctagtagattctaggtaacaccagcctctcttcagaatcctaaatctagggattcttttttgaagcaattgggctattttagtaaagggggtgtgtctgtatgatacttatagacagtgcagtgcctggaacacttttatttatttcaccaatgagaaatgatttctaacatttttatgctaatgaataaacctttggtgttgaccagaaatcatgatagctaaagaataaagtagttctgtgggaactctttctggaatactgtattctaatatagtctcacaaaagctagtcatttttggagagtgttttcctgattagaattctttgaatattaattgaccaccctaaggtggttttaattagggcaattaactagggtaattaactactttaagatgtggattaaaatacgtatgcaaacactctctcacagacaaactactgtctatgctgatatattttaaagttaaagaccacatagaatgtctcatagaattaaatgacataatcaagtggtaactgacagcctgccctgatttatgggaatgaatgatacttctttggtggccaccagaaatacattgacggtgggggagtttttgcaagggattggaattcttgagtcaacagctaaggggtgggtgtagagagctttagatgttaatgttaatgtgatattgatagatatcactagagggtaaactccataaggacaggaacatttcccctttatttccctgctgtatttcagtgtttagaacagtacctggtatattgtagttgctcaatagatagttgttgaatgaaggaatgaataaattttaaaaatctgatctgattcttttgaggatgttcaggagttagtgcagtgctaggcatagagtaaatgcctaatgaatgtttactaattagtatgaatgaatgaatgaatgaataagcaattgagtgaacaagtaaaagaatttcctaaaggatattgtcaaactagatcaatataatgctgcacagaaatttaatttatgctgtgtttatagcaactctagcgatgatattttagataagatggcctgagcatagtggcattataaccaaatgaatgtctctatctgaagaatacaggttaagagacccatattgaactgaagaaagggctctatagtagtcgttggaaggctcccttctaagctcatcagagtctccatgtagagattgccattttccacgttgtatattttgctttttatgaacagctcttaattttaattttcaaatctatcaacctttccctttttggtttgcacattttataccttgtttaagaaattctcttctagatcaaggttaaaaatatatacttctttattttttattaaagttttgaaaactttgtctctctcagaggtcatcaaaccatcaagaattgatattttgcatatagtataaggtaggaaaatacaatttcattttcccttatatggttggtcattatttaaatataattttatttagtccaataactacattttatcatttccatctaaatcttgactagaggcttttttgggaagtggaaagggcaggttgtacaagtcatgttaattttatcctcccaacttgtgtaaatgggagcctgtgcttagggatttggtgagaggagagatccttcctcccatactccctcctttccagctccaactgtctcaagtctgagacaggccatgactttcttctcattgcaagttcattaatcatctaaggaggatgtcaacctttgggttgtgggaaactttattctagaatctctgctttaccttctcattctgctttattccctcacatctcatgtctgccccaataaaaccaaggctttttgctaccaggagtaaggaattttagtactagattatttctccttattgttgattctggcctcaagggctttgggaattccctttaatctcctgaaagctcattcatgcattaatttttttttaatttaattcaaatttgtagatgttctgaaccatgaggaagtctgcaaaaacctagtctttcacgttttcacgttgctgaaatagaagtctatggtatcttttttgtttatttatttattttttgttttgggggttggtttgtttatttcatcagtgcctttggagactaatgttttttacactcacatctttgatccatacagacttaattttgatatagtaaagggtatggtagggaatcctgctttattttttcaaagtcatccagtaaacacaaaacaacactatttattgaataattcacagaatggaagttttagaatgtaaatactcaatatgtgatagggaaaagaacactaatacaaagtataaaatcttccaaagcaaggccaacccctattattactgtcttaccagtctgcactggatgtggtcagcttcttgaatcaccagggctgtccatgctagagatacttccatctcttttagctcaaaatatttacagaaatacatatactgttgggaatataatggaggatatataatcaactttttcatgttcattgttttgttactatacatagtagatgagtttcagaaaagttgtattacattaaaatcatatttttagttcccctggcaagtgttctctttaaagggattttactttgaattatttttgaaaatcatcttaaagggtaaataatgactccctaatttttctatgatgcaaataagagtttttatttactaagtttctcaatgcaagatatacttgcataatgcagattcttttctaatacaggagaaaaaaatgaggaggctaaattttaaaagcaaatcaatgtgtattttaaaaaatgcgattgttggaatacagacttaaagacatttcttaaggatcatttacatgaatccaatttgcttgcctctatatgagaggcaacattttgggtgattttttttttcaaaatctaatttttaagctttgtagggtaggtgccaaatggtattttaaaaacacacatttaaaaaaggaagaacgtgcagttttgcctggagtacagatggagcctgtgtcaattgaaggcattttgcctaaggacacagagaaaatcacttcttcataaagaccataaactccactcatgtttctgttcattttaatttgtagaaagtgggaagaaatcaaataggggggcatacaggttcatttgtttaaataatctcatcactcaaattttatatcagttatgctctaaaaattatttgacccccaaatcagtaacgtaatttttatatgaaaaaatatggtcatttctggttatttcttgttgcttctcttactgatttttttttctgtcatgtactgtgtattgtgtagatagggcccaattctattccatctccatacctcatacatatcttttatatctcctcactttggtcccctgcagcataccttatattagtaatttaaaaaatgatgatagtaacccttattccctgtgccaggcattgtgctcaggactgtacaggtaacttttcatttaagctgcaaaacagaaatgaggaaccacagagtatttgagagacaagaggcagagccagtatctgagcatgcgctttggcttttaaaaccccttccctttaccactctgccgatattctttataaagacataaatgtgaaactgctggtaagaagataatataaatcttcattgattgacatggaaatgtgtctattataaattgctatgtaaaaaactcagattgtaatacagggtaggcatcaggatcccattcttttaaaaataaatttgcatatgtacaaaaatggctggaaagatagattcctaaatgttaatagcaattcccagtggtttaaaatattcttctttaaatttttggatttcacttttcagggagcgtttttcagtcatggttctttattgcaagcaacaactctgggggaaaaaaaaagcagcagcacatggccagacgtgagatctttggttttaataccatgtgctgctgtatcatttatagatgataatctttttcattttatttcttccttctacttttgattattaagccaattctcatattatcaaatatttgggacaaagttaatcctgcctggcaataatttctcatcggttttctatttttaaagattaactcattttaatctgttctccctgtgtcattaatattgtagtggcatcaagctacagcacaaactgacctgtatgaaaaagggaaatgtattgagttataactggagcacagaggttgagtcagagattctcagtgtcatcagggtattgaaacaacttctctgtgattcctttccctctactctccccgctttgataggctcattcgcattctgcttcctcatccttgtataaaaagctgcagctattacagtctccacatccttaccttcctctcttcagctggagaaagaccatcgcccctgataggtcctgggaaaccatgaagaaacttctttcctagagaaacctcagcaaatgtctgtttcttatttgcccaaatagggtcacctgtaaattcctgaaccaatttctaaatatctaactactaaataccaaattcattactcaatactaattaccatgaagctgagttgggtgggtaggtctccaaagggaaatttggctgctgttagtaggggaagaggaaaatgaaggctgggaagccactcattctcactggcttttatatccaccccccagtacccccaccctcccaactgccactcttaactcttccttacttcatttttgtgacagttttattccacctacctactgaattattttcctcattaaggttttatgaccactttaagaatctaacataacttgcttttggccacaacatcaaacccaaactctcatatccatttaaatttttccctccccaaccattcaccaccacttgatctattatcctaaaacagctctcactttgccccttctttactgaaagttgtctgagtcctggctgcataacaggtgatgttcattcaccctatcctgtcatttgaaaattttgacaatctggcctcatctacaatttaactttttctcttgtccttccccttactatttctagaaaacaccatattctttcttacctccacaactttgaaaacactgtctctttccatctggaaatctttcttttcatagatttggataactaagtaacattctataccatatatttctgcatacttatgtctttttctgtgaattataactgttcataaaaacacaaactagcaatatttatatgaaggcatgtttcattcattagtttatacactgatcgtggtctataaggttctgcatgagcagatgtccacctacctcccagtcttgtgtcacattctcctttttcttgcttgctatgccttaccacacaacaaatgcctaatgctgtttcctgttttagaaattccatacacatatcctccacccaaaatgctctttctccacttcttcacctgaataaactctactcctcttttaggtgtctccttgaatgtcatttctttagaaagacctctgactctcaaaagctttggtcctcctgttatgtgcttttatgggaccctttacttttcctttgtaatatttatttcagttgtaattaattatccattctattatctcttgaatgcttattactcttaacatactctaaacacctaacacgataattagtactggtggatgctccattctttttttgaataaataatggtggatactttttctccacagcagtgctttttttcattaatcttcactggctaacaggtgctgcataatctaacattgcttttatttttggataaagcattgcattcaaatcatttcattagatttagaagtcttcctggaaatagacgtgaactaccaactctagagctttggaggtgactttacttccagctcttctgctgtcttctcctcccgtccttgatcatctcacttgcctaacaagtgagtcattcacataacatttaagaagaaactcccatttgctactttgtgtcctgtttgatgtcttcttttccttaaggacaagacacaggataaaagataagtattacacgaacatgtcttcatcatgcctggccttttccaatcagtattccaaatatatacatgcatataatgcactctgttcatttcaaatgagatctaattaaatgctattttataccaaatatcaaaaatccaattagctattcaagtagactccagaattttttctgtttggccattcttactgaatatttcaagatttattgagtcaaaattttatactatttaaactgaggctacagagtttcagaatgagttttagagaaactaattccaggtgtattcttactgatcctatgatatctttctgtgagaaatataggacaaatacttctcttctgacttcaaaaaatgaagaaatagggattatgtcaatagcccacttctctttggagcaatgaaaatgttctaaatcttggctgttcaatatggtagcactagcgacatgtgattattgaacacttgaaatgtgattagtgcactgagaacctgaattttaaatttaatttaattaacttaaggttacatagtcgcatgtagctaatgattagtgtatatcacagcacagctttatatgctcaaagtgatggataaatgggcttctggatttgtaaaagaagagagtcaagaagggactgttagccaagcgcagtggctcatgcttgtaattccagcacattgggaggctgaggtggaagaattgcttgaggccaagagtttgagaccagcctggacaacatagtgagattccatcgctacaagaaaaaaaaaagattgattgttaattctggttctctcctcatttctcattcaggtgaggggacaattcacaagcagacacttgtttctaataggatgtcctgactatgtgagacattccatgccctaaaactacacatcacctcatcggaaacactgaaagacagacttctgccaaaataatttgctaagcttgtttaaacagacaggctgggtttcttctctctcataagactcagatatagaaatgtttaaagggttccgaatcataccaataatatgagcacgtattatggctgagtgtttgtggaaatattgcacatccacccaactcatcacctgttaagtcacatctttgtttaattttcaaaaatgaaatgattcatagtcatttcattcatgggaattggtgccagtttatttctgggagttcaattgccagcttctggaattgagacacaaatatcttaatataaacaggctatatgcaggagctttcaatcttctttccccttggaaaagcaccagtaatttcatatttggtctaataaatcagtttccggaagaatgtttgctgacgtcattttttatatccctcatggattttatatggaaaaacagcctggtcatgttcaaagcaatagattagttctggtagtgtctttcggcctgtgggagccctcattcctctgcaatcacggtttgggagtggttctatatcctgatacaagagaaatgcttttgtgaaaggcagctttggaggtatgttgagcagagaagctggaaactgatctccttaaaacattgatttcatcatgtctgtgtttaagttgtggctgcagtttgctattttcggagacaaggccaatgtcagcctgtattcaaagctctctgtagtaaagcaatttatacttactaggtgaaccacactgcaaaggcccttctacctcacatttaaaattttatctatgtgaattttgatgaagattaacagtaaaggaaggcttgaagccaaagagatgagaagattccaccaaaaaaaaaaaaaaaaaaaaaagcaacatgcagcataaacatacttaaaaagaagagaggttttctgtctggagcccacactgctgtgattgtatgtttaggagaacagggtgattttcattcatcctgtagctgttttccatgctccaattctagtaattcataatacacctattaagcacctactgtgtgcatagaactgggctcagtggtacaagagaatctgttttcagcctcattggctattttaagccatgcattttaaatgaatctttatttaaaacaatttcaaacacaggaagattgagagactaatacaatgatcctttatgtagtcatcacccagctttaacaattagcaagcattcatcatgtttgcatcacttattcttttctgttgtagttattgttgctaaatatttttaagcaaatcccacatttgatgtgacttcccaacacatttgtgcatatctctaaaaaatattagcattttctcccataactacagtgccatgatcacacccaagaaaattgagaatatttccctgtaccctccaataaccagtccatattcaaattttcctacttattaaaaaaatgcctttttaaaaattagttcgttcaaatcaggaactaaacaaggcctaacattacattacattaacatagccattaccataactgtaaacattacattaatccaatccaaattttcttttatatataatatacttttatataaaaatatttttattatatttatagaataaacacacacaaacacacatatatttgacatgttgaagaaatttggtcagttgtcctgcagtccctgcactccaaaattctaaatttttctgtttacttctttgtggcatcatttatcttaatcctttatccctccattttcttttctcatttttttttcttttctgagatagagtcttgctctgttgcccaggctggagtgcaatggcgtgatctcagctcactgcagcctccacctcccaggctcaagtgattctcatgtctcagcctcccaagtagctgggattacaggcatgagccaccatgcccagctaatttttatatttttagtagagacagggtttcaccatgttggctaggctgctcttgaactcctggcccaagtgatcagcctggcttggcctcccaaagttctgggattatagacatgagtcactactcctggaccctccattttcaataaacttgaaagtttatgttcaatttttcttttggcaagcatgcagtacttcaaaagcggtgctatgtgctgcacattgtatcacatcaggaggcacacaatgttgttcataccactctctaagcatcctccatcttcccctacgaagtttaagagaaccttggggaaatcatttaaccttgcagagcctcagctttctcatagagacaatggggataatagtagtacacccttgcaaagtttagtgtaaagattacactatgtaatctttgtaaagaccataacatggtgcatagtacactgaaaaatataagagaccttaacttattatgaataaggcatgcaaagtagttagtacagtacactggtctaggagagtgttaataatgttagctattattgcctttataaattattttggctgaacaggccaggtaaatttcattgagtagacagtatttgaaggatgaaatgaaaaggcatagaccgcaacacactaagcctcagagaaacctctctgataagtttctttgtaggactagattataaacttcaagatggcaggaatgtattaattatttatccataatatgtagttcaatgcatggccctcaataatatatgagtaaaaaatcctacacaaactcaactttagactggctggtgtcttattgtgaagtcccctgcccccatccctatgatacccacataacatccccttattcccagctctggacacttgcctctgccatttccactgcttagaagacctaggcccagccaggcacagtggctcatgcctgtagtcccagcactttgggaggccaaggagggcagatcacctgatgtcaggagttcaagagcaccctggccaacgtggtgaaaccccatctctactaaaaatacgaaaattagccaggcgtagttgcgggcgcctgtaatcccagctacttgggaggcgaggcaggagaatcacttgaacccgggaggcagaggttgcagtgagccaagattgtgccattgcactccagcctgggcagcaagagtgaaactgtctcaaaaaaaaaaagaaaaaaaaaaaaaaaagacctaagccctctgattctaccaatgtaagttggaccagttcttccatgtctttctcttacctgtgtcctttgggaggacttttctgagactgttccaccctatatcccactttttcttttctcaatacctacatcatactctttgttcacaaagtttgatgcttatactttacagatttgtaggttgtcttgctttctaataactccctacacttccatcttatttcctctaaataaattgtaaactctttaatgggtgatgtgttagtcagtttttgctttgttacaaagagatatctgaagctgtgtgctttatgaaggaaagaggtttaattggctcacggttctgcagactgtacatgaagcatggtgccggtttctgcttctggaaagggcttcaggaagcttacagtcatgatgagggggaaggggagccaacatgtcacatggtgagagggagtaagagagaggagggggaggttccacacccttttaagtaaccagatcttgtgtaaactaacagaacgagaactcactcatcaccaaggggatgacactaagccattcatgaaggatccactcccctcatccaatacctttcactaggccccacctctaacactggggattacatttcaatgtgaggtttagaggagacaaacatcccaaccatatcagctgagttggtgttttctgcctttccatcttctattctcctcttacccaatactcattcccaaccgaaacacctggcacaggagtagacacagtagaacttcatataagtactacctgctaatttagcatctccttattacacctttttcaatgtacttgggaactcaaggacatggtcatcaatacactgcctggatgagagtggcatatccctactaccactgcattatgattgtctgcttatgtgcctgtgtccctatcaaactgatagagtcctggaaacagagattatggatttttacttctgttgccctaggaacttgcacagggattggcacatcacagataatcaatcaatgatgaatttaagaaattgtgggccaaccaatttgatgaaattcacttttgcctaaaaaaaaaatttgactgactatttagactagttcagtcaacaaagtaagatgtttcaaccatttacacatatgggcccagccctcatgagaatatgaaacatatttttaggagtcagataaaattagaactaaaattgaaatggaagaaaaatattaaagacggccattgactactaatggctttattgttctactcaggagcatcatggagctttcaaggttttaaacttaaagaaaaactcttaacagtagaatttaaagcaggagagagagctagcttgaggcctcttggtactgcttaattcacactcaagagatatctctcttctctcttctggaagctatactattgttcctccttccccacccagcgaccaaaaaacaaagcagcttcaagtcctggaaagtacagaagaaaaatcttctctgctcatgttgtaggtgtgtttcttccactacttggggtggaattcatcaaccaggttggggcatgtccaggctgtgttccacacatcttctcctgaatcctcagcccaagcagaaatcagacacctccatgctgtcctttaagagaaaagctggcatttcagtgttttaaacattggcatattctggttcaatggcccagctagatgtaaggaaggtgtgttacccaatttttttcatgctttgaaccaaaaagatgttcttccttatgttttactccacctgaccattgcctggcttgaagaaaaaaagagaacacttttcaggagctgagaaaattggcattgatttaacataatttagttaaaagttagttctcccctgccatgagccacagctgattatttagagaattattaccattcattgttcattgagttttatctttctaaattttcactgattagcatgatttgttactaggaaaaatattatgattttaattgcattttggcatcttaaaagaatgtttcacactgcttaacatctgcagtcaacagatgtttaaacacaactccctcaatgactaaaatttggcaaaatgtataatagttggaacagcttaaaattctaaatatacttctaggaacatgatacaggcagatgaaatactacttgtgtgtgttttatattaaatattaaaatattacatataccatccctctcggagatgacaggtttcagggaaaaaaacaacagccaagagatgtttcaaccctaccataccagatatattctatctataagcagggctatgtcttatggtcactgtcaactgcagtggggacccttttttaagtgctatttattgtggttaactctagaggctggcagaggcaaagctgtgagacagacacgtttgtcccttttgcttccccttttggcatccttcttttctctgactcagatcctcaggagctttcatgaagatatattctaagattaatatgtcagacttgagtttaagttaattggtcagccttcagttaattggggcaaagattcattcatatcagagtgtgtgtgtgtgcgtgtgtgtgtgtgtgtgtgtgtgtgtgtgcacgtgtgtgagtgtggtgtctgtctgctgtctgtttctcaaggcaggggttcagagaggagagaggatgacccaattagcatttcatcaactatttgaccaaccatttaagccgttatgtttagcatggcttaaagaaatccagagaaaaatcatgaatttcatttcgatcacaacttttaacagtctgctcctatgggcactttatgacagttgatgactcggggcttagcagagagttgcttcctgtccccttgttgaactcatccccaatgaaaacgccatttctacatcaagaatcctagaggctgtagcagcaagaatgagaaatccacattttctgtccctggatggttaagttcacagtcacaggaactgtgcagatataaagactttcaatcaatgtatctctgcctaagcttatgaggtcattctgttctctgttactgatttaagtcagtaaattttgagtacagccgattacttaatatattatgggtgggtctactccaatcaattgaaggccttaggagcaaagactaaggtttcctgaagaaaaaagaaattggcctcaaaactgcagcatagaaaccctactagaatttccagcctggcctgacctgcagattgtggactcaacactgactgaaacatcaactcatctgaattttcagaccaccagcttgccctacagattttggactggctggcccccacaactgaataagccaattccctaaaatctcctctctctctcctctccctctcgactagtacacatgtgtatatgtaacatctggattcagagaaagtgactatagccaggaggaagtagaatcatggagagataaataggactaggctatgagaagtgcaatgcaggtggtccatcaggaaggggaagcagcttgtacaaagaccaggagatgggggtctgtgcttttgagggggagaatggagggagagagcctgagagtctgagtctggagactgtgttagagagcagtgagtactaagactggatggattggtaggacccaagaactgatgtgtagaaaagagcctcttcttttttttccacgcagggggcttagaattattgcattttttaaacactgagtcatcttttctgtagtactctacaacagagtccacttcagactgtgcagctgtccccagctatcaccatatcctctgtctttcatatctatcctaaaaggcatttgctcttcctaaaagggatgccctccaaagaaattttaaaagaatcttatcaaggggccctggagaagaaagggatgtgagggtcaagtcacaactttgaggggaaatagaaagagggctcctttctgagaaagaagaatttcaaagagtccaagagaaccaaaaattcaggacccaggagggtaagcattcctgtttttgcaagcttcacagaccatttgagtgagtgggtttttcaggtgacatttaaatgaacaaataatatccatgtctcagggtcagaaatggtactttgcaactgattctgtccctcttgagaggcttctgcaagactgagagggtgggatgacttaatgaacattaaaaacaatgttattaggctggatatggtggcacatgcctgtaattctagcactttgggaggctgaggtgggcaggcccaggagttcaagaccagtctgggcaacatggtgagaccctgtatctaataaaaatacaaaaatttagccaggcatggtggcacacacctggagtcccagctactcaggagactgaggtgggaagatcacctgagctcaggaagtcgaggctgcagtgagccaagattgcactactgcactctagcctacatggataggagtgagacctgtttgaaaaacaaaaaacaatcaaaaacaaaaaaaaacaacccacacaatgttatttttaaaatactgaggggagagaagttggggaaaaaaagggaaaacctaaaactctccataatcctaccatcagaaaattacactaatgtgataagtgactttctcccctctgaatctccaattccattacttgtagtaaatatgaatcttattccacaaactcagacatgcaaaaaaaaaataccactttactttttacataaaattaattctaagcctatagcaactctctttatcatattaggtaattaggaatttggtctcagatattattgtcaccctcagggatggacaagggtctcagggttttgtgtagcaccaaaccctaataagatctcttcagccattgaacttactctacaatattaactgctgaggtgtccatggtctcagactacaaggtgtcttccggttctggcttctctgctgccgcttttcaaatcaggagaatctttggtgaggctttggaattcccagctccctagcccagcctccctagggtcttcctcctcatcagagtgctccagaattcagactaggattccattcacactccaaacaccttcccttctctctccagttcctccaggacaccaagcataatctcctcaatgggtttaggttttacaaaattcagtaccagaatcggaagtgtcttgcagacaactttggcttctggccctatgacaaacatctcccttgtggcaggaggccacaaaaagccctgaccatctgcttacaagggaggaggggaagaaacactgggaggacaaacacaagttaatattccaaaaattataccactacaaactgttgaccgttttctaagtctctttccagaatgttcttgtgcttataaagcaaaaatctctctacacataagcttttcttttttaagcaaaaaggggattgtactatatatatgcagttacagcttgctttttttttcacatagtatagtgtggacactatactatgtgaaataataaggacacttcctagagtgtccttattttatttgtgacattgggtactgctccactgatgggtactcaggtggtttctattgttttgctctttcacacagtgctgtattgtgcacgtacttgtacgtctctgtgttctttttctatcatcactttctagaagtgaactgactaggttgaccaagtggctagtgaatcaatacagaagtttatttgcaaacaggagcatagttatctgtttctctgcactgcgagccccggccaactctggtgggttggttagcatatgctggttttagagaaagagcctgaaaatgcatttctcaagatcgtagtcttcatgcatttgataaagttggtggagttggtgcaaagattattctaaaagtctctctaattagccttggtgaataggactctcattattagtgtataggaaacaataatctgggctttacaactaactagctaagagaccctggacaaaccatgtccacctcgaggtctcaggtagatcatgtaaaatggagatgggacacagataatctcctaaagacttcctgaagtgatatcatacatattgttatacatactctgcattcctaaacatacactgtcctgggcaggtaacaagtatctgtctgtggattgatgacagactttgggctatattgactttgctatgcctcttcagtttcctactttatatttttggaacggtataatacatttgtgttagcttgtgttcctccaaaagctgacccagggacaagggttcaagtttaagaggtttatatttggaaagtgcaggaaagatcaggaagggaggtggctgatataaggtatgttatcaagccagctgtcaccgggcttaatcccaaagggcaatgctgagaaacagcgttaaaacccatgcttcagagttatctgcctttagatcaagggtgctcgggtgtttatacatgaaatcccatcagcacaccgtaatgtgctaatgtgctaattaccagcacatctagcctgccatgcaaaggctgaacagcctgccttggtttaaggaaaagccttcaggtcaagagtgcaaaaagagttttctggaacacagctaagggatgcgggcatggccacagtgtctactgtgtaactctcacagttcccctcacaccagtgttgctttactcttttgtgtctttgctcatgttgtattcactcctttccctttctgatcaatttcaaatcctcagacttcctatgtttgtgtcctgcctctgctacttcctagctgagtgactttgggcatgttacttaagctctctgtgcctcagtttcctcatctggaaataggcatagtgataattctcatctcattaaacagttgttaggatcaaatggtaatggtggaaagcacttatggcagtgcctaccacttaataagtcttcagtaaatgtcatcatatttattatccttcaatagctacttcaagtggtagtgccttgaagaaagcatccctgagacttcaggcagggttaagggctcaggccccttcttaacacattatgatgacactttccatatgcaagtttatcttctcctatggacagtgagtccaggaaggcgtcactgtggcttactcaggtctgcgtcctctgcaattcttgcaggacctaacctgccattctgttaatgagtaatagacagagactttgctttcattcactcataaataaacctttgctttaagattgaccctgagtaaaacgtaaatttcatcaaactgtagtaacaatacactttctttatcctaacacatacattgccaacactgctcccttaaaacacacacacacacacacacacacacacacacacacgcacacacaaaaccactgcttagtatttctgaaatcaggttgtcagtctaaatactgagatttgtttttcattttatctgcctttctttcacaaagtaggctattattaaataaatgctagactctagtattaaaattgacaaatgtatggtttagacctcaaagtgaaggataacttggaaatagttctcggttgctcttcaagaagaaaacaggttcctggggtgcctcgccatgtggtggatctcacactcccgtcattctgctaacacaatcccaggagctgattctgttgcgtctcgcagggtatcagtctcatccagatcaagtatgagcagggcagactggtaggtcctaggagtgggaagggacagaagaactaatttgatgccatgttggaaggtcaagacagagatgccaaatcagatgtcaggatggaggagccaacaaaatgggcaataggggacacagttgaggaatggagtgacagtagcaagagagtgagaagtaggaactcagcagagatgcacacccagccaagaagttaccctgcattaaatgacagtgagctggcctggaatggacaccccaaaaccaagatccatggcagaggggacactggcagtacagggtctggccctggacatcaggtgggtgaaactgttggggatggaggagaagaaggcattgatgatgaaccatgagtgttgggagggtttagtcagatattaaacattgcctcatttaattttgcttgaaaagaaaaataactctggttagaatattttagaatgcaggcttgctagtatcactaaaccagaaaaaaaaattgtcaaaaatatatataaaaaagaaaaacaagagcaaatccagatttgaatccagtctacttgagttaacagctggatgaatttgggcaaacaatttggacaagcgagttctctgcatttaacttttcatcatgaaatacacataatattcctgggctgttgtgaggaattattaagataagaagataatgacagcaatggtctactgaatacttaatatttgcaggcacagtaccaagggttttcccatacttggtcttattttctaaaattagcctacaaggtaagtaccatagattcttattttatagctgcaaattgagtttcagtgtgattaagtaacttgtgccatgtctcgctaaagaatatatataaatcatcacacatagaatacagtaggtgtttaacacatgtgagttttctcctttcactctgcttgcaatgctagccatagaagattttaaaattgtctgatttttgaagaaaaaacccttggaagagcactccctctctgctggactagagtttaactatcatcatgttctttgtgaatttgatagccttttaatccaccgaggccatgaccttcttgtaatgtgttgacttcctctaccgccagtgtttctctcgagggacctccatctgcatttgtttgtggctgtccctctcagtgacatttcctcctttacctgattctcaagataatttgtttttcatttgagcttcagcagcctgagagatgatgtcaaaatcaatcaatcctcctacaagctttgtaaatacaatcccttggctttgcagaaagggtatctctattgcccagttcttcctggagcagtggggccacccaaaggagaatcaggaggttagaacacatcctagaacatgaaatctcatgcatgaggggatgtcagcctcatagcatctgagtcctagtgtgggaagatgggagctgaggaggtgtcatcccctgggacttctgggagctgcaggtggaaccttagagcccttggtccaatgtggataataaggagccctgttagagagccatagaaaccatccctgagtcatgtcttcctttctccttcaatatgaccttctctgggagtcttcttgcggggaggcagcaatgccttggaaagtttgagctggtttctgatgagaggttgaggcagggatctcatggttatctccttcctcaaaatggagccagaagatgcaagccagctgtcatggactgattgaagcctgttatggatttgccttttaatgtgtttgttaaaaatttgaatcaggtgcaacatttaaaatgggagacttcacatgaaactccagatttctggcttcccttgaaaaatcacacctgataatcctgggctagcatttctatgggcaagagtaggctggatctagggaagcctcttcaggtggggcaggtgcagtcctgtgtgccccagtccccacctgaccccatgctcccttaggttacctgtcttgttccctgggcatttgagttttgaaagaaggaacgggaaggaaaataacaatagagttacaagacttacaacctaacacagttaataacaggaaaagtaaaaggcgcttcaggtaactatttcctttacatatcacgcaaaacatccagttttgcagaaagataaattggagaccagagaagtgaattaagctgcttaaagtgttggtaaatggtacaaccaaaatttgaggtttggtctctttgactccaagtcatgtgaccacaaaatcccactttgctacagtggcctcccccagaatctgcttccctttgattaacaggatgccctcacgcttctgcatatccagggcacctgatgccctgtcagatatcaaagagttaatgttataccagtcatcattcttgataccaagaaaattcaagaggagtcttgtttttctctgatgctggctggcatcctctctgctccctgagtctctaatgagaatgtgtacagtggtattcaaatagggtaggagaaacttctttgtgtatcactgaggtcaccatttgcattaagggaaaagaggttcgatgactctcagttcggcaattcagcagccatctgtacttcacatcactggcctgaattttcagcctcattaaattctttcaggtcgtctggtcccaatctttgtggttacccaagtgtatatttatgtctcatgagttattgccatttctcacctgtgcttaactgctcccacctcccactacccttaattgatcttgcagtacttctggtattttttttaaagtcttccctttcccaattatttccaagagcccacaggggttactgcatgtgtatcagacactgtgtcctctgggtttctacatggcttctaccttgttctgtcaaagctccctgtgaactatttttgctgggtaccaccatctcccactggacaccgccgccaagaggtgtttaaggtcatttggggttgcatgcactggtgggtagaatgaatgtttctttctcatggtctgtgtttcacatggctaccaaactgctggtagtgccatgtcttagggagcttagcttggttggtttttgtcacaacatccctctgcctccatacatacctttgcattgctccacaggattcagaggagatgccgtggggaactgggctgagagatataatactgagctagggtttgctccttccctttgatgactaaggctttatttttgcaccaagactatctgcctagtaccctcttcccttaggctgagttttctcccaggtggctctttactcccctgtgcaacccttgctatcttgcctgtattgggcatgactgggtctaagtgatggatatgtcttggtggctcgcagtcaaattggaacccctgaaatctgtttttttgttttctgtttttttgttttgtttgtttttttttttgttttgacaaggtctcactctctcacctactccagagtgaagtggcacactcttggctcactgcagcctcaatctcctgggcccaagtgatcctcccaccttagcttcctgagtagctggcactacagacacatgccaccatgtgtggctcattttgtgtatattttgtagaggtggggttttgccatgttgcccaggctggtcttgaactctgggctcaagcgatccacctgccttggcctcagaaagtgctgagattacagacaggggccaccatacctggccggaacccctgaaatcttaggtggcagtattttatataattttgtgtccttaaagcccaaatcacctgaaatagttttatcatacagcctcaacccagacacagattggcttaagtgttcctctaagtgcttgggtatgcagcttcattgtcttctttcctaaagaaacaagcctgtaactcaaagattttgaaatttggattcttgcttgatgtaagctgagtagcacggttataaggctacagacaccactgcaataggtgggactccttgagccagcttaagccacaaggaggaaatggaagtggaacccaaggaaaggattatggctaggtcttgggaagaagggattgaggcagtgaacttcctcttgttcctgccttcctctgtatctttatgcagactgtctacctttgactcccagttcacaaggtggcatatgaccatcccattcttttcaggtttacatataatagttccagaaatatgcaagacttttctagtcccaatttaaaattcccaagaggaagaacctgattgtttctgtttaggtcagtgttcatctctgattcaatcaactgtgttccattcaccaagtctgtgtctaaggatcaaagatagaccagagaggttacagtgagctgacagccacatacacatccattctacttgaccatttttttttttcccattttctcacatttacttgtacctttctggaaaggcactgagtagaggggcaatactcaagataagcaatgaaagttaaccataatgttttctttcttttcttttcttttcttttttctgtgacagggtctcactctgtcacccaggctggagtgcagtagtgtgatctcagctcactgcaacctctgcttcctgggttcaagtgattcttatgcctcagcctcctgagcatctgggattacaggcgcacacgaccacaccagctaatttctgtatttttaatagaaacggggttttgccatgttggccaggctggtctcgaactgttagcctcaagtgatccccccacatcagcttcccaaagtgctgggattacaagcatgagccactgcactcaaccctaacaaagaatcctagtagctaatgtttactagacatttcgtatgtaacagatactgtattgagtgcatcacaggaattatctcacctattacatacaagaagatcttatcattgattattattattttcatgtgcgtccctgtgaagagaccaccaaacaggctttgtgtgagcaataaagcttttaatcacctgggtgcaggtgggctgagtccgaaaagagagtcagcaaagggagataggggtggggccatttataggatttgggtaggtaagggaaaattacagtcaaaggggggttgttctctggcgggcaggagtggggctcgcaatgtgctcagtgggggtgctttttgagccaggatgagccaggaaaaggactttcacaaggtaatgtcatcacttaaggcaaggaccggccatttacacttcttttgtggtggaatgtcatcagttaaggtggggcagggcatattcacttcttttgtgattcttcagttacttcaggccatctgggcgtatatgtgcaagtcacaggggatgtgatggctgggcttgggctcagaggcctgacattcctgccttcttctattaataagaaaaataaaacaaaatagtattgaagtgttggggcggcaaaaatttttggggggtggtttggagagagaatgggtgatgtttctcagggctacttcaagcaggattaggggcagcgtgggaacctagagtgggagagattaagctgaagggaggtcttgtggtaaggggtgatattgtggggatgttagaagaaacatttgttgtatagaatgattggtgatggcctagatacggttttggatgaattgagaaactaaatggaataacagaaggagaaaaacaggtataaaaggtctaagaattgggacgactcaggatatctgattagagagtgcctaaggagatacagcatagtcctgccagcaaagattatttatttacttcaagagttaacagtggcagtttggggatagcaccaggagatatcagctgtgatggcttggaaaaacagtgtaaactggcagtgtaaacaagagcagggtatgagtagttgagaacggtgaataggagtatgactagacagaagatagtagggatgacaagatttttggggcacagtctaagttggtctggtgtctggaatgagaccggggcctaataaaaaggagcatctatacaggagcttaaatgggctgtaccctgtagcattccgaggacaggcctgaattctgagaagggaaagtggtaaaagtattgtctagtcctttttaagttggtggctgagcttggtgaggtgtgtttttaaaagacctttagtccattctacttttcttgaagacggaggaccgtaagggatataaaggtttcactgaatactaagagcctgaaaaactgcttggctgatttgactaataaaggctcgtctgttatcagactgtatagaggtgggaaggctaaactgaggaattatgtctgacagaacggaagaaatgacctcagtggccttctcagaccctgtaggaaaggcctctacctatccagtgaaagaatctacctagactaagaggtattttagttatctgactcaggccatgttgagtaaagctaatttgccagtcctgggtggggcaaatcctggagcttgatgtgtagggaagggagggggcctgaataatccctgaggagtagtagaatagcagatggaacactgagaagttatttcctcgaggatagatttccacgatggaaaggaaatgagaggttctaagaggcgggctagtggcttgtactatagtataacctgcctttgctggtgtgtggcgattaggcctggtggaactgccgtcaataaatcaagcgtgatcagggtgaggaacaggaaagaaggaaatttggggaaatggggtgaatgtcaggtggatcagagagatagtcatgggggtcaggtgtggtatcaggaataatgtgggaggccggattgaagtctgggccgggaacaacggtaattgtgggagactcaacaaagagtgagtacagctgaaggagccggggagcagaaagtatatgcgtcaggtatggggaagaaaatagattttggaagttatgagaactgtagagagtgagttgagcatagcttgtgattttgagggcctctaaaagtattaaagcagcggcagccgctgcacgcagacatgagggctaggctaaaacagtaaggtcaagttgtttggacagaaaggctacagggtgtggtcctggctcttgtgtaagaattctgaccatgctagccatgcctaggaaggaaaggagttgttgttttgtagaaggtgcttgggtttgagagatcagtcggacacgattggcagggagagcacgtgtgtttttatgagaattatgccgagataggtaacagatgaggaagaaatttgggcttgattgaagtaatgggggctgtctgtgaagctttgcagcagtacagcctaggtaatttgctgagcttgatgggtgtcagggtcagtccaagtgaaagtgaagagaggctgggattaagggtgcaaaggaatagtaaagaaagcatgtttgagatctaggacagaataatgggttgtagagacaggtattgaggataggagagtatatgggtttggcatcacagggtggataggcaaaacaatttggttgataaggcacagatcctgaactaacttgtaaggcttgtctggttttaggacaggtaaaatgggggaattgtaaggagagtttataggctttaaaaggccatgctatagcaggcgagtgataacaggctttaatctttttaaagcgtgctgccggatgggatattggcgttgagtggggtaagggtgattaggttttaatgagatggtaaggggtgcatgatcggtcgccaaggagggagtagaggtatcttatacttgtgggttaaggtggggggatacaagaggaggacgcaaaggaggctttggattgggaagaagggtggcaatgagatatagctgtagtccagggatagtcagggaagcagataatttagttaaagtgtctcagcctaataagggaactgggcaggtggggataactaaaaaggagtgcttaaaagagtattttctaagttggcaccagagttggggagttttaagaggtttagaggcctggccgtcaatacccacaacagttatggaggcaagggaaacaggcccttgaaaagaaggtaatgtggagtgggtagcctccgtattgattaagaaggggacaggcttgccttccactgtgagagttacccgaagctctgcgtctgtgatggtctagggggcttccgaggccatcgggcagtgtcagtcttcagctgcgaagccgagaagatctgggaaggagtcagtcagagagccttgggccagagttccagggcctctgggagtggctgccaggtgagttgaacagtccgattttcagtggggtcccacacagatgggacacggcttaggaggaatcctgggctgcaggcattccttggcctggtggtcagatttctggcacttgtggcaagctcctgggggaggaggttctggaggaacgcctggccgctgagtttcaggcatttggaagttcttgtgtgctggagatgtggctggggtttgtctcacagtggaggcaaggaattgcaacttttttctattattgtacaccttgaaggtgaggttaattaaatcctgttgtggggtttgagggccggaatttaatttttggagttttatttaatgtcaggagcagattgacattattttgagaataagacggccttttgagcttttagggtctagggctgtaaagtgtctcagggttgctgccaaacaagtcatgaactgagctggattattatatttgatgaaaaagagcctaaacgctatctgatttgggataaagaaaaaggagcattaaccttgactatgcctttagctccagccacctttttaagagtaaattgccgggcaggagggggaaggctactcacggaacgaaactgtaagctggaccaggtgtgaggagaggaggtgataaaaagattatagggtggaggagcagaggctgaggaagaattgggacctagctcggcctggcgaggagcagcctggggaggaagggagaggtcagatgggtctgtagaaaaggaagattagaaagactcagcgacgcttggtgttgggactgaggggacaggcgggagggaaagagggaagatttgggacgagttgcactgggcacagagactgggaagggactgatgtgtaaaagaatgcctggatgtcaggcacctcagaccatttgcctattttatgacaagaattatttagatcttgtaggatggaaaaagtcaaagtgccattttctggctatttggaactgctgttgagtttgtattggggtcaggcggcattgcagaagaaaataaggcatttaggttttatgtcaggtgtgagttgaagaggttttaagtttttgagaacacaggccaagggagtagaaggaggaatggagggtggaaggttgcctatagtgaaggaagcaagcctagagaagagagtagagaaacagagggaagaggtttgggggttcttaccttccagaaaagtggaaaaaggggttggggcacagagataaggggttggggcacggaaataagggatggggcacagaaataagggatggggcatggaaataagggatgaggcgtggaaataaggggtaggggcacagaaataaggggtcggggcacagaaataagggattggggtgcagagatacgaggttggggtacttgcccctcctctagaaaagtgggacttgccactaagagtgaaggagaaggggttgaagggtacttgcccctcccccagaaaagcgggacttgccgctaagggtgaaggagaaggggttgaggggtacttgcccctcccccagaaaagcagagaaggggtagagacaaggagagaaggggttggggtacttgcccctttcccagaaaagcgggacctgccgctaagggtgaaggaccaaggcaggcatccctgcatggtctgacacctttgaaacgtgggtgaataatcaggcgtccctgcaatgattaaacaccaagggaaggctgccttcccagtccgtgaccggtgctggagttttggatccacagataaaacgtgtctcctttgtctctcccagaaaatgaaaggaattgaaattaagagaagggagagattgaagagtggaaaggagaaagtggttgagggacagtgagagaggttggagaagagagtaagaagaggccgcttacctgatttaaaattggtgagatgttcgttgggctggtcggtctgaggacctgaggtcgtaggtggatctttctcacggagcaaagaacaggaggacaggggattgatctcccaagggaggacccccgatccgagtcacggcaccaaatttcatgtgtgtccgtgtgaagagaccaccaaacaggctttgtgtgagcaataaagcttttaatcacctgggtgcaggtgggctgagtctgaaaagagagtcagcaaagggagataggggtggggcaatttataggatttgggtaggtaagggaaaattacagtcaaaggggggttgttctctggcaggcaggagtgggggtcgcaaggtgctcagtgggggtgctttttgagccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttacttcaggccatctgggcgtatatgtgcaagtcacaggggatgtgatggcttggcttgggctcagaggcctggcaattattagcctcatttcacatgaggacaccagggttagggggcgggctggaccaagatctatgtggagagcagagttcaacccaaaatgcatgctttttatcactatatttagagatagacacacctggtttcaatccttgaggttgccactagctatgtgatttttgaataatcattctgaatcttagtttccacatctgtaaatgaagataaaaatacctttccaattaaaaatgattttaaactaggcaacttaggcaaattattcttttccttcatgtacctgggctttcccgcctcatctaagcacacttgttctttctaatgctccctgactgtaaccaaaacctccagagcccttcatccatcctctgattgccatgaattgccaacatcagataaatagtttaaaaagtggcaagaaagtaggatttcaagtcagaagacttggatttgaatcttgcttcagctttgtattaattgttatcattctgaatcatagtttccccatctgaaaaataagatgtggagttgttattattggtggtggtctgttctaagcattaaatgaagaaatgcatgtcaaaccttctgaaaactcagacaccaaacacttggaaaggagtctgttacagtctcaccaatgcaccacaatgtagcagtctctccttgtgaggtatcacccaagaccaagagaattaaggagtatggacccaaagggtgaggtcggagtgaaagtttaataagtgaatgaagaaagctctctgttgcagaaaggggacctggaagaggattgctgtttttcacagttgaatgcaaaggcttttataggaaactgatgagggctgggcattttgtttgcataaggcatgtttttctggtagctccaccccatcctcctaaggtgcatgtgggcccttagcttgagttacccatattgctttgttgcccttattatgcatgtgtcaggggatgaaattttccactgctggcatgtctgggcaagtcacctgtgtagcctttcttatctgtgcagctgtgggcatgtcttaggcaagtcccccagtgtaagttcccttatctgtgcctgcaggctgttcttttgtttctaaaaattcaatccagggcccatcctaactgcctgcctgaccggtttctttctttttcctctctcaattcttattaaggcagaaaaattctagaatgactttttgtcctatagccttgttcccagaatgctttggaaatgtaacagccaatttatcaagacaggggaattgcaatagagaaagagtacttaatgcagagcaaagagaaaaaagataaagttcttttaaatatatatagcttggatattcatgtttaattaagcaaattttaaccatagagctcttttgtttaaagaaaatctcttttaaatctcttattaccagactctagtcaggacagccaatatttctggcctttgaattctaccccaggtaaccgcccacatgaaattagtaagttttaattaaggttataacttaaccatggatacaaaaggtgttttaaagagatggtaagcagctttttttttttaaaaacaagatttagaatatccccaaaggtagtacagtgaaaggaaaattcaagacaggaaatcagaagctatctatggggtgaaaaaaaaaaaacctcaataaatggcaaagttccacaaataacaaaccagaaaggaatcattctgtaagccaagaattgaacctgggccaccattgtcaagagataaaaaccttagctactgagctacacagcattgagcagtttctactgctctcccccgaagaagtctacagcagctgatctgaagcttgcaaaggcttttaagtgctcaagataattcttagggctgtgatatgaacccccaaattcctgtcctctggatggtggagaccaggatgaagtacctctacatggtcacaaagttaagctcttaaagacacaaaacaagacagaaatttcatctggtattggtttcagggacccacaacaaagtttataactgaccagcctgccgggttggcttgaaaagcaggattacaggggtcctaaactcatgttctatcctgtgacacccttctctccattacggaaggacaaattcttagtacaaagtgcaccagatttgccacagcctaagactagtctcacaaatccttttttactattcatcaaacctttgcagagacacacagtgacatttattgcttaccactgcccccctccaacacacacacacacacactcacacagacacacaatgcagagagacagagagaaagagagagagagaggccagacacttttctggtaagaattcttgccctttgtgccagcatatcaggtttctgggtcccctttctctgcagcttctagaagaatggagcagcatttgatggccctgttcaccgtgccatagacgtgaggggaccaagccccattacaaaagaaaatgatccttttctgttttatggaaccataggcaaaagcttctcaatgttgcaagatgctgcctgatgggctacatggggaaccaaattaacattttccattccagtggaagcaaaatacacataacgctacagacattggtcaccttgttcagcacccaacatcgacctggcaagactcgaactttttcccgttggtccctgttgtctttgatctacacaaagtggggaatggtgacctccatctgggaattcaatgggtgatctctgggcaagatgaagagcagtcacaaacccgatccagggctgttaaacttctttcaggactcactgaatgtgaccagatagataaggagagttctctgagttaggcctgctagacttccatcagcaattccttcagagatctcctccacatatacaaatacacacatatagacaagacagacagaaggctttccaaatcaagattcctaaccaagaattccagagtatctcttccaaactatcctcctattctctgtttgagaaatctccctgaaatcttcttgattgaggagaagtctcccgaaccaagactctttttactagttaggcagagccaaccgagaccccccaggagccaaaccaagacagacaccccatgttgtagctacagacacctcacaatggagctacagaactagttgcgaaaaggaaggagacattggcagcacctaggatactcaccaacccagacaccctacaatggggctatagacagacaccctgtgatagggctacagttatgggacgtctccccaggactgtttctctattaaatccatgcccattgggtcgggagtgccctgtcagtagagagagtaccagagtcaactcccagtccaagtgaactaggtggctgcttgggctggcccctggatccattgctggagggggctactgaaccacgggcaggtagccacaagggcaatcctggatgagcctcgaaatttgtaaccacccaatggattcaccttgcccactgcttagacagagctgatttattaagacaggggaattgcaatagagaaagagtaattcagccagagccagctgtgcaggagactggagttttattattactcaaatcagtctccccaaaaactcggggatcagagttttcaaggataatttggtgggtagggggccagtgaatcaggagtgctgattggttggctcagggatgaaataacagggagtcaaagctcttctcttatgctgagtcagttcctgggtggagaccacagaactggttggcaggtccaggtggggccgtccagttggtagaaatacagaaacctgaaaagacatctcaaaaggctgatgttacctttaagagtaactggggaagttgcaaatcttatgacctccggaataatggctggtaatatctagaattccagcccctctcattctaacttggtggctggtggcctttccttcattttataagaacagtttagttttggggaagggctattatttaaactataaactaaattccttcccaaggttagttcagcctacgcccaggaatggacaaggacagtttagaggttggaagcaagatggagttggttatgtctgatatctttcactgtcataatttccttagttatcattttgcaaaagcggtttcgggaaggccattgtttgcacagtattttcatactcttaatttgtagctgcatatgtttgcatgtcttactttttaagtggcaggagttttgagtctagggtgtgtctttcaagtttctttacagaacttagaaataatggatgtttaataaacgctagatgtacagataacattcaagctttctatgcatctgtctttcatgtttttgttgggatgtttttcaacagtctggagacctcttaacaatggagtgaaaggctttgaaaaatctctaaaagcctgtataaatgcaaaagtattttaaatttacaggaggtgctgttactactaatactgtgcaaatttatgagtagttgtggaaataataactctatgagcaaaaatgcttctatttctgttttgttctttgcattgtgcaaatatagcctatataaatcaaatttctacatttctgcatcctgtgtgccttaagacatatgttgagatatcaaaagaagaaaaaaacatataacaacctggaatcacaaaaggctgaagcttaaagatcattatgttcagccctgccattgtacagacgaggagactacgtctaacggacacaaaatgactggcctaaggtcacacagcaaaatagtaatcttttttctgtcattattcgttctctgaaatatgtgggtgtgtttagtattgttgacatttccttggaaaaagaacaatttttaaaatgaaatcttttctttccagggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccaggtgagtttcttcgagtcacttcaaataattatttcttgagcatctacttcatgccaatggtgtgctagattctataagaaaataaatgtgaattactcacagataaaaataaataacaatcaggctgcgtacagtggctcatgcctgtaatcccagcactttgagaggccgagtggggtgtatcactggaggtcgggagttcaagaccagcttgaccaacatggtgaaaccccatcgctactgaaaatgcaaaaattaagtgggcatggtggcacacacttgcaatcccagctactcaggaggctaaggcatgagaaacgcttgaatccgggaggcagaggttgcaatgagccaagatcgcaccattgcactccagcctgggcaacagagtgagactccatctcaataaatgaataaataaataacaatcaagagaatagaatcaatatagcccagtggacaagaccatggattatggagccagactagctacttactagcagaatgattaattttgagcaagacccttaagctctttgggagtcaggttcttcatgtataaagtgtggcttacttaatagtttctgtgaagttgtgaatttaacaaatatcaacctccttgccaaagctaactaatttgctaatcactgattttgcaaagcgtgttgtggagatgtggctggacaggtttgccatcagagtcgatataccgttgtattaaaaacaagataaaaaagctgccaagttctttcgtgagtggttggttagtctgaaatctttgcaagatgctgatgctcaagctgttgacctactcattgcctactttaacaactgtcagagaaacatgatgtggggtaaggaggtgctttttaaaaatcattcatagacttctgtaaaatgcaagataaagttattttaacagtggaaaaaaaacaaatatcaggtgctttcagggtccaacatataataagtgctatagttaacagttattttacatttattatctccctgggtctcaccctaagcctatgaagtaggtagcattcaccttttatagaggagtaaactgaagttaagaggtcaagtagcctgcttaggtcaccctgcaaccagcaacagagccaaaagtcaagcccaggtctgtctgacagccaggcctggcctcataaacactgttctgtgtgctgtcctcagacacaaaccttgctctccagaaagtcatattctagaagccttattgcagggctgaaaacactaagtgccactagagagatagaaataatgtggatggggatttcacaacagggcctgtgggaaattgtttccagcttagaaaatcagagggagttttaaggaagaaatggaatttgagtcttgaatgatttatttgtgcagaagcaggagtgagaaaggacaaacaaaaaaccagggatgagaggggtgaggtatagtttggaaacaggcaatagatggttcaataaaagtggaccctgggatatgtgcaggagagcagggaaaggtgaggcctgcaaccctccctaggtgaagtcagatcacaaggggcctcaagtaccaagctaaagagtgtgcatctaaaattgaaggtccttaaatagctttttaaaagacaaatgggcgaaaagaccaaatgggaaaaaggaaaaaataagacctaagactttgagacatggtgattatttgtcagtaagaattggcggaatatgggcttattaacctagttagttctcttctgaaaaagccacataggttttacagaaaaaaaagttgattttgcaaacaacatacttgttcatttgaagagttgaagcattttttctgaaatgtgatataatttttatatttaagttaaaatgcaattataggtatttttccttgattggataaaatagatccagaatttaaattttatttgtgaattgttcccctccttccctccccctctcccttccttccgtccgcttgcatttgtgtttggttcactcctctctcttagacaaaaggtattttctcatttcttaatcccaatttctccttcatgttttgagtgctgttttatgtttcaatttcatatttattgtaatatgaaccctcagccactaggacatccaacatccctagaatggcagagttgaaatgaacagtagagatgatctattctaacattcatcttacagctgagacaatgaaggctcagagaaagaacatgactttttcaaaaacacagagtgagttcaaggcagaagtgggacttggacttgttttctggctcctttctagtgctcatttcagtgcatcatctgagcacatgtgtaggcagggctctgggcctttaccttcttgagaatggtttagggagtctcaatagacttctcatgtactgctgcaggacttagaatctatgaagtatttagagctggagggaaccttaagatcctcaaattctgcatcgtcctggctatggtctaaatggtccctccaaaattcatgtgttgaaaagaattccccgtgcaacagtgttgggaggtggggcctttttgggagatgtttaggtaaacagattaatgccactataaaagggcttgatgagagtttggcccattttcactctcccatcccttcttcgatgtgagaacacagtgtcctcccatctgaaaaatgcagcatcaaggtgccatcttgtaaacagagagcagccctcaccagacagctgaacctgctggtgccatgatcttggacctcccagcctccagaacagtcagaaataaatttccattctttataaattacccagtctcagcaattctgttaaaacaatacaaatgggtgaagaaactccttttgcagaggagaagaccaaagctgaaagaagtgaggggagacctgcttagcttatgtggctagagacgtacagagcaaggtcagggatttcaatctgctgactcgaggcccatgttttcactctgtacatgctcatccttattttcaaagtctccagttcaaaaattcatctctttgcagtcacatatactgaagggaattctgcttcacaatgcctggaggagcttcaagtggaatgtgtccaaaccaggaggaaacaattcccttggttctcctctggatgtcagtgcaggttggtgtgcagtgaaggtaggggtgtggaaagctggccaattccactttacaagttctttattctctcatacccgggaagtaccacagctactgaattcttggtgaaaccagaacctaaaacagtaaaagtggagttgggaacctggggaagcaatactcaaccaagccaaaactaagattgcatatttacatagaatggctgtagccatgttgttcttcacactcacaaagtgaacacacagctcaaggctcagtggccagactatgtggtgggggtgggatgtggcaagatgtgcatgcatgtgaaagaacagtgtaaactctaaaacatctacaacagggaaaagcaaaaagaaatccgtatttctccctctgattatcttggtctctctcttctgtcatggattagacccagagaagaatactagtccaaatctccagcaactgttcatcatttttaacctttcctgcctggtaaaataacctgggagctttgaaaataatattgatgcctgagcttcactcccagagattctgatttacctgatgcagggatgcaggatggggtctacaattcataatttttttaaaactccccagatgcctaatgtgcaactagggtggagaattactcaattaaactatcaagttgctttccctgactgctgggatcccttccttggctgctgcaaacaatgttgtagccacttagggctaaatacacttataatgtggccttacactgcattcattcaatttaatagacacttgttgactgctttccggtacatggctaggtgaactgcagtgggtacacaggtgaatgaaaatgtccactgctctagaagagtttatacaaataactgcagcttagtaagggagcaattattttacccaagaaaatgctaaaggcttcatgcaattgaacctttaacatatagaaacattttttatattcatagaaaattcatttgttaagagaaacctgcctaatcgaaaatttgctttgataagtctaccatggtatacaaacaagccgtggactagtgcctaggtttgaaaagtgaaagcttctctgcataatagagtgagagcaggtgatcagcactaaatgctgtgtagggaaatggtcaaaaggacacttaatgacttttagagatgggatctcaatctgtcacccaggctggagtgtaatggcatgatcttagctcactgcagcctcaaactcgtgggctcaagtgaccctctcgcttcagcctcctgagtaactgggactacaggcacatgccaccacacccagctatatatatatatttttaatttttttgtagagacagggtctcgctatgttgcccaggctgttctcaaacttcaggtctcaagcaatcattttgcttcagcctgccaacgtgttgagattacaggcctgagcctccatgcccagccataaggccatttttaataagaactgttaaaaataaaatgtcaattatggaatgtaaacttcattttcacatttattaagaagtcttccataaaatacacattgctcattattcagtgagagtgaattgtgtatgaaaaattcgaagaagtgctaaatcccaccttgagatggcagaagaaaaccagagggtatacatggggcaactgcctgatgtgtgggtttgctagattttacaattaaaattgcaggacacccagtgaaatttgaatttaaattaatacaaatcattttttactataaatatgttccatagagtatttgcacacacttatattaaacaattattcatttggtttgatgttttttctggcagccctattatgggttatggttgggtagggattttataatcagagagggagacagggaatggacaaagatgcagaggaggtagagtgtaaggtacatttagggaatagggagaagtagggttggagtgcactgtcaagtgtgttggaagttgtctggacattaaagtaggaaaataaagctacatcctataaggccataatgccaatatcaccaatttgttactctgtcagcaatggatagccctttgatatattaaagggagggaaatcatatgctctattcatccattcatctatccatccatccatccatccatccacattaatgtatctgtatcaatatggcacacttgaaaagcatatgtcctctgaatttatattctagttctgctatatgctcactgagtgatcttctgcaaattactgcctctctcagcctcagttacctgaaaaataggcataattagatctacatcttacatctctcatcaggtttatcacagtgacatacaattgccaagcaggcaagtccaccttgaatgcctttttgactcgtttgagggttccaatactgtgtgtgccaacttagaccattatttcccagaaacattcctcttagtctatcgatttcattcccttgcaatgcactggcctttacacctgcatagtcaacagtgattaaagacagcatttctgtctctcctgccacatcggtacatttgtgtataggtaggtgttgctatttgtgtaacgtattacgaagtgttttcatgttcattattgtcattgaaccttcagagagatcattctgctatcatgggaggatgttggaagtgggttggggtagagagattgggggtagagagatgggttggaaggctgctgtgatagcccaggcgagatgcaatgaagacctgaaccagagtagtggaaaggtgagctgaaagtgaaaggaatggatgaaaacaaacggcacagaaataaaaacaaagggaagttctgacacccgcgttttggtctccttgacattgcttccatttcctctagggacatgtcctggataagggtgaaactggatgctccttggcagtttcagatgtcaccacccctaactttccattggataaaagaaggcccaaaatagcctctggtcccataggctagtgattactgggactcagattcctgtcctgaaaacacggggaagaagccaggcatttgcccacttaccctctcaccagctgacccagggcattagcaccctggtgcctgctgacgcagagcatctgccaaattcgattagccccgtggcctggctaagctgggcatgtcctgcactgcttctaaaacaagccctccaggaaggggctgcgagactcggagatgttttttcctactgtcaagcaggaatcactgcttggcagtttgaggtagggatggggaggagataaaaatattagaagatgcagaagataaaaccaaatactaatctaacagtcacttctgaaaacagagaaaacactccaaacagtcaacatggattgtttttttttctctttgcttcaacttagtaaagccctttggagtccagcagaatgagccaagcagtgtgaaatgtgtggaaacatgttgttggctcagagcaggttgcttggaggcgggacaggtgacgacctgcctgtgagaagcccatagagctctcttctcctcaccactgggtcagttgatcctcatctgtagatgagagatcctcatctgtagactcagccctcctgcagccattagtgcctctcctgtttctaatcacagggaatctaaagaaatttaaggagcctcgttcaggagctcagtgttagattgagctttctggtgggtccattctgactctgaatgttgattttactatctaaaatcattattcttgtttctatggctagggtcctacttgtattcaatttcctatagaactagcgtcctgtcttgttaattcccagtcattagaatcccacacccaagtttgggaccaggttagggctctgagtcccatgggcagaaatctctgatacctctgactcctgtttacctagaggaagaagaatctggagcagcagttctaccctggctggtcaacaaaaccactggaaagatctttaagaaatacagatgccgggcgcggtggctcacgcctgtaatcccagcactttgggaggccgaggtgggtggatcatgaggtcaggagatcgagaccatcctggctaacaaggtgaaacaccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaatacagatgcctgggccccacccccagagattctgatttacctcgtctgggtatagatatattttttaaattccctatgtgattcaaatgtacaggtcaggattgagagccaccagtctggtggttaaaattcgagaccttgggattatatagatgtggcttcaaatctgactatatcatttattaactgtatgaccttgggcaagttatttaggctactgtgttgtcagttttcttgtctctcaaattacatctatctcatgattattttagatagcatggaaagcatttagcatggcatctggtacaaaatagggatgtaacagtattgcctattgccaaacacttgtccttgtgttcaaccaattgctagggtaatcttaccctttacttgatttacatatgattctttgcatatggatcgtctgtctgaaacccatcgatagaactctttatactcattatagaacattcttcaccctttcgcatctaacttctgctgaactcaagggacacatcagtcctcagcaccttgactttactacctgatctaccccatcaccaatgggatctgttcttaagaaagtgggaaagccaagatagcaaactgagttcatcttttggttcaattcaattcagttggcagtggagcatgaccttgacatgacttgtgaggctgaggtgcagcaaagacttacaagtgatgtcagccatacatggaagaatgggggagagaaggctggcgctggtggccagggctattgcagacccagcaggcctgagtcattatcctttctcttctccaccaatcccaaacacaaaataactgtaaagtattgacctagggaggattgggcactcctgggtcttgcaagtggttccacaacactctgcctatctgcccaatcccagcaattcacaggaagctcatcagattgtccatgaggttaaaggggtgacaactgccccatatccaagtattggaaatagctgacatgaagctctagaaaccctacattcaggtttttcagcacagagtagggttgtatccacttttggaaaggcctccatgcaatgaaagactgtttgcatgttaaccttaaaagatcaatccaggactcttctgaaagctaaaaattctaagcaccactggtggtctccctttttgaaggaagccaaatcccttggacatgtaactagctattccacccccctccccacaaccacggccttttttttttttttccttctgtatgttctcaatgccctttgcacttttaaatttttcagtggtttaagagtggctccagatccaggctgccctgctactcacaagtgttgcagcctttgccaacttaattgaattctctgtgccttagtttttttcatctctaaaatgggagtactaaaactaccacctagtttatggattgttgtgcagtgagaaaatctgcataagatgccttgaacactgcctgcttatagtaagtactagtcactataattgtgcaatgggttaaatgtatgtcaaggacatggggcagaagttgaggtaggattttcctgatgtgccatgtctatttttagaaatgtgactgtggccccttgtttctttcagactatgtgagttcatccatttcaccctggcttcagtcattgccattcagctgggatagacacttaggaataatgggcttcatttggaatgtacagtctagaaaaacaccctttattgtagtatatctcttccatttgcttgagtgtatgtagtggccacagtttaactgccaagcagtattattgctagtgggtaaacaagagttatctctctgagtcttccagaaaagacaaagtgaccctggatgctaatggcacagatgagatgggatctcttccaggagtctgaatatgagaaaagagtctctgaagtgtgtactagatgagcccagcttattaccagtcagcagagtgacttccaagagtttgtaaacattttctgaggctttctcatgggtctgtaactttcctaagtgctttatatgtattacctcatttaattgtcacaaaatcccatgaggtaagtgggaatatttttacctgtcctttgcaggtgaggaactgaggcacagagaagttaagtgacttgcctacagtcacacagctcttgtagcagagttgggattcagactccactctttactatattatgtgccccctgagtggtgagatgttggatcccagaggaagcagagctctgaggtcatcaggaaggaaagcagggcatgaagtgggagcagaggtggattgaacaaaaacatagatttctcagagattcaggcacaaaggactcagggccaggaataaaccaaagttggattgctgaaatgaggagtttcaaacactggcatgccagtgaggtttgtctcctaagctagccaaagctccactcagaatgacctctttaccattctgaaatatctgctgtttctctgaggaaatctgctgctgaatgtggtgttgctgtgatttgttatgagatacttttgttctcaaggccatcctctcaggaggaggaactatccagagtactcgggaggtggtggtgaaacagattgggaaccgtacatccttggtgaatttataaagccccaaagaacagagatgcaaacccatttcattcaaagagctctgttaacagtgactctacaggatgctaatccagcagtttcatgcagagtttcctgaccctgcaacttggcaaaacacaaggaatctctccttgccaggcaccatgtaatacagtaagaatgagtgacataaaacaaaggtaaatacattgcctggctttgaaagtaaggttagaccctggtagaaaatttgcatcttgaggaatatatgggcaccttccccaaggtattttctgcctgcttgtcagacagttggtaatatttttatagttgcatatgaagtagaaaccttcctttggtcacatcctccccaaccgccacactaacccaaggtgcctcctgcttttaatcttgtggcaagtaccatgatataaggacaccagctatggagggaggcaggagatgcacagtgaattatctcagaatgcttcccagcctttaagtgcttcagaaacctctttaatctctttttatggcaaataatgaagtaggaagaatgaaattgtaatattaaaactgaaatttacctccaagaccatcctcttgggagatcccccaagttcaccctcttcctctgacagttgagggcatggaggttcagataccggaaagggttggccaacctgatgattgaactaccaagatacctggctcccaaggtaggcttgttagaattcaggcttctgtattgcctaatggatgggtaatacatttggacaccctcccctccatcctagaaatagaaaaatcttctaatgcaatttgccttgtaaaatgtgcaggagtgtgcacacacacatacacatacacacagagatgggaatagctatgttcaggtcctcatttccagaaaccagttcctacaatatagaaaagctttgccacaaagtctgaggaagccctttgtatttatagtctggtcattctagaggtgtgaacctagatttcctcagctggatgttaatagctgattaattcaggatgctgatttaatttgtgacctataaaacgctatttcacagagaatgggctgtgttggcatgtgcagagaccagctccccagatggaataatcttttccttattaatttgctgcatgttgcttctcatttctcacagtcgttccaaatgtgttacaaacgactacgtgctctgggtcctgaatccactactgctgttgctttgaaagaaaaaaaaattgttgactatgaagggcactgagctttcctggctcacatttgcatgctcactttcaaaccatcagtgcactcttctcttacaacactaagccttgctccacctgcgagcacccatcacttttgtgttgtttaggaaatgcaaacatagatagtttgatgttttcagggccaagcaaataggtagtgacatgattgggatcagatctacagtttcaaattcttgggttgtgctatcttcctattatctagaacatgtgaaaggctgtttaatccccttagtccaatgatcctcaaatttgagtgggcacagaatcacctagaggggttgttaaaactcagactgttgtactctacccccagagcttcttatttagtaagtctaggatgggaactgagagtctgcatttgtaaaaagttcccagagatgcagatgctggttgcagaacacactttgagatcattccatgagtctaactggaggagagtatgggtactgttatctccaagtaaacactgcttggtatctgttggagcaggtctctgctgggtaaggtttctattttatgtctttttcctctttccttcctgatatgcaccaaatcccagttgagcaactattttttaaatgttagggctcaatggagaatgcagcttcactaaataaatttaaatgtgtactgcagtacttgacatggattttttcaaattgtgagcacttaagccagacaaaaatatttcccctgggttcagccattctatgcagaccagcccctggtttctaaggaaccatttgaaatagagtacagtaccaaagtgcagagctgcagaagcatctttatgtcctttctaaatgtagaacatacacctcaagctcaggatttcaactaacactttttggtcatttacaggcttgagacaagtcctgtcattaactacaacattatgtgtgaggcttttttcaggacagataagcttatttttctaaaggaaaggacttttgtttttccagatataaaatagcagctcacacttaaatgcaaaggtcttgtttattgtttgtgtggtgaggtttaattggaaggcctgctttttacaattccatgctactgacattaccaagcacacaggattgttgttagaaaagcaaatgccaggctggggagctcctaatctggtggtctgtgccttgtaaataattagggtgtgggggtgaggtaaaggcctatggaaatcctacagagtgccacagaaatgggtcttctcaattatgataatgtgtaagatcacagtgctttttctgttaatatttaaacatagtcttcaagtaatttactgcaaataatcacatattaaaaagcaaggagtttgcttttttttccctacaaataattcaaatggtggccagaattgagagaatggatgatcatactcacaagattggggatagacatgcaggcagtgtgtttattagaaggaatgtccataaacatgggctggtttggagtggcttcacctactctagttgctaagtttagctattaggtggggagttcaccaaccaccagttagttcaatgtaaccaacaaaagtcagattcccaaccattacccccgcttgtcaccaaaccaagcagccaaccaacctttaaaaccacagtttaaaaacccacagctaaaaggatggcctatgttccataaaatactaattttgctggtcaacattctgaggttggatcaaatctgtgaatggctttttgcaagctaaatgcttcatcttcctaaatttatgtacacgtatattgtttcttatcccaattaacagtctttatttaacaatggcttatcaaaatatgcagccatttctactttaacttgtagaccaggcttgatgttagaacatgatggagacaagtatgttttacaataaccttaaaccttaacactattgggagtgctggctgaactgaggcaatgcctgaagccatttgttgcagttcaaaaagtgtttgacattttatccagatctagaagtcacttaaatgaatgaggaacaatttaacactgacccattctaagacttagttcagattctcatttcgaactgtcttattattcactgaattagtacagctcataaaaagatttcatagacacagctaatgaccacagaggcttatcagtatggtgaaaaacaacagatcaaagcaatgatctgagttatttcctggcatcttagtaattaaacaagtttaactgcttactcaatgaatgcagtacacattggttactcctattaactccaagtaggataatttagtagatgtctctattttgtttttttctccaacctcatcttctaatgaaaactttcagtcatgtttaccaaactcgtttaacttcaagtaatttggatgtcatgtttaatttttactttttttactcaaccatttaaaaaatattttagtcctctgactatgaaaattggtcaagcctgaagtttatcaaagttctaagtccatggctgggctgtcatgactggcagtcaagggcttctcttagagtacttttcaagttcactggacagattaggatagagtaattcatctcattcgatctgtttttccatatacacaacacaagtcaatgtttgttatgactttcctgatccttatttataagacaatacaagaggaaaccatgtgtgtatgtttagaaatagaaatgatacattgcacagatatagttcaccacgttatgggatgggttgtcagtgttcaaatggggaggctgaagagtaagaacagatgctttttttccttaatggccccttctctgatttaaaatccttccatttatttccctaagatttagtgataactttaaacactttaactaaattacccagcggcttggcagccatcacggaggcaaatccttttagaaatcctagcaatctgttagattgtgggtactatgatataaaatctgtgtgctccacgtacaaaaattaaatcagtgctatggatacaaatacatactgcaaatggcaccacttccaaaccgaggatatgtgacctgtctccaaatattgaatttctttttttacttttttccccagtacttgactttctaaatttgggccaatttattctcattatccctaagtaaacctactttgattttttttaacagttattttatagtcaaatagagccagccagccagccgtgattcgtggatcctgatgttgctaggatacatggtttggtatctgatgaaagtatatcacttcaaaggggtaaaactttcaagtgtccgagaaaatgacactcccatcttccaccatggaagacagatccaatcctacaacttctcagaagctcacagactgcaggattggcctcccaggctttcaaataagtatcctctctggagggctgtttaattactaaaactagtcagattagtcttaaagcaaggaacacacgtatttataataaaacacgttttcatgtttgttttacagtaaagagaaaaaaacccagaacccccagattttatgtactttgaaaatatatttaaaaacattaaaaattctatatttaaaacatatattatatgttaattagtacacttaaatagaacttgtatttacaataggcttctgatgcggttaagttttaatgccaatttttttcaataacataattatataaatatactaaaatacaataaatattgttttttgttttacatggtgaataatatctttaccatagagagaacaaggccacagacatttacttacattttcaatgggaatcgccataaaaaagcaacaggcctgctgccatgcatgaaacacttctgccacaaagagaccacagcaagactttaaaaaacaaaacaaaacagaacaagaacgaacacaacagagagagattttaacaaaataaatcttaggtcaacataaaccatcaagcatgtgactgtgatgtatcttattgggtaaaagagccactgaccacacaattgctggatgtgtctcctatgaaaccacttaacagatctggcccttgcaatcctttaagtttgtgatggggggttgtttgttttaaatttgtccctcaaaaggaagctgcataaagttgacatacagcagatattccaagcattccttacatattaaaaataattacaaagataatattttcaaacaacacaaaacaaatctacactacgtaaagtcttccttctttcaaagaggtattcagatggtactgtgaaagactagctctaaatgaaagactgaacaaattgaaattctttgctgatggtatcttcattcctgggttatggtgaacatcctcttttgcttatccctcaccctactaagatgcagcaattgcttggggctttctgatacttaaggatgctggtccaagtggtgatcactaacattttcaggtgtgaaatgggctgaatgggcttagagctctagttttcactggggatccatttttccaagaaccactatttcaggctcccaacttgacttctcctaacccaaaatggcagaggtgaggcagggaccctctccatgaacagacaggatgggcagaaggttgctgtggccttcactggggagcaaaattttgtcagctctgtcctggcctcttccattgagcaaggcaccttcaagtcttggtgttctgaatgtccagacaccttcccgaagtcttgtctctggacaagatttcctatgggtccccttgatcattcggcctgagtttggggtttcttttcctgttcccttttcccttaccaaaagttctcaaaagataaaccctggtttcctcaagtctagtttcaaagcaataagtgttcaggtagcaaacatcttctatctcattgcatcaatctcatgatcacaaatgccacatttggctcccaacctgctccaggctaatccaattttatgcaaaattatccagaggtgggatggtgggcataagtcggcttgagtgtggtcctccagtcgagaacctcttgagcacagttagataatgtaggcacttaaagcacgaggtccaagcagcttgacacatgtcattccagagccacctctgaagggtccttcagaggccttcgttttggaatgtctcaaataccatgccccacctccacctagaccttgggatggccactcagaaattcctcccgcactgccggtaaatgcaatgccaactccacatagcctccatttggctgttcagtctcatgtcactggcaatgtggattcctgttctgatctaggtgtttctgggttgatacagggctctaccttttgcttacaagacattgttaagcctcaccatgagttttttttaagcttagccatgatttacccaaatgttcactcctcataaaaaataatcttcattttggggttattttttgttgttttctgttctaaaaaaaaatcactgttctccatgcttatacgagtgtcatgatgtgacacaatgtgttcacttgttcacagcagtggtaaaatatttcagaacgcgcaactgatttttcttccttaaaacaaaacaaagaggagaccagagggggagggggggaaagaatgtgttctgagcaaacataggtccttccgtcaaaagcagcttactctgaccaacgcccaaagaatgagcggggcctgggaggtgcatcacgggatgtggagtgtgagcatttttttgttcagttgccttaatttttattcactttctagtcatctgatcgatattgcaaacatcttcacaacatacaaatgtatcttttatcagccagaatatatattgtaggaattctttccccatctctactccctgtgggaactaaaaaacaaaacaaacaaacgaaaaaaaaacacaaaacaaacaaaaatataccccccatcccccatcccctaagccagtaaagcaatgacaacagcaccttgacattgttttaattccaacgctatcagaagttaaaagcagtaaaacagatatagtactaacaagaacgaagatacttactgtctaaaatgtaaacggaatgttttggttcaaatttttgttgtgtgtgtgtgtgttttttttctgttttctgaaagaggacagtttattatcaattcacaattaaagcagcatgcaatttattattttttttaactttttatgttttcagttcttggcaacggcaacaaaccacaacattatcaaggaatgtaatgcagactttttaagttgtgcgcaaatgactgtttcccttctggtcatggacatgtccaataaatagattgtagaaccactgtactgtataaacttcatttatacatgcagttcataaaattatttttttcttaactgaataatttaccctgttatgtatatatacaaatagataatttttgtctcaatataatctaatctatacaacataaatccactatcttccccttttaatggtcaatgtacatacacaagaagtgtctatccttatgaatcgccagccaattctctttttgctatccatggtaagggcccgcacgtacgactgggtagttcggcactgggagttccaatgccttttgtctatgcccctgcagccttcttttgtgtaacccatgggattgcacttggtctcgtagaagtattgcttcagttggccttttgatacagggaccttttcaaggactgtgaccgtcccgcccgacatgtccactgcagtctttttgtctgctgccgttacccactcactaatactgtcacacacgctcagctcccctcggcgggcagggtcagagtggcgccggaccctcatggacatgtttgcagcatctaggtaatttttgtattcctccagcagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctgggtaggccaagccaccttgtcctcggatgtttgcttctttcatgggggcagccttcatgcaaccaaagtatgaaataaccatagtaaggaaaaggatggtcatcactcttctcacctggtggaactgtagggagaaagcagaaacaagacagaaaactggttagggctttctttcaccgggatgccatgtggcccatctgattgtaattccaggccattctgcagggtcaaggtttttttatgtcttggtgataaactccagctgcaccagacacaaatcagtgtcagtagtgtgctgtatgtggtttaatataaaccagagacatgcagtgtttcccccaagatctagcatataaacctgagattagatggcttctaagcaagtgcaaaaattgtggcttcaagttctccttcttcccactttagcagctttgtaagtttaatttttaatgatctctgctcatgctgtcacgagaaacacaaaatcataaatgttactaagcaacaactgcaagtgtaattaatagtaatttttttcaagttagcaacatggtcctttgcaggaatgtgtgacaggaacagcagtggcctgaggggtctgatgggcctttctagctatgtgatgtctaggcatgaatagcacaataaaacagcagttggggaactataaggagcctttaaattgactttttttttcctcttcccacagagatactctattatagcaaagaagaaagataatttcattgagccatcctgttttacaggtaaggaaaccaaaggccatagaagacttgccttatgtcatgaagaaagtttatgttagaactcagggctcccaattccactgttctttattctacacctgggtggtcacaactgaaaatgttttgcttatttctaaacagaaatcattttttgacatgttcattttaatgatgtgtctatgcctggggctaatgtcatgaaaacaatgtgtctggtaaggagaaaactgaaaaagtcagcattaaaaagacatttaagtccatttcaaatgcctcccatatgcagactccactttatctcctccagttctctaaaacccttcactccttggctttttctggctaatacacacatctagctaagaaagctcaacttttctttttactagagatgttctctctgtgtgtgtgtgtgtgtgtgcgcgcgcgcgtgtgcgcgcgctctgagtttatcctacttttaaaaagctgagtggtgttttacacattttggaataggcagctagtgcttctttttctgcttttgaagtttcctgggaagtcccttaaaagcataccacaaaattaatctcttcctgtttgccagagggttgctctactctaaatttggctctacatctacaagcatgctctaggaagccaattaaaatggatgaacaagcaaaatgaaaacatacctatggaccaacccaaggttaccgtcaggtggtgaaggacttcagaatcacttacctgaagcattgtgtttctcagcagcaaagagtagcatccccagccctgaccctaattttattcctacttctcagttctgaggcatggacttacaaaaagacacatacatgcaatggccatcatgatatccaaataagtaggaaaaggaactgtgtttctgcccatgaagttttactgaattcaaaggcaacctacctccagtcaataggtcagaatgcagaaatggctgaaaactctggtattgaaaagcaaatgttctccacttttgtaagaaataacattttcaaccactaagagactttattaccatccctaaacacacaaaaaaatttcttttagatttactctcactttgcacgaatagcaaacatgcttagaactgcttagattgcacaatgttctcagattaggaagggaaaattggtttgaataaaatacagatgtctattccgctaacaactaaatctttgtgaatgttctgagtcctgtaccatcaaagaaatagatcgtccatgggggtttctatttctggtagattgtacttacacactgaatgaaaaagctttctcctaatattcccagtccaaataaaaacaacccaaggggcacctcttatttaggtcaataaaagtttgcaaatgtggaatactttagccatctacatcacactggtagagactttctgtgatcagctattttttaataccatatttaatcaaatctaagataccatcattgtgaaactcgacattttatatatcactaagaaagcaaaaatgcagcctgggtgaccagagtgaaactccatctcaaaaaaaaaaaaaaaagaattaatgaactatagtttaatacatatttactaagtgcccacactaactacttaaaaatggtccaaaatactgaggcatcttaagctgttggaaaattgttttgttttcaccactacagtaatgagtctttgaatgataccattttctatacttggcttctagtttactctgcctttcactgatcttatctttttattaataactttatgagaaaaataattaatgctttatatattgttctctcagttccatgagcaaatatttcagagggaaaattggcatctgagtaaatattacttggctttcattctgaagcccaaacatgggtattcctcaagctgagcatctgcatagaattaggaattaacacaatggtgacaaagtccaaccccacattgcaagccctgctctctgagtggcacttctgcaattctaactaactgtctactcacttgtaaggccttgaagttaagtgggtgcaacaccaaactcaatactttttgttggaacagtggtatctcctaccttttctaacaatggttccctgatattttgggcaacccaggcataggatagaaatcctggaatcaagtttgacaatatatttcctgcatagccttccaatccagtcagtaaagatgtcctgttaatttttcctttaaaatatttgtcctggccatccctttttatccatcccactgccaccatcttggctcagccctcaccacctcattttgtgaccacaacgtcccgatgctgtatcagacactctttctgctccattcaactctgatgaccacttcctgggtaaccaccctaatactattctcttacacaaaaactggcaatggcatttttgttctatctgctcaaatctaatgtcttctctctgatactcaactctctccaacatctgccctcacccttcttagctaactttctcaaactactcaatgcttcatcacttctgctccgatcaggacagagtccttggagtgccgtacacattactgcctcctgacttgttccattcctctgacaaactcctctctccctctcacttgctgccaaaatcttgcttatccttcatgatccagttcaagcatcaaatcatgcatgcccctttctctaattactccagcatacactgccttccttccctaaaattccacattacatcttacgtagtacttgattcccttctcacttgttttgttttgtttttttcccaagacagagtcttgctctgtcgcccaggctggagtgcaatggtgcaatctcggctcactgcaatctccacctcctgggttcaagcaattctcctgcctcagcaggaggtagctgggattacaggcgcccaccaccatgcccggctaatttttgtatttttagtagagacagggtttcaccatgttggccgagctggcctactcacttgttaattgttaaccgtatttgctcattctagtcagtcttcagctgaaaggtaagttctttgagggaatggatcatgtctgagcccccataatgcttaacagagaaaaatgtaatagcagtactcagtaaaaacttactgataggtttattaaactaagagaaaagacagtttggatataattttcgtaagaagccttttcatttggaaagatcagtgaacccattgaaattctcaggtaaatataggctgtgctaaccccaaattataaactctaaggcagtggtcccaacctttttggcagcaggaaccagttttgtggaagacaatttttccacggtctgggagtagcagggtggatggttttgggatgaaatggttccaccttagatcatcagttaaattatcataaggaattggattctcataaggagcacacaacctagatcccttgcatgtgcagttcacaacagggctcatgcttctatgagaatctaatgctgctgctgatctgaaaggagacagagctcagatggcaatgtttgctcacccgccgctcacttcctactgtgcagcctggttcctaacaggccagggactggtaacaatccatggcctgggtgttgcggatccctgctctaaggaatttgacagatagcaattatcagccatgaccaacttcttgagttcctctaatggaataaaaccttacttgaataattaaaaagcagataacactaccacatactaactgtcctacaatttcctgtgtagctctatttctaacagatcaataagagacttgggaagtaataacaataataatagcaaaatttgtagttttcagccttttaacttcttgtttcttattctgctaagctttcaatgagtaattttatatactgtattaggaaataataaaagattaagtaagagcttccaggacaattcttcattttcaaccttcggatgactctttatcacacataagataaagaggctgtgtaatattgctaagcagattatatatttatttatacttaataaattcattgatgctgtctaattctgctttaaggcttacagccattaattcaaccacatctataaaatgctaggaaggctttcatagccccactgtcaggaaattcaatatagtacatagaactaaaaagaaaatcaatgaagtagatatcaagtttagctttaagtgtgactcacaagtcttagacatttcactgaaagaatgtccataacaacatgctcttttactcttgctgtagtcataacttacatttgtctaagagactatagaacattcacaggcgtcatctaatttgatttttacaaggagacaggatgggtattattatccccattatatagatgaggcaattatgcgtcagagaggttaggtaacctgtcaaatgccataaagctagtaggtcacctgtctcctgaaccaagcttttaccatcaggatgtgttgccagttttagaatatcagccacagagaagagagtggctgtgacaacgaaggagcttacaaaatgtggacactgcagctatgtgtgtcctggaacctaactttctaaaaggagtgccattaagatactactttgtaggtctagattaatcatgaccaagatccttcaactttaaggcttgattacttaaatggatgaaatttcagacaatgtggtctttttctaagagaaagaactgcaaaaattgtagcatgttagaactaagtttctatggccaaaggtgggaaaacaagcaacagtacagataattcaggcatacagaaaaaaaaaaaagtcttgtttgttcccagcccctttgggttttacctgtgagcgtgtaatcagagaaaacacagtttaaagatatggctgctcattttagacagtcctataaagataatggtaatgctgaagaagttattaatatttggttcctaacatatatgatacaaactattaagagttgaccttaatgaaatcttgcaaatcaatatttaaaaatttttaatttgcatccagttgactatatccatatgttagacttccttttgttcattcattcatcacacatgaagtctactttccagtcttacttacctccctccctaggagggaggtaggacatacgtaactagaatataaaggtagaaatgacccagaaaaggtacagatacaattttataaagagaaagaagttacttccagttagggaataaaggaatgcattgtcaagaaggttgcaaagggccaggtgcagtggctcacatttgtaatcccaacactttgggaggccgaggcgggaggatcactagagcccaggaattcgagatcaacctgggcaacacagtgagaccatgtctctacaaaaacttaaaaattaaaaaaattaggtgtggtggtgcacacctgtagtttcagctacttgggaggctgaggtgggaggattacttgagtctaagaagttgaggctacagtgagcgattgatcatgccactgaactccagcctgggtgacagagacactattgccctaggaaagcaactgttttgctgtaatcaatgaaggctcccgatagccagagccacccagaattcacagtcacatcgaaccttgccctcatcctctgcctccttgtcacagagcaacactgccccagtagcacacatctccagtctgtaacaaagaagtcttagcatcaagcatactcaagccacttggatagcaaatgaggtcatctgaaaatacttttaaagtttacttttttaaaaaacagttttttgtttacaggacccaaatggcagttgacattccctgtaaaagtttaacctcttcaattagaattctgttttctttagaatttcaggtgggatctgttacaattcactgaagtttagatttgacaatgttctatctactatgttattgaaaccatataatatttaccaaattcccatacatggtagacagtgacattaattaagaagataatttccaatttgttccatgaagtttcagtgacccactctgtaataaagaacttggaaagggaggttccaagatggccaaatatgaacagctccagtctacagcccccagcgtgagtgatgcagaagacgggtgatttctgcatttccaactgaggtaccgggttcatctcactggggcttgtcagacagtgggtacaacccacggagcatgagccaaagcagggtggggcatcacctcacccaggaagcacaaggggttggggaattccctttcctagccaagggaagccatgactgacggtacctggaaaatcaggacactccccaccctaatactgtgcttttccaatggtcttagcaaacggcacaccaggagattatgtcccaggcctggctcggagggtcccatgcccacggagcctggctcactgctagcacagcagtctgagatcgaactgcaaagcagcagcgaggctgggggaggggtgtccaccattgctgagacttgagtaggtaaacaaagcagccaggaagctcgaaatgggtggagcccaccgcagctcaaggaggcctgcctgcctctgtagactccacctctaggggcagggcacagctgaacaaaagacagcagaaacttctgcagacttaaatgtccctgtctgacagctttgaaaagagtaggggtcctcccagcatggaatatgatatctgagaatggacagtctgcctcttcaagtgggttcctgacccctgagtagcctaactgggaggcacctcccagtaggggccgactgacacctcatacggccaggtgcccctctgagacgaagcttccagaggaacaatcagggagcaacatttgccgttctgcaatatttgctgttctgcagcctctgctggtgatacccaagcaaacagggtctggagtggacctccagcaaactccaacagacctgcagctgagggtcctgactgttagaaggaaaactaacaaagagaaagaacatccacaccaaaaccccatctgtacgtcaccatcatcaaagaccaaaggtagataaaaccaataagatggggagaaaccagagcagagaagctgaaaattctaaaaatcagagcacgtcttctcctccaaaggaatgcagctcctcgccagcaatggaacaaagctggacagagaatgactttcacaagttgagagaagaaggcttcagatgatcagtaataacaaactcctccgagctaaaggaggatgtttgaaccttttagcaaagaagctaaaaaccttgaaaaaacattagacgaatggctaactagaaaaaacagcatagagaagaccttaaatgacctgatggagctgaaaaccatggcacgagaactatgtgacacatgcacaagcttcagtagctgattcaatcaagtggaagaaagggattgaagatcaaatgaatgaaatgaagcaagaagagaagtttagagaaaaaagagtaaaaagaaatgaacaaagcctccaagaaatatgggactatgtgaaaagaccaaatctacatctgattggtgtacctgaaagtgatggggagaatggaaccaagttggaaaacgctctgcaggatattatccaggagaacttccccaatctagtgaggcaggccagcattcaaattcaggaaatacagagaatgccgcaaagatactcctcaagaagagtaactcaaagacacataattgtcagattcaccaaagttgaaatgaaggaaaaaacattaagtgcagcgagagagaaagggcaggttacccacaaagggaagtccatcagactaacagcatctttcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccttacaagagctcctgaaggaagcactaaacatggaaaggaacaaccagtaccagccactgcaaaaacatgccaaattgtaaagatcattgaggctaggaagaaactgcatcaactaacgagcaaaataaccagctaacatcataatgacaggatcaaattcacacataacaatattaaccttaaatgtaaatgggctaaatgctccagttaaaagacatggactggcaaattggataaagagtcaagacccatcagtgtgctgtattcagcagacccatctcatgtgcagagacgcacataggctcaaaataaagggatggaggaagatctaccaaggaaatggaaagcaaaaaaaagcaggagttgcaatcctagtctctgataaaacagactttaaaccaacaaagatcaaaagagacaaagaaggccattacataatgataaagggatcaattcaacaagaagagctaactatcctaaaaatatatgcacctaatacaggagcaccagattcacaaagcaagtccttagagacctacaaagagacttagactcccacacaataataatgggagactttatcaccccacggtcaatattagacagatcaacaagacagaaaattaacaaagatatccagaaattgaactcagctctgcaccaagcggacctaatagacatctacagaactctccactccaaatcaacagaatatacattcttctcggcaccacatcacacttattccaaaaattgactacatagttggaagtaaagcactcctcagcaaatgtaaaagaacagaaattataacaaactgcctctcagactacagtgctttcaaactagaactcaggattaagaaactcactcagaaccactcaactacatggaaactgagcaacctgctcctgagtgactactgggtacttaacgaagtgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaatttagagaagcaagagcaaacacattcaaaagctagcagaagacaagaaataactaagatcagagtagaactgaaggagatagagacagaaaaactccttcaaaaaatcaatgaacccaggagctggttttttaaaaagatcaacaaaattgatagatcactagcaagactaataaagaagaaaagagaaaagaatcaaatagatgcaataaaaggtgataaaggggatatcaccaccaatcccacagaaatacaaactaccatcagagaacactataaacacttctatgcaaataaactagaaaacctaaaagaaatttataaattcctggacacacacaccctcccaggactaaaccaggaagaagttgaatctcttaatagaccaataacaggctctgaaattgaggcaataattaatagcctaccaaccaaaaaaatccatcaggaccagatggattcacagctgaattctaccagaggtataaggaggagctggtaccattctgaaactattctaatcaatagaaaaagagggaatcctccctaactcattttatgaggccagcatcatcctgataccacagcctgacagagacacaacaaaaaaagagaatttcaggccaatatccctgatgaagatcgatggaaaaatcctcagtaaaatactggcaaaccgaatccagcagaacatcaaaaagcttatccaccatgatcaagttggcttcatccctgggatgcaaggctggttcaacatatgcaaatcaataaatataatccatcatataaacagaatcaaagacaaaaaccatgattatctcaatagatgcagaaaaggcctttgacaaaattcaacagcctttgtgctaaaaactctaaataaactaggtattgatgggacatatctcaaaataataagagctattcacgacaaacccacagccaatgtcatactgaatgggcaaaagctggaagcattccctttgaaaactggcacaaaacaaggatgtcctctgtcaccactcctattcaacatagtattggacgttctagccagggcaatcaggcaatagaaagaaataaaggatattcaaataggaagagaggaagtcaaattgtctctgtttgcagatgacatgattgtatatttagaaaaccccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattgtttcaaagagaataaaatacttaggaatccaacttacaagggatgtggaagacctcttcaaggagaactacaaaccactgctcaaggaaataaaagaggacgcaaacaaatggaagaacattccattctcatgggtaggaagaatcaatatcatgaaaatggccatactacccaaggtaatttatagattcaatgccatccccatcaagctaccaatgactttctccacagaattggaaaaaaactactttaaagttcatatggaaccaaaaaagagcccgcatcgccaagacaatcctaaaccaaaagaacaaagctggaggcatcacgctacctgacttcaaactatattacaaggctacagtaaccaaaacagcatggtactggtaccaaaacagagatatagaccaatggaacagaacagagccctcagaaacaataccacacatctacaaccatctgatctttgacaaacctgacaaaaacaagaaatggggaaaggattctctatttaataaatggtgctgggaaaactggctagccatatgtagaaagctgaaactggatcccttctttacaccttatacaaaaattaattcaagatgaattaaagacttacacgttagacctaaaaccataaaaaccctagaagaaaacctaggcaataccattcaggacataggcatggacaaggacttcatgactaaaacaccaaaagcaatggcaacaaaagccaaaattgacaaatgggatctaattaaactaaagagcttctgcacagcaaaagaaactaccatcagagtgaataggaaacctacggaatgggagaaaatttttacaatctacccatctgacaaagggctaatatccagaatctaaaagaacttaaacaaatttacaagaaaaaatcaaatgaccccatcaaaaagtgggtgaaggatatgaacagacacttctcaaaagaagacatttatgtagccaaaagacacatgaaaaaatgctcatcatcactggccatcagagaaatgcaaatcaaaaccacaatgagataccatctcacaccagttagaatggcgatcattaaagtccggaaacaacaggtgctggaaaggatgtagagaaataggaacacttttacactgttgatgggactgtaaactagttcaaacattgtggaagacagtgtggcgattcctctaggatctagaactagaaataccatttgagccagccatcccattactgggtatatacccagaggattataaatcatgctactataaagacacatgcacacgtatgtttattgcggcactatttacaatagcaaatacttggagccaaccaaatgtccatcagtgagcaaggacatcattctgagcaaactatcgcaaggacagaaaaccaaacaccgcatgttctcactcataggtgggaactgaacaatgagaacacttggacacagggtggggaacatcacacactgggacctgtcatggagtaggggtaggggggagggatagcattaggagatatacctaatgtaaatgacgagttaatgggtgcagcacaccaacatggcacatgtatacatatgtaacaaacctgcaggttgtgcacatgtaccctagaacttaaagtataattaaaaaaaaaaagaacctggagaaattatcaagtaagcatcatatttaatgaatttatggtgaaatcatgtgggaaaaatttttctgtacagggatgatgactctggaaatggtggagagagagacagaaaaacaaatgtcactgtaacacaggtatttaaattgtatttaaatacacagacttttgaatttatagaaaattttcaagtatgaaattgatttcatgcaacctaaagtctcaaacttcaaataattttttgtgttaaatttataaattgtgtattaatgcaattcaaatttattcctaaaaatattttaactaaaggagaaattcctggggcctgagattagagttttaggaaatgtacatatgggataaacttacacaggctgaaattaagtgaaaccttacttctcaatgttgagatggattagccattttaacataaagtagaaacttctaagaaatgcagaatctcaacttccccaccctcattccacctaccccacccactcaatcagatcctgcatttcaataagatttatttagtgcaataacttttttacttatcaaagttgagaagcacaggactaaatgataaagagaaaagaggctgcttaggataaggaaataaaaggttgaagttaacttaagtattatgatactttcttagcgtgtcatacggttacctgtcatctttcctctttggttcaacttgttttatggggacatttatgtgggaaaatatctttgcttttgtaatttatgtgggaaaatatctttgcttttgtgtttttacttaagtaaaatctgggctccttttatgtcaactagcttttccactattgttattatgatagaaagtacaggctacttataaacatgattagttcaatgagaacttttagaatattgctgacctaaatctggacatctacacaatcattaattcttaccaaaatgctacaaggcaatataagcataattagcctccctgatccctgaacatagcctaatatcactcactcaatcagaatcatactggaaacgatatgaccaactatggcaggtagtagatgtccagtcacactagtattgctttcagccagatgtctctggtccttgtgagttcctttcgtccttaatggtgaaatagcaacagagggaaccaactcactcactcaaggcagatttcttatttctagacttgtcctgaaaccaacagatccagctctctcctaccaaataccatgaaatttaaacaaacgaaactcgcaaaataatacagcagcagcagcaacaacaacaatgaaatattaaaatagtaaatataagtatcaaacatcaaaaccccctctccaaccaaaatctctcttcttcgataaagttcccaggaggtaacccaatttctaggttggtgtccaatatttgggatcatttgattcaagactgaagtacttaaaatggcttttaaaaaaggaaaaaaggttagatttccagagaaaagtgtaacattttttaagttgaacattatgagggatttgatgggggcagctttgcaagtagaactggagactggtccactgttcaggctttttacgaaagactgcaaaggttgtttgtttccaaacaccaagaagtcaccaagttcaccagtccaaatgcaaatgactcacactaggaaccctaatagtgctgctgttaagtcatttgcaaatgggtggggctgagatgacacagaaccctattttcccaggtggcatcttaagtatggttgattctaccttcagccccacatttaaaagtacagtgtaaacacagctaagggaccgcctccttcaaattacacacaaggcacacctactaataggagatgttgtgaaagccaggtggggctttgtctttcaagtccctgcatccaagaataagcatgctgtgtacaaaaaaaaaaaaaaaagcaagggtgatgcaactgcattcattgtccctaaagggagaacatgcaataattctcagatccaaggataaagggaatccccctttaagaaaagatgttggcattatgtggggattgggaacatgccagaacaatcacacatttttacaagagagagaaagagaaaaaaagttaagacccatttgtcttatttcagtctctttcttcagaattgacgactttaatcaacaggtcactttcagagtattgctggacaccttgactttctgccatgaaatgctatgggaattctggcagttgagagccaacaccccactagacaccagtgctgcataaccacacttttaatagaccccagagctgtggtgacagcatgcccttcccagtttttccacagacggtgctcctgaaattttccatagacagtgtattcttgtggttaattagttatctgagcaatttccattatagaaagagtatctgtacataattaaacccatcttaggaccaaactgccgggcttcaatgtcattaattcagaagggctaaaatgaaaatgagatgaataattctcacctgatgaagggaccgcactagattagatcctatcctctgaaatacatacagcattaaatttaaaaaaacaagagagatgaaaacaggtgatggaagaaactggaaaggtaagttgcctctagagaccaaagaataacactccttttcaaactattatcaagaaatcttgggggaaagataaaattagcaagagaaggctattagctctctgttactcacctttatgaaaccattttcagggatcagtttgttaaattccactgaaacgtggaggtacacagcacagcccttcttctgggatgcacagtcatgccatacagaagcgtgtgggtagacgccaaaacatgtgtggacctgcaaccctttctgtagaaactcagcattctgagtagtaacaaggattaaccttgtgcactcatggagaaaactggtggctccacacatccagttgtccttcgggttatttttgcatcccactctataatttcttttaattacttaactgtaaagcacaggaaagtgctcattacttgtagcttaatgcaggaggaaatataattgaatatgttctcctagccactgctctaccccagctcccagctcttctgaagtgtcacggttcatttcaacagcacgagtaaggcagtttccaggccctgtgcataatgagccatgtggaccctattcaagaaactggctgtactccagaactactataaaatataaggaaaatattaacatcttagatgacaaaagatccatatggctggccagaaaatatctgcatcatttaagccattagaatgcacctatatggaaacattcaatttggcggtactgtgaacaacaggactgtgaaaacatctgtttatctccacccgttttcactaaacactgattcctatagaagacatgcaaactcaaataccaacatatttcatctaagcataggacagggactccatttttacatagttgctataataaatacaatacagtatttgttggtgataggattttggaagatgctctggatagctggaaaaataagtaaaatgtttctctttgtattaaacttgataaaaaataatagctaacatttattaatggtgaggtaaataatttgattatccaccatttatagctgaggaaactgaggcccagagagtttcggtggattccctaagatcacatacccattatgtggtggagagggaatatgaaccagtgctggcttgctatgcctctttccatatggggtcagacatagatgtggtgtcttataatgtgagggaggtctacttggcagaaatatcctgcagaccctatatgccagtttcttatttatttaaacaaagccccatatgagcatttctgataagcagtttgtttacacactaattccacagaggttaaatataaccctaatgtttctttgttgctactctgtttccagtattgaattattaccacaaggtaccaaccatatatgcatacttaatagggtattttgtcaaaactatgcatgaaggtcatttgtttgagatgtcagaacattttcccgtgagaagatctcattgggcattgaaacagaaccacatgctcttcagaccagcaaccgcgactaccaaatactcctctgtcaactctacttgagtaagaacgctttcaattaaggcctaagtgtcaacatgcctttaaaaaaaatcgtggtgacacaaaatctttctttttagcacccaacagaatcccttcaaagcctcgtggtctgacaccctatgctacgtgacttgtgacccatccatttgtcatgttcttcgggaatgtggctaaggggctaagatgtgacttgaaaagaaaggtagaacaagatcatctcaaatttattatcaaggaatagttcagaaaacgacttcagaccacagagacagcagaacagatggtccggcatggatagagcatcagacactcacagactgtgccaacaagagccatcgagtcaaaacagccaaaggaaggagggtcatggaatgggttctctcacaccaaactgatgcccagaggccctcagcatgaataacaaaggcaaccagacccacaagccatactgagtggatacaaaacctatacctaggctgacatcccaaatgtgtgtggcaagttagatgatgatggcacaaaagacagaacaccttgcttctggccattgtcagctcttggaagagagcacacttttagaggagcagctgcaaggagcctgagaacaaaactggaaatgtctgttatgaaagccttcacaggtattattaacaaaagaaaatgtctatttgtcaatggtgtttcagctagattttggcagtccattcttatgcccaggaatgacctcttgtgtagactggatacagtcatcaatgcaactgtccaggtgcaactcttctataaaggggaagaggagtgactttcccctatacagtggccctgtcaaaattctataaaaaatattgtccatttaaattaaataaccactgtgcccggctccatttaccacacttttctatgcagtggaactgaaggggatttttttttttgctgtcctcagagaaaaataagactaagaatcaacctttctaatgagaatggtaaggagttatgtggggatgacctggaatatatgctgctcaaatggtggagatgttatctaggccgtaaatcatggcatttttatatgatcccctatttgcctaatgcaggaaaccacttggcaactttaaggaaaaagtctagcaataatgcatcatagttcaatgtttatattgtacttggacagtttaaatttatcttataaagtactaattatttaattacaaatgttgagtaagtgtaaaatcattcctcaaaaaagcatcccttgagtatgaaagttccaagcttagcaagacatccctgtgatttgggatacatctcttgaactcagtcctgaaaataatgttaatagctgagaaaagagcattgaaagccttatacacagtgtgttgtagtgaaacaattttctttttggttctaaaaaacactgttgtgctctttagatccagcatggctagttagatgaataatgaatgcatgttcaactttctgctacaggaaattctgcaagtggcaacgtgggtccattccgtgtgtgtcactagagctggcgcaagcccatggccatggtgaggcagcgtttccactggaactaatctgatacctgcaccagctcttgcaactgtgcagtgttcccactgcaaactacggatggggtaaaagactgctcacctcctatttctcatctaatctcacacactctgtttgatgaggctatggagaaacaggtcttctcatacactaaaggtgggagtacaaacaattcaagccctgtgcaggacaattaggcaatacctatcaaaattatacatgatttttcctgctgacccagcaattccacttctgggaataattgacagatataggtgcatatgtacaaaatgatggaaagctctctggtatatattagtaagtgataaaacaaggtgtaaaatagtgtatatatggctactaccttttgttttaaaaatgggggaaaatggtggagcttgcggtgagccgagatcgtgccactgcactccagcctgggcgacagagcgagactccgtctcaaaaaaaaaacagggtggggtgggggggaaataatagtacatactcatatttacctgtatctatataaaacacactatcaaggattcacaagaaactaatacaaatgatcaccttatagatggtatgtattgggggatactgaggtgagcagggtataagtggggcaagacttttcagtgtaaacttcttttaaattttattttgatttttgaataatgtaaattaactgtcaaataattaaattaaaaataaccaatttattaacaaaacatttaatctagtggctttacttttgacacaagacaatctccaaatctccaccaatcaccaaaaacagagatttacaccagttcctttgcttgtttttcctggtaatgactacaattaagaagtcctgtgggtgccatctcagttttggagatatttccctagaagaaactgattcaaggtgggacaattgggtatagagaatagtccctgggaccgggggctgaagtcctgaattctggtcctgcctaactcccactttctattaagctgaccctgtgaaacggctgatacatgaccattttttaccaacaaattagacaaattcatgggtgatcaaattcaaaaaccctgttgccttaccactgtaatatgatgaggacacgtatacacaccctgcctaactcacagcatcacaccagggattgtcaacatatgggaaagagctttgtacattgtaaaggtcaaccctacaaacagcagctgtgaaacacaacacaaccctgagggggtggccatggccaaacataggaggggaaaaggacccagtctcaaaagcatctgagatactgagatagtgcagaggaatgaaatcttccaaaagatggaatctaaacataaacagacatcaagagcgggctgacttgcagtggaagatgtggttaaatgactccacatgtggtcatctgccattgcatacactgcaaattctgtgaagcctactaagggaaattagggagatgtaactgggagcgcactgtaaagatactgatacgaacacgaatgtgagatcaatgttgaatgatggacccaaaaggatggctcttagtccttgtgaacatatagttgttggagacatgtgtctgtcatacacagataggcctccaactcacctctgaaatcagatgcaaacttcaaatacttttgaaaagtctccctagaggaccttttacccccaaatgtagagactaaatgaaaaaccattctttaaaaggggttaaaaaaaacactcaaaaaacttctcctttccacatgtatagtcatctggaaaacagatctcccattaaacggatggtcaaagctgtatcacaacattaaactaagcacaaaaattcaagacttcccttcctcaccctcctaaaacgaaacattccaataggctagaaataacctcatgaggaagttcattgaaggtactcccacttggcactactatccagacactgggttaggaaactagttacttggaactcagaaaaaataagaactattttgattaggcaaggcccctgtgcaaggtgcctagttccagctgggtctcagtagtctgatgggtgtcatgcactcctggacctcctcttaatgaaacaagggaccttgactttgggccccatgttgagaagctctgaagccaaatataatggtcaaatataatgtcctctcacttctagcttcatagcagaccatgtttccatatagaaatttctctaggaggcttactatcctatgttatctcaagccgaggcctcctcttacacaagaggcttaaactgcccgtaagtaagaattaaagatatgttacattttttatgaattagtcatttattcattcagcaaaggttattaagaaggtactgagtttggatgtactttgctttaggaaaatcattttcaaggttgcttcatgcaaagtgggaataattaacttggtaactcaatagacttgctaagtgattgccccaagtttaaactgtcactgatttgcaagtatgacatgaaaaccagagacccaaggaggtgggcacattcccacctgtcaatagccctcaagagaagtgcttcagtattaccccaaatggccaactttgcatggttaatcatttagttagaggctcacaagatcaaaaacaattcttaaaaaactatttatgtgaacaaagggacaatgagctgacaccttcaaggtgcacgtcaggggcacaatacaagttcctgtttcaccagcagagctctggtcgctcagttgaagctgaaagtcagaaccagctgtgtttctgtcattccctcatatgaaaagaactcagctgtagacctttactccatgagaaaacattttttaaaaacccacaaataatttttaggtttcatttttgcctctgctttctccagagctacaaaggtcacccaaatttctgtggcgaggttatttaggagagcctttcttttggatgtcaacttgtcaaacttgcagtttagatgagtgtgatgtagtctcctaaaatttacttttgcactattttttcaaataatagatattctctgagcacaggcactgaggacatcaaaatgaatgagactgaatttctgcccttggggactgcagtgttaagggtgggttagacccaaaaaccaacaatacagtgcaatgtggtacatgctgtaactaacatgcacaaagggcattcccaaaaaagagaatgaaaagagggaggaaggtggcaaaggagaaaggcctttggcccaagtttttgttcaataaagatcatattttgtagatcaaaagattatatgatctgctaaccccttagcatgtatagctcatgaagcaagacaaagtacccatgaagagttcaacattagcgagcctctggggcaagtaagttggaaatcataacccatttatggatacctgcctagaactgatttcctattcagagtgccttcctagctgataagaacaatactgaaatctttcttttccatgagggaaaaacatgttgaatcatttagcaagtacctacagagccacctactatgtatgtgcccagcagtctactgtgtgctatcaggagtaagaaaatgtagaaatattcttgcttttaaagggtttacaatctaattgtagaaataatactaaaatacatgagaggaaagaaaagcaaacttagcttctctgggataaggactatatctcatgcaacttttaaaaagttaccatttattcaacttcctaccaccattacatacttctggtaatcaattatcttccttctccccttgggattttgaattgggaacagaatagaaataagttgccaaataagaatcaaaatacagggtcagcctcaatttcagtgcaagtggtccattgctttggttcacaggctctacagtccagaagatgaaagattaaggatttcatccatcagattaacctctcctcttttcacagaaagaacaagtaatggggataagagaagggcctagaatattcccctgaaagtgttacttattaggaagcaagttcccttgtggaaacacaaggatgggggaaagggatttccctcaacattgttctatctacacacagagaattcaagtaacttgcccaaaatcacagagctagtaagtggtgaggcttaaatcaaacttgatcatcaggtccaggaacacaggtacaggctggggctgcctcatgaagtgtctgtttaggaaatgtgtctttaaagtcaacagactgtcctgagtaggacattctagaacatttttctagacaaaaacatcatatctacaacttccagcctagaatctgatacagcaaagacacacaataatgttttgttatataagtgcatatacaattaattaccaaattatgaggtacagaccacctaggaactcagatagggcaggtttattattatgggcaagagtctttctagaaacaggattccagctaggtcttgaagaatgagtagaattcagatgaataaacagcagaaaaaatcattaataaacacatgagactcagagaattacaacaaaacagttttagtcttgtaaactttgctataaagtgaagcatatttaggtatgaagcatgctgattaaactttttattgtcttaatacaagtctaaaaaaagtatctttttgggggagctggaaagtactaaaaataaaaacagtggctgaaattcattaagcatttactatgccaagcactgctctaagcacttcacagacactaacacatttaatccctaccaataccctgttgagaggttgagatacagagaatttaaattactgacccaaggtcatagacctagtaagtgttaggcctggagtcaaactcgatcctcctctggctcaggaatattgttccaggcctttgctctcacctggaagtttctaattagaaaatttatttcaagtcagaataaaatcttcagcagttctctcatctcaaaatgtctgaatttctgattatttacaaggctgcaaatcccttctagccacgctctaatgcaagtacttggatagtgaaataaacgataagtctctctaaatcacaggatattcagtttatttgattttagttcagcgattcttaaactgtcccatacatccaaaccatctgtagaagtttctaaacccaacataggcccagggacccaataccaaacttacaaatcttggagactaagatctcatatgtatatatattttaaagattcaagggtaattctgatgctgaatgtgtttgagaatcactgctgtatgctgcattctattttattgtatttcttttattattattattataataataataataatacttttaagttctggggtacatgtgcagaacgtgcaggtttgttacctaggtatacagatgccatggtggtttgctgcactcatcaacttgtcatctacattaggtatttctcctaatgctatccctcccctagcctcctacaccctgacaggccccagtgtgtgatgttctcctcccagtgtccatgtgttctcactgttcaactcccacttatgagtgagaacatgtggtgtttggttttctgttcctgtgttaccttgccaagaatgatggtttccagcttcatccatgtccctgcaaaggacatgaactcatccttttttatggctgcatagtattccatggtgtatgtgtgtcacattttctttatccagtctatcattgatgggcattcggattggttccaagtctttgctattgtgaatagtgccacaataaacatacatgtgcatgtgtctttatagtagcatgatttataatcctttgagtatatacccagtaatgggatggctgggtcaaaagatatttctggttctagatccttgaggaatcaccacactgtcttccacaatggttgaactaatttacactcccaccaacagtgtaaaagtgttcctatttctctacatcctctcctgcatctgttgtttcctgactttttaatgatcgccattctaactggcataagatggtatctcactgtggttttgatttgcatttctctaatgaccagtgatgatgagcttttcttcgtatgtttgttggcagcataaatttcttcttttgagaagcatctgttcatacccttcgcccactttttgatggggttgttttttttcttgtaaacttgtttaggttccttgtagattctggatattagccttttgtcagatggatacgttgcaaaaaatttcacccattctgtcggttgcctgttcactctgatgttagtttcttttgctgtgcagaagctctttagtttaattagatcccatttgtcaattttggcttttgttgccattgcttttggtattttagtcatgaagtctttgccatgcctatgtcctgaatggtattgcctaggttttcttctagggtttttatggttttatgttttatgtttaagtctttaatccatcttgagttaatttttgtataacgtgtaaggaaggggtccagtttcagttttctgcaaatggctagccagttttcccgacaccatttattaaatagggaatcctttctgcattgcttgtttttgtcatgtttgtcaaagatcagatggttgtagatgtgtggcgttatttctgaggcctctgttctgttccattggtctatctatctgtttatgtaccagtaccatgatgttttggttactgtagccttgtagtatagtttgaagtcaggtagcatgatgcctccagcttgttcattttgcttaggattgtcttggctatacgggctgttttttggttccatatgaaatttaaagtagttttttctaattctatgaagaaagtcaatggtagcttgatggggatagcattggatctataaattactttgggcagtatggccattttcacgatattgattcttcctatccatgagaatggaatgttcttccatttgtttgtgtcctctcttatttcattgagcagtggtttgtagttctctttaaagaggtccttcacatcccttgtaagttgtattcctaggcattttattctctttgtagcaattgtgaatgggagttcactcatgacttggctgtttgtcattattggtgtataggaatgctcgtgatttttgcacattgattttgtatcctgagactttgctgaagttgcttatcagcttaaggagattttgggctgagatgatggggttttctaaatatacaatcatgtcatctgcaaacagagacaatttgacttcctctcttcctatttgaatatgctttatttctttctattgcctgattgccctggctagaacgtccaatactatgttgaataggagtggtgacagagggcatccttgttttgtgccggttttcaaatgaatgcttccagcttttgcccattcagtatgatattggctgtgggtttctcataaatagctcttattattttgagatatgttccatcaatacctagtttattgagagtttttagcatgaagggctgttgaattttatgaaaggccttttctgcatctattgaaataatcatgtggtttttgtcattggttctctttatgtgatggattatctttattgatttgcatatgttgaaccagccttgcatcccagggatgaagccaaattatcatggtagataagctttttgatgtgctgctggattcagtttaccagttttttattgaagatttttgcatcaatgttcatcagggatattggcctacaattttatttttttgctgtgtctctgccaggtttttgtatcaggatgatgccggactcataaaatgagttagggaggattccctccttttctattgattggaatagtttcagaaggaatggtaccagctcttctttgtacttctggtagaattcagctgtgaatccgtctggtcctgggctttttttggttggtaggctgttaattactgcctcgatttcagaacttattattggtctattcaggaatttgacttcttcctttagtcttaggagggtgtatgtgtccaggaatttattcatttcttctagattttctagtttatttgcatagaggtgtttatagtgttctctgatggtagattgtatttttgtgggatcagtggtgatatcctctttatcatcttttattgcgtctatttgattcttctctcttttcttctttatcaatctggctagcattctatctattttgttaatcttttcaaaaaaccagcttctggattcactgatttttttgaa

SEQ ID NO: 1214 - DNA, 22419 bp, Homo sapiens
tgaaaatacaaaatttggccgggcatggtggtgggcgcctgtaataccaactactagggaggctgaggcaggagaatggctggaacccaggaagcggaggttgcagtgagccgagatcatgtcattgcactccagcctgggcgacaagagtgaaactccatctcaaaataaattaataaattaaaagaaaatcttgagaggtattcttgaacaaaccacagtgactttgctgttgataaaacgttattcttagtagctctgtggaggaatggaggaaggaggagaagaggggagatgcagaagcaaagcctgaagacaggagaaacatttctgtgttctaatctaataaaaagtctgaatttccaaattacgttttctttcctcccaagatagtagcatttgaaggcattttaggaaatctgcaagctcaggaggttgggattgcttagcaccagggcctaagagagaggctgcctggagggtctggaccctggagggtctttccttctgggccccaactggccagaaccctgatgactgggaaagaggggagagggccggaggggtagtgggtcttaggatgagggttaacagcctgagtccctttcaatcttttttaggaccaaagaaggaggtgctgtaaaattgtgggaccaggagatgaagcgctgccgggcctttcagctggagaccgggcagctggtggagtgtgtgcgctccgtgtgccgtggaaaagtgagcacagccagctcccctgggggctgggccagggaagggggaagtgtaggtaccctcccagccggcactttctctgggctggtttgtttactccttgaaacaaggcctcaatacatgaattgtgctgtagtgggaagcagcttaagagagtcagactcccccaggaagaaccagctgggtgaccttgggtgtgttccttaatgtttttgtgtccagcacacaggtttgtcatgaggtttttgtgagggtcacatatttatacatgacagtgcctttcatcttacctggcatatagtcccattcaggagatgttagctactagtattatagatgatatcctcataagctcagagatactaaatagtttgcccatgccctaagctatagggccagtaaggaggagggtaagggccaccaaactgtctgactcaaagccattggtttccaactcatatttgggtagcgtatcaaaaacaactgtcgggttttaaagaatatggatgtccgggcacccacctggagctggtgaatcagaatctcaggagtgggacctggacctgtatgtttccttctatttccttctatttaaattcccccaggagatttgatgcacttaaaagccaatctccaaacttctattgaataccttgtgtttgtttttaaatatcagtctaagaatttgctttctagatgctgtccatgaaaaaggcaaactggatatggagtaccacatgattcaaaactggggattttgttcttaaatagctaagtgatgcccacctggaagggtagttatgggagatgaaggcaggactatgcctggagcctggaagttatcaggaagtagtttttttttttttttttttgagacggagtcttgctctgttgcccagggggagtactgtggcatgatctcaactcactgcaacctatacctcttgggttcgagcgattctcctgcctcagcctcccaagtagctgggattacaggtgcccaccaccatgcccagctaattttttgtatttttagtagagatggggttttcccatgttggccaggctgttctcaaaactcctgacctcaggtgatccacccaccacggcctcccaaagtgctgggattacaggcgtgagccatcacacctggccaggaagcagatttttgttcagtggaaggaagaacttactaagagcttgagctgtccaagaacaggagaattggctgctttgctctgcagtcactggaatattctggcagaggctgggtgatggaggagtctgtgctgaagctctcacctgaggtagctgatggagaaagggcaaagtaagagggtggagaagagcaattaagaatggacagtttgttgttaaaaacaaaacactggccaggcatggtggctcacacctgtaatcccagcactctgggaggccaagaggcaggcacatcacttgaggtcaggagttcgagaccacctggccaatatggtaaaaccccatctctactaaaaatacaaaaattagccagatgtggtggcgggcacctgtagtcctagctactggggaggctgaggcaggagaatcgcttgaacccaggaggcagaggttgcagtgagccaagatgtcaccactgcactccagcctgggtgacagagtgagaccctgcctcaaaaaacaaacaaaaacaacacttctcaccccttcttattttaatattaacactgcaaaggcattttctcaagttacttgttttttttttttttttaaagacagggtctcactgtgtcacccaggctggagtgcagtggtaccatcatcatagctcactgcaacctcaaattcctgggctcaagcaatccccaagtttttctaataatagtggtgttttaaatttttttaactgtggccaaatagacataaaattgaccattttgaccatttgtaaatatacaattcagtggcattaggtgcattcacatgttgtgcagccatcaccaccatccacagaacttttcttgcaaaactgtaactgtacccactgaacactgactcccctgtccaccacccccattcaccggcagtcatcattctactttctgtctccatgaatttgtctactctagatacctcatatgagtgcagtcatacagtatttgtcctttttctaatagtgtttcaattacaacagggaaaaatcttagtgggaaccaaagacggagaaataattgaagttggtgaaaaaaatgctgcttctaacatcctgattgatggtcacatggaaggggagatctggggcctggccactcacccttccaaggacctcttcatctctgccagcaacgatggcacagcccggatctgggacctggctgacaaggtgaggccgactctgcccaaactcagatgcccacgagtgggctgcgcggcagtgggagctgagcgaggagaggcccagccagcgtcatggcagagacggggatggggccaggtaggagatcgagttagaaaacctaacgataaaagaagccccactcaccacaccccgtctaaacaatataattgagaaggattattctgttgtcatgaaagaacccacaaaactaaaaatatagagacaaatcatgttttccctggatgagaagactaaaaatgatttaaaatgtgaaatgttctgaaatgggcctaatgtatttctgtcaaaatcccaacaaggtttctcttagagcttgggaaggcaatgttaaagttcatctggagtaaaactgtgaaatagcaaggagtggctgggcggagcggggtgggtgggagggaacaaagagttcttgccgatcctcatggccttatccagtgttaaaacaagtactcaagttcaactaattaaaatacttggtttcattttaaaatggctggtaagtgtttgttgtatttttagtgtcagagtcacagaatagtcaggtaaaagcttgagtatggttgctagacttttaagttagtttctgtaattatttattaaacattattagcaacagctgtcactacttgactaactacataacaccagctgcttcatggacatgatcagtgcctacaataaccttgcaaaacccttattaacatcgctattagtaaaactctaaaaactgagatgtaatttacccaaacacacccagctagtaagtgacagggccaggattcagaatttgaactagcagaggcagaagctcacactctttcccctaaagaagaggttggcaatctacagttaaaggccagatcgggcctgtggcctgtttctacaagtccagctgccctcatttattcaggtactgaggctgtcttgtgctacagtggcaaaggtgagtagttgcgacagagactatggcccacagagtctaaagtgggtgctacctaatcatttacagaaaaagctgggcagcctgtgccctaaaacttgttgtcccccaagctgctctaatcaagacatacagctctgctcagttattcagggacatttactctaagaagcaagagatttggtggcctgcagtggctgcgagggcagcctgacttctctggcctggtgcagaatgtctcctggagaccagctgagggggccaagagctcaggtgactttcctttgcatcaatgtagaagctgttaaacaaggtgagcttgggccatgcggccaggtgtgcagcctacagccctgatggggagatggtggccattggcatgaagaatggagagtttgtcatcttgttggtgaacagcctgaaagtttgggggaaaaaacgagaccggaaatctgctatccaagatatcaggtacctaagtgggtggtctgggcatggaggagaaaggcaagcattctgcttaccagtggttcccattccagccacggctggaataaagaactcagttgtgagagggtcactttcaacaagccacctatgaaagaataccttctcccactctcactcttagacaagtctttgctaatttccataaaagtgtggttaaaattacttgtaaatgtcattctacatatttcccggggattcgatccagataaattgttgaattccgtagaatgccaggagaggctgaccacatgtgagtcacaaggtggctctcattgcctttaggcctggaaggcctgtcacagaccagccttcgtgcctgaccagccccaaacagccctcctcatggactctgctctcggattgctttttctagaatcagcccagacaaccgattcttagccgttggttcttctgaacacacagttgacttctatgacctcactcagggcacaaatctgaaccgcattggctactgcaaagatatcccaagctttgtcattcagatggatttttctgcggatggcaaatacattcaggtatgcttggggtttacttatatctggggcaaccaataataacagcagtaataacaatggcctatattaatcgagtccttactgtgtaccaggcaatgtgctaactcactcttcaccagaactccttaagtagttactttttccatattttataaatgtagaaacagaggcttagagaatttaagaacgtggaggaaatagaatttaaaataataaagagtaagaaaaacaggaaacacaagccctaatcatctttaatctgcccctcaccacctcctcttcagagtttcctgatttctagttttctggggctacacctaagccttgtgccgcttctggtatttattcatgtctttcccaactctactgggtagaatggcccctccatacgtgggccctggactccagccagtgggcctggagtgaaagctcatccctgggtcccaggggaactgaccggtggaagggagggagagggttccactgctgggactgatccctaaaaacagaatgatttctctagcactcaagaaatctgcgtttgtgagctggcctggagctggatattcactgtaaaaggagagaggatgtatttattcattcaactatttgctgaaccgggcactatgctagacttttagatggacaaaatgagactggtcccgtaaccacccaaggggttcaccttgccggctgcctagacagagcccatttctcaagacaggggaattgcaatagagaaagagtaattcacgcagagctggctgtgcgggagaccggagttttattattactcaaattggtctccctgagcattccggaagcagagttgttaaggataatttggtgggtggggggaagccagtgaaccaggagtgctaattggtcagagatgaaatcatagggagttgaagctgtcttcctgcactaagtcacttcctgggtgggggccacaagatcagatgagccagtgtattgatctgggtggggccagctgatccatcaagtgcacggtctgcaaaatatctcaagcgctgaatttaggagcagtttgagggtcagaatcttgtagcctccagctacatgactcctaaaccataatttctaatcttttggctaatgttaatcctacaaaggcaatctggtccccaggcaagaaggaggtctgctttgggaaagggctgctaccatctttgtttaaaccataaactataaactttctcccaaagttagttcagcctacatccaggaatgaacaaggacagcatggaggttagaaacaagatggagccagttaagttagatctctttcactgtctcaatcataattttgcaaaggcagtttcagtccctgcttcctggagcttgctctataacagagaagacaagcactaaacagacaatcacaaaatataaatataattacaaattgtgattatgtgccaagaaggaaaagtacagcattccggggagcatgtaacaaggtgctgaatttagatgcacttcctctcagcaagtgatatttaagctgaggtctgcagggtgtgtaggtgttagccaacagagaggtgggaacattgttccaggccatctgcatgaaagccctgaggcaggaaagagctcagcttcccagctcattccaggagaagcactgcagggagagaggaagctgaacaggaagggcagcagccattcactgcaaatgtcttgatggtaggaaaaatggtctgtttcctttagaagactcccagagcaccgaggttcaggttctagacacctcagagatcatctgtgtcacccactgtccatgagaaacctgccttacctctgtaccaaaggttcttggtttcctgtgaactgggattcctgtgtatcagaaacacctggcggctttgttacagcagagactgctgggccccaccctttcggtgtctgtctgggtaggtttggggtggggcccaaaaatttgcatttctaacacatttctagatgcagctgacgttgctggtcgggaaccacactcagagaaccgctatcttaggactctggaaaatagcgagaaaatggatgagaagaaagatgggaaaatggcctgctgttgttgtcatgggctggccataggctttgcagcctggagctgagcttgggtttggagaaaagccctagggatgcagaggctgggcagtgttctgggaaactgtgcccaaagggagtctgtgggactgagaaagaacgttgatgaacatggcttcccttctacctacaggtgtcaacaggtgcctataagcgccaggtgcatgaggtccccctggggaagcaggtaactgaagccgtggtcattgagaagatcacctgggcctcctggacaaggtgactgactggaagaaaaaacttgaggaaaaggtcacaagggagtctcttgtctcactcaggctcagcctccaagtctgtgcaggatctgaagaagctgagaaatggagctgtcttttcttttgggggtgagggtgggaggcttcttggctagtctagtttaggtcactggctttgatctgacctaggtttttgaaatgcgaagcccctctttttgtgtaatttcttctacaagtctccaaccccttccagcaagttcaacaggaaaccatctcccgtctcttggccaatcctagtgcacagtgaggcctccattcgctaggggaagggagtgggagggccagaccccggcttagcaggatgagaaacaatggctaattcatgggaaaagagaccatttagtctgtgagttgaaaggaacccctgctgttctccccaacacacacatattcaagaggaccacagggaacagggagagaatcaaagatgggggtaacttgtgtttttggagtgtagggaactgaggcagagggggaacagtaagagctggcacaaatgtacagaggggaaggggacagatgctttcatgccaggagagccacatggctgtactgaattacataaaacagcaccagggaccaatttcatggaatacaatttttccagagaccaggtagggggtggggtttcgggatgaaactgttccacctcataaggagcttgcaacctagatccctcgcatgcttagttcacaatagggttcgcactcctatgagactctaatgctgcggcagatctgacaggaggcggagttcaggtggtaatgctccgccaccactgctcacctcctgccctgcggtcggttcctaacaggccatggaccagtaccgttccgtggcctggctgttggggacccctgatgttaaacatccctctcttccttatccctgggaggtgatgactgactgcaaggagccttcgccgtgacttccttctatcctaacccctctttctgttggaacagcgtcctgggagatgaagtcattggaatctggccacgaaatgcagacaaggctgatgtcaactgcgcatgtgtgacccacgctggcctgaacattgtcacaggagatgactttgggctggtgaagctctttgattttccatgcacagaaaaatttgtgagtgttcctcagagtaacctccctgcaggttctctgtttggccgtctgcaggagataggggccacgtctagatggccctctgggagacacagagaaaccctgtcccggtacagtggaaatatggcaatgagtttttcacctcctggaggggcagtcctggaagccagaagggaggatggagggtggataaaatgacctgaagtggggcaaggatgagaggcaggaaagtcagccaaaggctggctaatagatgagtccagaccaaatggaagtccccagtgaaggaaggttctgggagcaggggatttgagtgctggaagtagtctgtggttgctgagaggagccagggtctcttagctgtctccattcacttttgctcacaggccaaacataagcgatacttcggtcactcggctcacgtgacgaacatccgtttctcttatgatgacaagtatgtggtcagcactggaggagacgactgcaggtactaacgtagctgacccagttcttactccacaggcctggccagctctccctccccatctcaggcatcccgtgggtcagcctctcccaggggcatgaggagggctgatgtggggctaataaacaggaaattccatgagtcctcatgaaggcaagtactttccaagataaggcatttactctttggtgactgtcaacccaatggttgtgactggagctgtcctgggatggcatgggcatgtgatagctactctgggcactgctgggggaaagggacaggtggatgacacccgagatggctgatttgagtagaagctcttggcagcccatgggcttttgtgcataatcaggaggttagaatgcaaattcatctatatgtccttttaagaactcccagttgatcaccagtgttgggaatttctttatttactctaaatagagtatagaggaacaggtctaggtcattctaactcactcagcttccccatttctgatgagcttcattgtagcatgaatactgggttctattcagcccaagcaaaactcctgaggggataaagatgaaatacaggccttctgatacttcctggtggtctgagttaggttgtaagaaaggcacctataaagaatctcaacccacttcccactcaaaagcactgtgtatttctcatggcctgcctgggagcccccatctccagcctgctgtgctggctacttctggcacttatagcccttgagatagtaccgccagcagctccctgtgaagtgctaacaccccttcaaagcagcaccaacccaattgtgaacaagctaggagtaaaagacgtaaatgaattggtcaccccaatgcaggggatacagacttgttttaatataaaaaagaagtggccttaaccgtgcagggcttgcaggcctttgtaggcatgggagcatgctgtgatccctggttctgtgctaaacactcaaaagggctctctgactcaagtggaggtgataaaccttttcaatagtaacaggagagagtgtgatatcaaagtgccagaagtcctcacggaccaacatttagcacagacattcaaactgctgaaagaaccaaacagaactcaactgaaaaaaacagaccttttaagaaaagcaatagatcttaatttggtggcaagatccctggtttaccttttgaagtcaaaatgttcaatacatcacccgagcttgacttttgagcacttggcaagattgttttttgccacttgacacaagtatgatgtccagctatgcaaaatgactgtttgatctgccttttcagtgtatttgtgtggcgatgtctgtaaaatgccagaagcctcttatgttattgctgctgctgctaccagccagcaactgcagaggccatgctgaggtgcctccttgccaccagccgttgggaaatgcctaccatgctgccccggatgcacaagctcaaaacgctgcagaagttacacaactgctcccataatctggactctccaaaaccgtgatgccacgaaggaaggtcaagttttaaaatgttaaagactgcttgcctctgttcctgagactaaacagtatacatactaactacattgacaaagaaatcctatctgataatgtagcccgctgacgaattttgaagcctcggttaccctaaccaatatgtagcttttaatttgcatcaaaacttttacaaagatgttttgctattgtttctatatacttcaagaatgttcatttttacaaataagttgaacaagacagcctaagttagatgcaccgaagtactagaaatatcgctagcctctgttctccagtttagctttcaaaaccaaatgagccatgtataaaggagttgagaaacttaatttttaaatgtttcatttgcagagttttatatccattaagtgcctttgaaagtttccagttgtgtgggctgctgtctcacctcccaccaatttctcctttctccatatggtgctaaaacctcaaagctgaggagggctgcaggacccttagcagattcagtgtgtcacccttgtcctgtgttcacgccaaggcttcctaaatgaaagacatcggttacctgcttatgggaaggtgagcagcaaaggaattgaagttcgggacagggtagaattatgggttttcattgtgtttcatgccaaacccacaaaatccaaaatagaattcaagttaaacaaacttctactacaaaatggaaggggaaaaaggctcaggaaggtctatgagaatgagctgacttatctcgttaaatcttaagataaatgagggtaacccaaggctgcaccttggtgtaccaccctgagtggagttgaggtgacttcatttgattgcttcaggcgaactatataggtcaagtccagattataaaaaaattatctgcagaacaaattgtaaacccaaggaatagctggtaaatcaaaattataaagtgagttagagttccttggagttggttgtatgacggaatatgacttggacaatctttaccagaagccatccgtaagcccctcagtcacactttccatgtagctgaccagtgactacaggatgtggctgacagtgctcactgaaaggagagttggtgcgggactggtggttctgagcacatagacgcctattagtccttctggtcagtgaacgaaaattctagacctacagttactggctacttgcatttgtcagtttagagaaaaggtaaaatgaggcattttcaattgtagaatagactaacatttaccacagaagtgcttcagcattctaaatggattagatcactcattaagctatttttatatgccaatttactaatgccttacatcaatccactaataggttgttgggcccgcagtagagtccctatgcagtcccaattctgttttctgtaaccatgtgactggtgatgcagagtgataaccatgtctgcctatcttgtactagactcttcatgctgatcggatcttgcattgaaataaccatgtggaagaacaatgaatcgattaatgatgacatgtacaaccatatttaaagagcaatagtgtccgtgtgtcatgaaaaacttatttgtaaacgtttatatggtatgattttgattttatgtatgttcataaatcctgcactgtatgatatatgtgagttaaaacattggtgcatgaatttattttcaaagtataaaacacatcacttaaacattttatgtgtcaaataaaatttgattatgtaaacacatttgttgacttttgtttccacagtaaacaaacaaacagctgcaccatcagctgaaaaaaacccttctaaaagcacaagctaccattcgctggttgaagcagtttacccactgtgtgcatttttaatctgctgcaatttcatgaaatgaaaataccaaagcatattttaagtctataagctttattgatactttgcttttacagttcacaatgcattccacagatttagttcagtacagcttaaaccacaatggtataaatcttcattttgtaattaataatttcttgcataacaatgtttgatatttgcaaacaaacaacatttttggaagcattagattcagtccatagattctgtgacaaaattaactacagtcagtctgtgcaatgaaattgatgttggagttctatgtgtgtggcatttcatgttgaaaacagatggtagtgctcctagaaatatttcttcttctagcttatgtgctttggaactacacatgtataaccaatgactgactctgaaatatcaagcactgtggggtggctggaaggtaaaggtctaagctttgtgaaacactatacatatataatctatatttacttatattggcaattaatataacagtaaaagtcacaatacacctagaacataccagaaaagcaagctttgtcattcctgctttaccggtatgatctcgtctaaacaaacatttcatttcagaaaatctgcatcaatctacacggaccatacacagtgcacaaactgaaaagggcttttttttttttttttctagctccaccatctctgcaacttgccaagatgcggcaagactatctgcaacaaagtaaaatatacaggttttttattccaccagtgcctcagatagataggaaaaagatatgattacggtttaaatccatacatagcagcttacaatacttaagatgatgaacacatggcagtcaagacaggtaatttttcctcacaacagtgcatggctaaaaataaagatctaacaacgatctgtgaaactgcactgcaacgtcaaggttcgttcttccctgaccctcccccgtataatcaaatgaatatcccctttaaagatgaactcctactaattattttgggcgttttcattcagctttgcgcttcaatccagggatttttgcttggattctgaaaatgaaaaagtcaatgtaaatatcagttttgtttgctgctgcttaaaataccatcttccaagaactacttgtatgttattcagctaatacaataaatgaaatccttaaagctgcctaattctaagctataattttgccaccttggcctcatgaattagatttaaacaaagccttaaacacataataaacccagaaacgaatggtccaaatgttagaaaaacaatcttttggcaactctgaagtcacacttaaggtctgatagagatttgttactcattatgcctgcaatatgaaaatactgttctcacaatccagcacaccttatcctagtaaaaacactgcagattttaaatacttacttagccatagcatctttaacattcttatttgcaagtcctagataatgatctatctgtgcctgaaagagaggtataaaggaattattaccgttgctaaagaatcttattaaccactactatgtgtcaagctaaaggcttaagaaaccatcacacttctcatttttgtaagacattgaaaatgggcactaatacatccgtaaatcccatgtaatagagtgagtgctctattctgaagtcagcagttagttaggaaattacctgatgccgttcataaataacaggaacactgaagagtgaaatgagagctgaaaagggaaatatacaacttttcaaaaagaacggaatgatttgggaggaataaacactcaaaaaactattaaactggcaactcaagataaccaagcagtgttcctaatgaatgaataaaaacataaggatctctggatgcatctgctgttgaggagccactccagaggaatgaatgaactgtgtgaggctgcagttattagagctaggaaccatttctagcttcaaatcatatcacagtgagatttcataaaataaaggtatccctggttagatttatgactgcaccatcatataaagccaccctttatctggtttatcactgtttgttagtaggagctgtcttcagcaactaaggtagcatttcaataaaccgggaagcagtatcaccaacttatttaaagagaatacaacctcaaacttattttgagatggagtttcactcttgttgcccaacctggagtgcaatggcacgatctccgctcactgcaacctctgcctcttgggctcaagtgattctcctgcctcagcctccggagtagctgggattacaggcgtgcgccaccacgcccagctaattttttctatttttagtagaaatggggtttcaccatgttagccaggctggtctcgaactcctggccccaggtgatccgcccaccttggcctcccaaagtgctgggattacaggcatgagctaccgcgcccggcccacattttcatcccctacttttcatacaatgagaatattctccactaaaatgtctaagctcctggcacacaatctttccagcaatttttcatcccaatggctttgtagacttacccaaaatcagtagtgtcagaccattaaacaaggcaccaacataggtaaatacccacatcaacactgcaaactataagaaaataacattagcccattataaacaaaattcaagtaaagtttcttaattatgctttcaaaagcatcccatctaaatgcctacctacaaaaggcatacaacttgaagactgggtaaagtaccatgagcagttcactattaagtcacgagtctcaattatgaatttcaaaatcctaaaataattaatagatttgacccattttctctggactacactaccaagtagttgattctgctgagatcagacaatataccaagggtgcatcttacccctccagccctaacaacatttaccttttaaatgggaagactataaaggtgttatgagaattgtctattagaattgatttcaaagtatgaactagttgagtgcttgaagatatatgagctgaataattcagacattaatatctcagctgataagcaataattgggcaaagagtacttatcagggaaattacgtttcaggtaccaaaaatatcacctctagcctttgaaggatcaggcacaaagtcagtctgaattttgttaaacattggtcatcatcagttcctttgctttctaattcaaggccttcatgtgtatgtctggcaatcactttgacctacttagtaggtaacaaacatgatgccaccagctacagtgattatttaggcttatgtaacactataaatgaaaaggggagtagtagagcacccccattatctaaagcggggatcagcaaactttctctgtgaagagccagacagtagaattttaggttttatgggccacatagggtttgtgtctcatattattctgtgtcgttgtcataaccctttaaaaatgtacaccacccactcttagctcccacactatacaaaaacaggccgtggcccaaacaagcagtggtttgctaacccttgatctaaagcatatatctttctccatgtattaaacgaactctgactgaatgcttactgaccattaattaagcagtcaaacattagtaagcatatttattacagcttaggaagacactttggatgactctaccaagcaacagttctacaaatagcaacactctggtcaccctaactgaatttaactaatgttcaagtcagtaaatatcaggcattcttaatatctgtcaattgaaaaaaaatttttttaagctgccgtattcttagcaattgctattggaacccctggtagaaaggtttgaaggatgacttcagttagtaaggcttttctctcacagttttatagactcctattgctgaagctaaatataacttttgcacttgagcaagtttactatagagtaagagagttatttttatccatcactatccacaagtctaaagggaaaagtgttgaccttccatattttagaagaaattactctagcaacgaagatgcccttaacatgacagaagatagtaacaaacacaagctaaaataactcctcatttggtcattacagtcactgacaaggcttcactccaagtccacaggggaaaagcccaagacttcacacctgagccactgtaggggctcaaatgtcacttgcctctttgagaacacttcctaaaagccaggctatcccaagacaaagagaagaacacagggaggtctcaaatgtccttagggccaggcaggtgacatacatgtatgtgagaggctgggagagaactgaggcacacagtgatatgcattcttcctctcaaaggggcacttacaaccctgctccatacgctgtggccatgcaaatattccaggccagtgttgccagaaatgtacacttttgtgtgctatcatataatttttaaatgttgcagctatgttgagaaaactgaatacttcggcggcccaaaacagaaatagtggttaagtgtattcagggaacacaccaccaggagagaaaggggtggcagcaagaactaacctagagagtaaccattattaatgggaatccaccacaaatgatggatttgtaacatggcaggaataaggtcaataaacactttaaagaagcaaacaggctgctctcattttggacttaacaaattctacacgattccatggcaaatactttgcaacattatagccaatacttattaactgaagaggtcaaagcttatctctccattgcacagtatcgagactggaggaaggaggcctaaaatgtaatgaagatctaacaaatacttactgaaaaggggcaagggccacatctggtttatctttcttccagggcaataagagaattaaattcactgtgtataacacacctgattaaagagctctgcagatttgtgatgtttcaatttgggggaaggggtatctttaaggcaaacggtgggagagtgcttagtaagatctcagaaattactctggcagttctgaccatttcaaaactttcctgcactctcaaactctaaactctacttgcccttctgtgtctccttcagattcattcattagttggtagtttggactctctctatatccccagcccacttccttctaatttttctgagagctcaagaaacctgaaaggaagctgtcaaaatgtgaatgttaacagctgcctatgagcctgagagctagattttagtgttcttctgggtcagctatttctggagctcaggccgtttttttttttttcttcctctcactttcagatttaagattgtgttctggaacattatagttgcgcctcaattacagaaaagtaagaacctctgctgaaaatacctggtcttagtccctaaaaaagtaaaattattagacagctttttgggatttgaggtttcaaaagacaggaacctgctaagaaggctcagtcagactcaattagcccaaaagctgagcccagtaggcattgtcatatgcttttctttcataattgcgggtgggaagcgaggggagggaggatttatagtttaatgccacaactttttaaaacagtgatttttgccatactatttgactaggaaaatgatcgttgctcactctataaatacttgaaatcttttctaggacttagaagtttgtagttaattgcaaaggagcaaaacaaacggaatattacacaagaatttaaaaggagaactctgcagaacatgtcttatttttattcgcccaagtcaaccaccaggaaacttggaccaggcacacggatacccatcatttcacaccggtgtttataaaaggactaatgagccctggagtttggttatttttttgatcacattttgaaaggccaggctcctccttcactgcccccgccaaaaggcaataagcaaggaaaaggtttcacatgctagcaagagcggctctaaaatttcaatttctgaggaagatggtttcacatggaaatagtcataattgtaggctgggcatggtggctcacacctgtaatcccagcactctgggaggccaaggcaggcagatcacctgaggtcaggagttcgagaccagtctggccaacttggcaaaaccccatctcttctaaaaatacaaaaattagctgggcgtggtggcggacacctgtagtcccagctacttgggaggctgaagcaggagaatcacttgaacctggaaggcaaaggttgcagtgagcctaagatcgcaccaccgccctccagcctgggtgacacagcgagactctatctccaaaaaaaaaaaaaaaaaaaaaagagctagtgataattgtgacccagaatctaaaaatgtagatataaatttgagggcacacaacagattttgcatttatgaagacaatgagttatagagatacttctttcaaattgttgtttaaaaactattattttgtaaacacagagcttgataaaaatgtcttttctaaatgacaaaaatttagaaatgagagtaatttctactacattttcctgaaattaagatggtttccattttcctagctatgaatcatataaaatcaatgtaattccaataaaaagctacttcctataaattttaaaaaactcattgttatttaaataagaaaaaacattcatctcaactggagagactggagctattagcaaacttcccataaatttaaaatctgactgtaaggcattaaaataaatccgtttaaacaaggtaaatacatttttccttatgttgaaaaagtaaaaaaagaatgggaattggaaaaacattttttgcttgctttagggtgacagaatataactttccctaccagtttttgtggctaaaaggcaaaaagtaatacagtccactattaaggaacttaagattaagattttaataattttttttttttttttaaacagacagggtctcactctgttgccgtggctggaatgcagtggtatgattatggctcactgcatcctccacctcctgggctcaagaatcctcttgcctcagcctcccaagtagctgggactacaggcatgggcgaccatggctggctgatttttcagtttttttttttttatagaaacagtctcacaatgttgcctaggctggtctcaaactcctggcctcaagcaatccttccgccttggcctcccaaagtgctgggattacaggcgtgagctactgtgcatggccaggaaaaccttcttctttttaaaatgctctctatataaacaaaaactgtggtggataagtgtggccatacacagaagtctctctagaaaggtaatcctatcaagcgtttttataaaaaagcaaagtgatttttatcagcttccttttttcaataaaagctgttttaaggaagtattcagtatttctgtatattcaatggaaacaaacacatggaatctgtactactcatatacaatgacattaggaaagggtttagctaaattcttgtgtggcaaaatcacaaggtttatcgtttatcaaggaagacctttcatgtacattatcagagtgtgcacctgaattaccaagggctttacctttcatggggagaaaaggacagattccctgccttattcatttgcctctagattttgagatctaaatgccaggttcactttaagtgctaacatgatgaggcaactgttacttatttgcagtcctaaatgaattgccagctggggaagtcaccaagcaggtttccttgagctctgggcttgccaaaaacacaactcagggaaaccaatcaagtacgtttttcttctcttctctttttaaaaggattgctaatccttaaggataaattataattttaatgaaagtcctttttttcaatactaagaaacaacaagtgttccagaaaggaaatctgtctcatcatgtgttactttctgttactttcaaattagcagtcactcaatgcaagaacttatcaagttcgatttctctcatttatgctagcttcctcatgaataacataattgcttttacaaaaaaatgtagttttcaaaagaaattaaaatataagatttaacaaagaaattatttctcaaaactttttttaaaaagtcctcatattcgattctcaaatacgtgtgcaaaacagagatttaaaatgtttcttaagatctcatcagcccctttctaacattttctctctcctcttgccccgtatctacacaatggactgtgtatggatgaaaattttctctgaaagaataaataagttttcttttgattaaagacaagtggaaactttatactcaaactcagaaaactagagcataatgaatcattcccagatcaattttaaaaatagatttattcaagaatgacatttctctcaagaaaaatgttaaattgtagacatatagctgccttcactgctatactgtgcaaacatcgaggatgacttttggtgtatctctgttgccgtgtttattgaatctataaaaacaacaagcatctctcctctcccctaagctcaccaggcttttctttgaagtcacctctctcccccaccaatctttgactactaaattcagagatggtcctttgctgtttgaagctctgaattactacttacagacagtatttcttctcagtcaattcctacccacaaaccatccatcttaagcggcatcagtacctcctcctcaatcacttttcacacatgttctaccctagaagtcagctacgtatagaaggtaataatacatgaataggaactggtttcctctaggctgtatgtacaaggttctatttcatttgctccaaaatatttttagttgatctcttttgaaacttattaaccaagcatgccaaacaacataaccgtaatctttttatttacagactaacatcagatcattttaaaacaccactacagatttagtcactaaatgcaaccactctatacgaaagaggtaagtaataaaaggaaactacattatttacccttgatgttattaggaagtaacttaagttccaagtcataaataaaaataagagatgcggctgggcgcagtggctcatacctgtaagcccagagacgcaaacagctgaaaataacgtatcaactactaggttataaaggctaaaatgtttttgttttttttttttaaaaagcactttaagcacttaaacctattctgaccagttcagaaattgtttttctgagtctaaaggcccagtcaccttattactactatatccttggcatgtgtgataaatataaactagaacatttctcttggaaatgaaaaatgaaaaattatgagaattaccaccactacatttctgcccaggcttagattggaaacaagtctgcctgttttctgcagagtcacaggaaagagcatatacaacacaaatgacaagttctatgaaaaagaaaagcactacaggtccagtgcttcaggcttaaattacacaactgtggtttagtgcctgtttcgtcagtcagaactttgggagagtttatttgcaaggtgagactcttaacagctgcttatgtagcgagatccaaaaactaaagaaaaacttccaatgattaccagttgaagattagttgaagtgtttcagaatattaaatcttatctagaataagaaagagtccaagatatgaaatagctttcatgtacataagtgctagactgtaaagcaaagtcagaatgaataaatctgataatgcattagacgatctttatgcttatagtcaaaattccgattaatttcctttccttttaatctttatgatttccgaaagtattactatatatatatataatttttttttgagacagagtttcactcttgttgcccaggctggaatgcaatggcgtg

SEQ ID NO: 1215 - DNA, 29524 bp, Homo sapiens
tttgttcagtatcttttttccccatagactgaaagttccctgggagcacaaatcacatgtcttttgtgtactgcagtatgcccacccccacttaccaaagtgcctgagacatagtaggcctttaataattgttgaatgaataaattaatgtcctcctgataggcatacttgatggtgaaactagacatcagagcctgatgcaagtaaatatttaagtcagttatatagtttggctgtgtccccacccaaatctcatcttgaactgtggttcccataatccctacatgtcgtgggaaggacccagaaggaggtgattgaatcatgggggcagtgaccctcatgctgttcttgtgatagtgagtggattattttcccgggctttgctcagcacttcttgctgccgccatgtgaagaaggacacctttgtttccccttctgtcatgattgtaagtttcctgaggcctcgccagccatactggaactgagttaattatacttctttcctttataaattacacagtcttgggtacgtctttattaccaacatgagaatggactaatatagtcagcttgtttagacccctctggctgggattctaggctcaccaaccagctttttgataatttgccttttcttttcttttcttttcttttttttttttttgagacagagtctcgctctgtcaccaggctggagtgcagtggcatgatctcagctcactgcaacctccgcctcccgggttcaagtgattctcctgcctcagcctccagagaaggtgggactacaggcgcgcaccaccatgcctagggaatttttgtatttttagtagagacggggtttcaccatgttggccagaacggtcttgatctcttgacctcataatctgtccaccttggcctcccaaagggctgggattacaggcatgagccaccacactggccgataatttgccttttcatttttaatttaaatagcctcaggtcccacagaggctgtaattgagctttaacacgcaaattcctgatatgttggctctcttagagagccacaggcctcagctcctgaaggatccccaactacttctcagggtccacttctccacccagccctctgctcctctggaaagatgtatgtctccagggtctctcctctggctttcccaaatgataaagccctcaaggatccacttaatgctctgtccctttcatcctcactatgctacaggtttgtcctaggaccgtttttgttccaaaaactcaattcaagctagttgaccacaaagaagacctggttaattctcataaccctggatgcgccagggccaaaccttaaggaaaactgtaatcgagaacctctaagctatccggctcctgccctctgtctctcgtctcagctgctctcctcctgttggcttcatcttctcttttttcagacaacttctctccatgttatatttggggatgtagctgctgcagttccaaggttttgtgcccaagtcccacatcccagacaggaaagagccttcctccacaggtctatttagaaaaatctgagggaaggtcattaattgatcagtcacatgcccagcttgggttacctctcagtcccgtgtggccaagggtgtggactcacaggtttggaaaggtgaggaagagtttcccgtaggaagggaggagggaggtgcagtaccagcagaagagaaaagatgtgaggcagtgttagcagatgcccactacactatcgttcatgcagaaataatgagattgcctttatgacttgaattgtgtcccccaaaaagatacgtttaggccatgtgtggtggcttacacctgtaatcccagcactttgggaggccaaggcaggaacatcacttgagcctaggagttcgagaccagcctaggcaacatggtgagacccccgtctctacaaaaaatttaaaaatgagctgggtgtggtggcaggagcccatggtcccagctactcaggaggctaaggagggaggatcacgcattcagaaggtcgagactgcagtgagccatgattttaccactacactgtagcctgggtaatagagtgagactctgtctcaaaaaaataataataataaaataaaacatatgttaactttgctgctaattagtttaagattctgaatttgcaaaggcaaagaccaaccttcctgggcctgtctggaggtgtctaacagaaagctggatgactagatgatagctgtctccatgatatcagcttgttcctttccatggataaaatggattcaggggccgggcgaggtggcttatgcctgtaatcccagctactcgggaggctaaggtatgagaatcgcttgaacccgggaggcagaggtttcagtgagctgagatggtaccactgcactccagcctgggagacggagcaaggcattgtctcaaaaataaaaaaataaaaaataaaacaggctgggcacggtggctcacacctgtaatcccagcactttgggaggctgaggcaggcagatcgtgaggtcaggagttcaagaccagcctggccaaaatggcgaaaccctgtctctactaaaaatacaaaaattagctgggcgtggtggcgggcgcccgtaatcccagctactcggcaggctgaggcaggagaattgcttgaacctgggagacagaggtttcggtaagccgagatcctgccactgcactccagcctggcaacagagcgagactctgtctcaaaaaataaaataaaataaaataaaatggattcaggtgataacactctttcctgcctacggaccctgtccctctatcctaagaggtgtcctctgattgaggattaggactaaacatggctgtttcccacttcatccctcatggctgctgtaatttttattttatctttatttttatcctacagaaagtaaaatactcccaatagattaactctactattacgtagttgtttcttcaaatgcccaagaatacttgtccttgggtataatttttttgtacccctaagtagttatgagtgtctgtttgtgtgcatggatgctttgcttcaaatgagttgcttttacaatgtgataaccttgtgccatatgttgggcaactatcttggccataattcacaggcaactgacacattaatagattctctgcccgttctcattgtggagattctgtgttagtggcctttgtcttccatggaactgacagaggggcaggattagctcactgacgctcggaacacaagtgacgagggatttcatgaaaacaaagccaaacaaacgaggcagcttccacgggcacctggctgaataaattaaacttgattgaatcctctattgtaatgacgacagaaaaggaggtaaaatatgccttccctaatgagtttctttacagtcatttactatttaaaacttgctattccaggaaagcagcaatcgcgtaagactgctttgactgggtcttgaaggctctgtaaaatctgtgggctcacagaaggattttgcatacttcctgcaagcatagttactggacaatgttgcttcaaagccaagctagcaagggaaccctatactctcttcctcttggcctgccctaggttctgagtggtcacatgaagatggcctcaaagcagaagaaactaaatgtgccaagcagggaaaagtctgaatcgaagtaacagtctaaaaaaggctataaaaataggaacaatgtaggtgcagcttttacatgaaagaggaagaaacagcaccaagatttactaataagcttggcacagagaaacactgctggccaggtgtggtggttcacagctgtaatcacaacactttgggaggtcgaagcaggaggatcatttgaggccaggagttcgagaccagcctgggcaatataatgagactggcccatcactacttaaaatgtaaacatttagctggggatggtggtgtgctcctctagtcccagctactggggaggctgaggcaggaggaccacttgaaccccagaagtcaaggctgcagtgagctaagatcatgctactgcactccatcctgggtgacagagcaagaaccctgtctctaaggaaaaaaatagaaactgctgtcattgaatttaacattatctatgggtctttagtttgtcatgaattgtcatcagcagtcagcatgagatacccaaatacaaaagtacaaaggaaaaaatacttttcactttgtaaaactgaacgcacacagcattacaaaagtgccctttgagggccgggtgcagtggctcacgcctgtaatcccagcactttgggaggccgaggtgggcgaaccacgaagtcaggagttcgagaccagcctggcgagggtggtgaaacccctctctactaaaaatacaaaaattagccgggcgtggtggtgcgcacctgtagtcccagctactcgggaggctgaggcaggagaatcacttgaacctgggagacggaggttgctgtgagccgaaatcgcaccactgcactccagcatgggcaacagagcgagacatcacctcaacaacaaaaaaaagagtgccctttggaaaggtgaatgtctgcatagtgtgagtttaatggagtcacatttgtctaaatagaaattcctctcaacctgtcattgcactctcttgccactgtgaacgtccaccaatagtgtcccatttgaaatatacaaaggcagtaacgtaggccccagaaaaatagggttaaaatatactgggattaaaatgttgccgaggagtcaaatgggtaactgaggttagcgttgacccattagtacatgttaggcagagaattagctattcaccttggtgtagaattgatgtttgatttctttgtgggatcagagggcccacccctaacaggaagtgaccaagggtcatgtagagtagaataaacaaagcatgtgaaacagcatgagaggcacagagaggcagcgtgtgtggtgagaacacttactgaacacattacagaaaattattattactgccgcttcctaagctgtaaacttttccaataaattaactaagttttataagcctcagtgtcctcatctgtaaaactagggtcaccatagcactgtcttgagattgttgtggaagctaaatacaaaatatattactgagctattttgccattgaaagtaatggcaaaatccacacttttggaccaacctaaatatataaacatgagcatacaagacctggaatgcactttaaaatgtgtactgccaaagctgggcacagtggcacgtgtctgtagtcccatctgcttgaaaggctgaggtcggaggatcgcaggaacccaggagttctgggcagcagtgaacagtgactgcgattgtgagtagccttcactacggccgggcaacgtaacaggattctgcctctaaagaataataaacataaaattaacttcctacccactgtctttcagggcaagccataactgtgaagggaaacaagttaaggaggacaactgactgcctaaggaaggttctggagtgtggacaaaggtggagatggctacttccactgattaataaaagccttctaggccaggcgcggtggctcatgcctgtaatcccagcactttgggaggctgaggcaggcggatcacctgaggtcaggagttcaagaccagcctgaccaacatggagaaaccccgtctctactaaaaatacaaaattagccgggtatggtggcacatgcctgtaatcccagctactagagaggctgaggcaggagaatcactttaacctgggaggtggaggttgtggtgagctgagatcacgccattgcactccagcctgggcaacaagagcgaaactccgtctcaaaaaataaataaataaaataaaataaataaaataaaataaaagccttcttcatgtcactattataaacagtacaaaccctcagctgctacttttggcaaactttttttttttttttttcctgagatggagtctccctccgtcacccaggactgagactggcccaatcttgcctcactacaacctccatcttccaggttcaagtgattatcctacctcagcctcccgagtagctgggattacaggtgcacgccaccacacccagctaatttttgtatttttagtagagacagggttttgccatgttggccaagctggtcttgaactcctgatctcaggtgatctgcccacctcggcctcccaaagtgctgggattacaggcgtgaaccaccatgcccggccttggcaaacttttgtaaagggtcagatagtaaatattttaagctttgcagtaaatatttttactcactattgcaactactcatgccagacattgtagcaaaataaaaagcatttcataggcaatatataatatataatgcatgagcatggcagtgctccaaaaaaacttttttttttggagacagggtcttgctctgtctcccaggctggagtgcagttgtgagaccatggcccactgcagtcttgacctcctgggctcaagcaattctcctgcctcaggtcccagaatagctgggactacaggctgcgccagcacaccccactaaattttgtatttttagtagagacagggttcagccatgttgcccaggctggtctggagctcctgggttcaagcaacccacccatctcagcctctcaaagtgctgggattatagtcgtgaaccactacgcccggccattttttttttcttttcagataggatcttgctctgtttctcctgctggaatgcagtggcacaatcatggctcactgtagcctcgacatcccagactcaagtaattcacttcagcttccagagtaggtgggacaacaggcgtgcccactgagcctggctaattttatttttgtagagatggggtctcactatgttgccaaggcaggacttgaactcctgggctcaagtaattctcctgcctgggactcctgaagtgctgggattacaggtgtgagccactgcaccctgcctccaataaaacttaataaatactaacagttacttccccaagcattgaaaactcttctacaacatgagttttaatgatggcataacagtccatatagattttcatgatttatttaacaaagtctttaatgttggacatttagtttctctttatttgcttacctcaatcggtactcataattattttgtaacaatttcttttttttagacggaatctcgctctgtcacccaggctggagtgcattggcgagatctcagctcactggaacctctgcctcccgggtacaagcgattctcctgcctcagcctcctgaacagctgggactacaggtgcccgccaccacgcccagctaatttttgtatttttagtagagatggggtttcaccatattggtcaggctggtcttgaactcctgaccttgtgatctgcccgcctcggccacccaaagtgctgggattacaggggtgagccaccatgcccagcctatagaaattatttttaaagtcgggatgagaaaaaaaaaaaaaagaaaaaagaaagtggggataagaaaaagaaaaattgctcatagaccatttattcagagattataactgccctcctcattattatatatgcttttcaggcttatgattacctttattatttatttatttatttatattttttagacagagtcttgctctgtcatcacccatgctggagtgcagtggtgcgatctcagctcactgcaacctccacctcccaggttcaagtgattctcctgcctccgcctcccgagtagctcacattataggcacgtgccacaatacctagctaatttttggttttgtgtgtgtgtgtgtgtgtgtgtttgtttttgtttttttttttttttgacggagtctcgctctgtcgcccaggctgtagtgcagtggcatgatcttggctcactacaacctccacctctggggttcaagcaattctcctgcctcagcctcctgagtagctgggattataggcatgtgtcaccatgcatggctaatttttgtatttttagtagagatggggtttgaccatgttggtcaggctggtctcaaactcctgacctcgtgatcgcccacctcggcctcccaaagtgctgggattacaggcatgagccaccacgcccggcctaatttttgtatttttaatagagacaggctttgccatgttggccaggctgtattatcacctttaaataaagctggggttacactgtacatcctatattgtaacctgaattttcacttcaccacagtaatgaaggtcttctccccttctgaggtcctaaacttagaattgctggtctctgacttccattattctagttttacttctgtcttcccactgtctcacatctactcccataagggagaccacactgaccatctgctcctcttggcattatatttcttactataaaactacacattggcacctggcttgcacatctgtctcttaggagtttggttactgttagctctgtgagcctgagtgatcacctcaactatcctagcaaaataggagagttggggccctccaaagctgagaatttgggcattatgacctaaataaagcaacacaatactgtctgagcaactagtcaaacccaaccagcctccttctctgacaactttattttgctttctttaagtgccataccaattattataagtgatgactagtatttatcattttaaatggcaaacaaccctaaatggcttggtggagggcaagttcagacattgtcctggagactggctgagagtagaagcccctctgcagtgttctttgaagtgctgattttagttatataaaatgctaaattgcctctcccactgtcagaatagccttttatttatttatttatttatttatttatttttgagacggagactcgctctgtcccccaggctggagtgcagtggcaccatcttggctcacagcaagctccgcttcccaagttcacaccattctcctgcctcagcctcccaagtagctgggactacaggcgcccgtcaccacgcctggctaatttttttttttttttttgtatttttagtagagacagggtttcaccatgttagccaggatggtcttgatctcctgacctcgtgatccgcccgcctcagcctcccaaagtgctgggattacaggcgtgagccactgtgcccagcccaaaatagccttttatacctcttcctgtttatgttatcaagaagttagtatgtagacttcagaactcaattttgatctgctcttgattaaaccttggtttacagaactacggtagtttttcacattgtagagaaaaagttgaactattttaataatggattttctgtgtgtatagaaactcctacaattgatttaaattttttttttttttgagacagattcttgctttgtcgcccaggctggagtgatctcggctcactgcaacctccacctcctggattcaagcaattctcctgcctcagcctcccaagtagctggaattacaggcacccgccaccacactaatttttgtagtttttagtagagatggggtttcaccatgttgcccaaggctggtgtccaactcctgacctcaagtgatctaccctcctcggcctcccaaagtgctgggattacaggcgtgagccaccacgcccaaccttgagttaaatttctaaaaatctcaacataatgtgtttggctcctcttcttattatgcttagagttaggcactagcacatactagacctaaacttgactgatttgaaaagaccactgaaatccatgatttgctgcggatcctctgtgtctgctgtggccaatataaagaaacttggatgcacttaatttatgaagacaagctttgttgatctggaagttgaatgataaatgtgaatccaatgacgccatacccctgcggataatggcaggctggatgtagcatgttagccgtcatattctgtgtgctccctgcgatgtgggcacttcccttccatcgtggtgaggccaaagcaaaggcacagagacctgaacacaaacatgaaaaacaccttaccacctgggagtcaggggcaggttcaggcacatccattcctctggcatttgagcagctgttttccacagcattaactcagcacggcagggtaagtcagattaaaaaccaataaaagagtagtatcctcataccaccctcaacgtcttcctgcttcaccaaaaaaccaataaaagactgaatgtggccctttatcagctagacctcaaaatcttctttgctttctatgcgtatttccaataaaaaagtacaagggttgttaaaagtccttatttatttatttatttatttatttatttatttatttatttttagaaccagggtctcactctgttgcccaggctggagttcagtggtgcagtcatagctcagtgcagcctccaactcctgagctcaagtgatcctcccacttcagcctccagagaagttgggactacaggtgcatgctaccacgccaggctaatgcttttggttttttaagagttttgttgagtcagggtcttgctatgttgcccaggctggtctcaaattcctagcttcaagcagtcctcctccctcagcctcccaaagggttggtattacaggcatgaaccactgtgcctggccttaaagtccttttgaaacacaagacaagaaacatttggccgcgcacagtggctcatgcctgtaatcccagcactttgggaggccaaggcaggtagatcatgaggtcaggagttcaagaccagcctggccaagatggtgaaaccccatctctactaaaaatacaaaaaattagctgggcatggtggcacgtgactgtaatcccaactactcagaaggctgaggcagagaattgcttaaaacccaggaggtggaggttgcagtgagccaagatctcgccactgcactccagcctgggcaacagagcaagactctgtctcgaaaaaattaaaaataaaaatacaaaaattagctgggcatagtggcacgtgcctgtcatcccacctactcaggaggctggggcaggcgaatcgcttgaacccgggaggcggaggttgcggtgagccaagatcgcgccattgcacgccagcctgggcaacagagcgaaactcagtctcaaaaaaaaaaaaaaaggaaacatttattgaacacctagtacattccatgcactgtagtgtgtgtggttttatttaatttcatctctgcccaaccctgggaaacggtctattagcagacgcagaggataaggcacaggacgatcaggtaacacacccagggccaaatatcataaatggcagaattcaaattaaagccaccttccaagccatgtccctcccatcgtcacaatactgcatgtctacagcacagttgatgggcataacccttcttagcaacagcaagcagctgagcagaaagtaattgcaggaggcagagccaagaggaaaactgctgagagtgctgacggtaggtggagagaacagaagcacacaccgtagggtgcaatcttagtgagctttgttttccttcaatagaggtgagttcagacccaggcatgtctctccaacattcatttcccctgcttcggcaccatagacttgaaggattggactcaggagttggggaggacacgggggaagttgctttcctggtgctgaggcccccggccaccgtggtagtgtacagcaagtacagggtaacagaagggccagcaggaggacacggcgcaatggtgtaccgagggacaggagagtgaatcagagccacaggacagagctccacctgtttccagggaagtgcatggggggctcccggaagccaaaggcagcgcccagaggcagtgtgaagaggccttcctcagacctcagggtttcggcagggatagtgggtgacctgtgtgctggctctccagaaactgaaagcagcaagagacacttgggctccttttttagtttttctggtttgttttgttttgtttttttgcaggcactcggtggttagctggaaataaaggtggaggaactgggcagttcaaaggcagagacggcttcccccacccccacctcacctcccctttcattcagaaaagccacaaaagcgtggccccagggtgtgtgtgaaaggagggaggagtgactccacctagctcctctggagtaaagagaggctgtgggcctggtgtcgtgcgtgcatgcctgcatgtgcctgtgtgtgtgcatgcttgcctggtgctcaagggtcaggggaagctggctgagaagactgaggagatggagggaggtggagggaagtgtaatagaaggaggtggaggaaggtggctgccatagagctttggctctggctggcctgagtctcttcctgaagttgcagctgcactttggggccaggcgctgttgacactgtgggtataaacatgtggccagcagcagaatagagactcagagtcttgagaaagaaagtggtgacttcccactcctccttccttctttcctgtacagagtctgccatctgggggcagagatatgggcaagccctcattataatactagcagtgaagggctgggcatgacaggtggaaacaccactgactctagaactcagagcatggaatttggtatggtggcaggcaggggtccagaggtagtatttgttatctattgctgtgtaacgaattagcttaaggtatagcagttcaagagaagaaatgtttattatctcacaatttctttgggtcagaaatacaggtgtggtttagctgaatgctttctggctgaaggtgtttcaggacgttacagtcatgccaccagctggggctgccaactcatctgaaggctcaacacagggggaccggagtccaagctccctcacatggtcaccagcaggattcagttcctcgaaggctgtcatttagaggcctccctccgtccctccttacaggtccttctcacagggcacttcgtgacatggcagctgactttctggggaccatccaagtgagaaagagcccttagaaagaagtgacagtctttatataacctaatctcagaagtgacaactcatcccttctacaaggttctattattcaaaattgcatctgtaaatccagctcactcaagggaaagggattactaggagataggggtcactgggggccattctagaggctccctgtcacagcatccaagctgagacctacagaatgacaggagttcaccaggcagggaggcaggagggagttgggggacggcaggtgcagtgaaccatggttgtaactcagtatggctgcacagagagcactgcctgagggtgagcagtgctgtggagaggccagcagggcccagaacttgtaccatcttttaacccaggtttgtaagggtggactttatcctgcaagcatgaagatcctaaagcttgaggctaacggttaagatttggctttagaaagattacactgctggcccagctcagtggctcacgcctgtaatcccagcattttgggaggctgaggtgggcggatcacctgaggtcaggagttcgagaccagcctggccaacatggtgaaaccctggttctcctaaaaatacaaaaaaattagctgggcatggtggtgggtgcttgtaatcccagctatgcgggaggctgaggcaggagaatcgcctgaacccgggaggtggaggaggttgcagtgagccaagatggcaccgctgcactccagcctgggtgacagagtgagactgtatctgaaagaaaggaaagggaaaaaaaagaaagaaaaaaaaaagaaaagaaaagaaggaaggttatcactgctgtggggagaatggattgaagagagtaaaagagcagaggaaggccagctggcgggtgcggcaggtggggggattgaactgaggtgctggagaggctgaatggctggcagcagcgctgctgcagagctggcgtccctgggtgtaggaactgactgcttatgtccgtcttcctcctctggaacataagctcaatgaggacagggattcttgtttgtagtctctggtatccccagcgtttaggacagtggcactagatgaatgactaggacaccccaaggtttctggcttgagtaactgggtggagctattctctaagctgtgaggcacagagggcaaacatggacagaaacttaatatttgagaaatactgagtttgaggtgctttgtaggccatctgagaataaatgcctcgtaggcagttgacatgcggggatctggaaagcctcttaaagaaatggtgagagatggagacttgaaaatccaagcacctagacgcccgtgatgggagtagttaacatggccctgggaccctttcccagagtttctaggacaccttacgcagcaacagtgcttgctttgaaagatagtaaaggaagaaagtcttgccaattgtcattcacaaaagaaagtcaaaaatatgttgccagagaggacaggagaaagccaggaatcacgggaagccagaagagagcttcgagtactatgagaacagcacagtaggttaggtaaggactgaaaggaggccggtgagttgaagcccactgtgggtggggaggaaggagaaaaggaatgttttccagaaatgcaaagcattacttaatatttattttattttatttttttgagatggagtctggctctgttgcccaggctggagtgcagtggcacgatctctgctcactgcaacctctgcctcccgggttcaagtgattctcctgcctcagcctccagagtagctgggattacaggcgcccaccaacatggctggctaatttttgtatttttagtagagatggggtttcaccgtattagccaggctggtctcgaactcctgaccttgtgatccacctgcctcagcctcccaaagtgctgggattacaggcgtgagccaccatacccggcctattttatattatatttattttattttatattttttgctctgttgctcaggccgaagtgcagtggtacaatcatggctcactacagcctccacctcctgattctcaagcaatcctcccaccccagcctcccagagtgctgagattacaggtgtgagccaccacacctggcctccattacttaaaaatgttttaaaggctggacacagtggctcacgcctctaatcccagcactttgggaggctgaggcaggaggatcacctgcagtcaggagtttgagagcagcctggccagcatggtgaaaccccgtctctactaaaaaatacaaaaattagctgggcgtggtggtgggtgcctgtaaacccagctacttgggaggctgagtctggagaattgtttgaacctgggaggcagaggttgcaatgagtggagatcatgccattgcactccagcctgggcaacagagtgaaactccgcctcaaaaaaaaaaaaaattaaaactgtcacttccaaacaccattaaaaaacaaagtgcctgattcggccgtacatgtactaaaattggaacactggaacggtaacagagaagattagcatggctcctgcacaaagatgacacgcaaattcatcaagcattccttttttttttttttttggagacagtgtttcactcctatcaccaaggctggactacagtggcgtgatctcagctcactgcaacctccacctcccgggctcaatggattcttctgcctcagcctctggagtagctgggactataggcatgcaccactgtgcccggctaatttttgtatttttggtagagacggggtttcactatgttacccaggctggtttcaaactactgagctcaagcgatccacccgcctcagtctcctaaagtgctgggattacaggcgcgagccactgtgcccagcctcatactttttatattcattttgaaaaaaaccaaacatacaaaatatagataagcatttagatcacaagttccccaaactggtctttgtagcagcaatttaggaatcacctgggtggtttttaaaaatacatattctgccgggcacggtggctcactttgggaggccgaggcgggcggatcatgaggtcaggagatcgagaccatcctggccaacacggtgaaaccccatctctactaaaaatacaaaaaaattagccgggcatggtggcgggcgcctgtaatcccagctactcgggagactgaggcaggagaatgtcatgaatccaggaggcagagcttgcagtgagcggagatcgagccactgcactccagcctgggcgacaagtgagactctgtctcaaaaaaacaaaacaaaacaaaaaaaaaccagattctgggtttgccccaattccataaaattaacctctcaagggtgaagcaggagaaactattttttaatgtgccaagtgactttgaagtgtgacaagctttttaaacattttatttggagttttctgcttttattatttttaattgacacataataattgtatatatttatgcggtaccatgtgagattttgatataggcatacaatgtgtaatgatctaatcagggtaattaacatatccatcacctcaaagagttttgacatcactcatttaaacctctaagaaatacttttcagctgggcgcagtagctcacgcctgtaaccccagcactttgggaggccgaggcgggtggatcacctgaggtcaggagttcgaaaccagcctgaccaacatggagaaaccccatctctactaaaaatacaaaattagccaggcatggtggcacatgcctgtaagcccagctactcgaaaggctgaggcaggagaatcacttgaacccgggaggcagaggttgcggtgagccgagattgcgccattgcactccagcctgggcaacaagagcaaaactccttggccgggtgcggtggctcacgcctgtaatcccagcactttgggagaccgaggcgggcggatcacctgaggtcaggagttcgagaccagcctgaccaacacggtgaaaccccatctctactaaaaatacaaaattagccggtcatggtggcacatgcctgtaatcccagctacttgggaggctgaggcaggaaaattgcttgaacccgggaggcggaggttgcagtgagctgagatcgcaccactgcactctagcctgggtgacagagcgagactccatctcaaaaacaaaacaaaacagaaaacaagagcaaaactccgtctcaaaaaaaaaaaaagaaatactcatttttctttgactttaagcccttttagaataaataaagcggtacaaaatattcatagattactaaactgttagaagccaattgttaaatttaagactttaatagggaacttaaagcaatcaagaaaataaactctccacaaagttttaaaaaacaactataaaatacatcctgtaggccgggtacagtggctcaatcccagcactttgggagaccgaggcaggcggatcacctgaggtcaggagttcgagaccagcttgaccaatatggagaaatcccttctctactaaaaatacaaaattagccaggtgtggtggcgcatgcctgtaatcccagctactcgggaagctgaggcaggagaatcacttgaacccaggagatggaggttgcggtgagctgagattgtaccactgcattccagcctgggcaacaagagcgaaattctgtctcaaaaaaaaaaaaaaaaaatcctgtaggtttgttatcaagaaaatgctgatgactataattaggattataaatttagttgagagtgagagctagattagtaaataaaattgtctataaacatttgtaaatcagtcatcctcctgggtacggtttgtaaaagaacccagtgcttaagtgaagagcagggacagctcctggctctggatgggggagaagtcttccttgtttcatagtcaaggaaagctcccagctgaccatcaccctcttctcttggaaaacgccacacctaccttcttgccattcctagagcgattttccagcctgagtggtatgactgcttccatttcctcgccactcttgtttgtccctggcagttcactttgattctcaaaagtccattaaaaccccttccaggtcctccgggatccctggccatgtaagctctgccaccaacagcagcctttctagtacaaagtctctagagctttccacagcctctggcttggtctctccctctccaggctggccacaggcccccagggacctatctgccatctcttggaaatatctttctaaattccccactccccctcctgcctttccacgactttgagttgcaatagtttgcccagttccccttttccttgtagtctttaaagataagtccacaggtttttcatttgtttataagatttactctccatcaggaaatgaaaataaacatagggaagctgataagtcacagctccccacccccagccgttgttccggggaagcctctctagcaaggctcagatgtttccatcttaaggttaaatcacaccaaacaatagaagccctttggtttcacctcagtgggcgggatgtgcctcctttcatggatctcctgccccacacaggatttctctggactccttagagtgtttcttcaaaactagttcaatctcgatctaattagtccccaaagagatgcaaaccaaacgagatgcgatttttgttctattaggagggcacaaaaataaaaaataaaaattaagcctgataatagcctgtttgggccagcttgctgggaagcggactcatttttatactgctggaggggttcggaatcaagaatcttaaatatgtgcatccccttcaatccagtaatcccacttctaggaaaatatcctgaggagataatcaagatgtgcagtcaagaatttatgaacaaaagatactcactgcagagccataattgagaagaactggaaaggacttaacatgcctcccaggtggggcttggctctgcaaatcctcatctgactctatgatggaatgggatgcatccggtcatgcagtcatccgtgcgacaaatagttcttcagtacctactctgcgttaggtaaacaatgcagagtattgttaacttggctgggtaaacaggtaagttctcagcccccctggaaaatccatgatctcctaaagtaaagcaatttaaaattgttcacattatttgtgtgtgagtgtgagggggcgctttatcaccctccacctctcatccccccaccacaagcagttgccaaattcaaataatttttccttcaatgcctctcccgtgtgaccgctccttttctttcaaaagtaaatcctatgtctgggaggtaacccgatcaccgcggaaagaacgccgacatggaaatcttaggattggtttctcgttccaggaagttgcgctactttgggcaaatcacgtcacctctgggactgtttctaatcagaataaagaaagggctggaccaatctttcagatcctttgaatccaatcatttttggccttatgacggaaccgtctgtagatgagggcatctgaatcctagttaaagggaagggacggtgaagcccttgaagatctggggcatatttcctgaacaccaaaacgggaaagggctgtctagagtgaaagtataagacagacaggccctgttccaggaagctccctgcactctgctcttctcctcaagccgaccccaaactcacagccagctttagcaagcaggcccgtcatccttccaggtgctatgtaatattaagaagcagcagctaacaattattagtgctactaggggcaggagatttgcagttccctcgctttcacacaaaagtatgaggtctgttttattattcccactctaaaggcaaaatggaagctcacggagattacagaacttatgggaagtgacagggctatttgccacgtttatactggccagtcttcctctttttctcaaagggtggggtgggagagcagcctcccgtgttatcaccctctcctgcggcagaagacagaagcataggtcattttggtagtacgggtttgttgattaccaactgggagacagaggtgaggtaaatcacaagcatggatgttagcagggctgcagaagtttataaataaatgatcttagaatctccagcagccccattctttcatttggtaaccggcctcctccctgccctcatccctgtagcgcccttcccccatgagggtgaagggtcagctctaaaaatgcagtcaggaaggaacaatgagagtcctctccccgcctgggagaaatgcaatttgcatctcagatgagctcagattggtgaagcctcgtttggactctgatccttgcagtaaggatctgctctgggaatctcctgtgacctgttgaggtttgctgctccaaaggaataaggagtctttgacattaatgtccatttaactcagggatctaaaaaggcaggttagtgttagagttctataggcaccccagaattgtacctaagagtgtgtgtgtgcgtgcatatgtgtgttttcctggggatggtgtagctttccttagattgtcaaaggaatttatagctgcccaaaggttaaaaacttgtgtgacaagtgagtgtgataaaggaggaacagtggtgcagatcctgtgggaggggagaatgacttaacaaacccagaggtgggggtgggagggaaagaattcaggtgagactgcactcagaggtaggattcctttttcttttttgtaggtaacattttttgttttcttactgtgtgccaggcattgttctaaactaaatatacaaggccaggcgcagtggctcactcctgtaatcccagcactttgggaagccgaggtgggtgggtcacttgaggtcaggagttcgagaccagtctggtcaacatagtgaaaccccggctctactaaaaatagaaaaattaaccaggtggctcgtgcctgtagtcccagctgctcgggaggctgagagaggagaatctcttgaaccccggaggaggatgttgcagtgagctgagattgcaccactgcactccagcctaggcaactgagaagactctgtctcaaaaaaaaaaaaaaaaaaaaaaaaaagacaaatacgtaaactaaaatctatgagaattaggtaattctctctcttttttttttttttgccagagttttgctcttgtcgcccaggctggagtgcagtggtgtgatcttggcttaccgcaacctccgcctcccgggttcaagtgattctcctgcctcagcctcccaagtagctggaattacaggtgcgcaccactaggcccggctgatttttgtatttttttagtagagacggggttacaccatgttggccaggctggtcttgaactcctgaactcaggtgatccacctgccttggcctcccaaatttctgggatgacagaagtgagccaccgcgcccggcctaatttttttttttttttttttaagagacggagacttgctctgttgccaggctggagtgcagtggcgccatcttggcttactgcaagctccacctcccaggttcaagtgattctcctgcctcagcctcccaagtagctggaattacaggtgcgcaccactaggtctggctgatttttgtatttttttagtagagacggggttacaccatgttggccagactggtcttgaactcctgacctcaggtgatccacctgccttggcctcccaaatttctgggatgacaggagtgagccaccgtgcccagcctaatttttttttttttagagatggagtctcactctgttgccaggctggagtgcagtggcgcgatctcggctcactgcaagctccacctcctgggtttaagtgattctcctgcctcagcctcccaagtagctgggactactggctggcgccaccacgcccagctaatttgtatttttagtaaagatggggtttcaccatgttggccaggatggtctccatctcttgacgtcgtgatctgcccgcctcggcctcccaaagtgcttggattacaggtgtgagccactgagcctggcctaaattttaaactatttgtagagacagggtctcgctatgttgctcagaatgttctcaaactcctgagctcaagcaatcctcctgccttggcctcctgaagtgctgggattaaaggcatgacccactgtgtccagccttttgtgggctttttgacatccttttatgtttttctttggtgaagtgcctattcaaatcatttgcacgcttttttttttttttgagatggagtcttgctctgtcccccaggctggagtgcagtgatgcgatctcggctcactgcaagctccgcctcctgggttcacgccattctcctgcctcagcctcccgagtagctgggactacaggcgccggtcaccacgcccggctaatttttttttttgtatttttagtagagacagggtttcaccgtgttagccaggatggtcttgatctgctgacctcgtgatctgcccatctcggcctcccaaagtgctgggattacaggcatgagtgagccactgcgcccggccatttgccctttttttgttgttgggctgtttatcttattattgcattttgagggttcattatatactctggatacaagccctttgccagatatgtgtgttgctaatattctctaccagtctgtggcttatctttgcattctcctaaatttctttcagagagcatacattctggtagaagagtacttagtcctgggcctggcagatttatttctttcaggacccaaggcctctgctgcaaacatgttccaccagatctttggtcagaataagaagcatatgagcttgatcattgttatggtcacaacttttgtatcccctcaaaattcgtacattgaaacctaatctccaatgtgatagtattaagagttggggtcatttgagaggtgatgaatgggcttcacgcccttataagagggccaaaggagattgtttaccccttccaccatgtgagtgcacagctgtaaggcaccgtctgtgaggaataggctctcaccagatactagcaccttggctcttggacttcccagcctccacaattatgtctgttttttgttttgttttgttttgtttttgagacagagtttgctcttgttgcccaggctagagtgcagtggcacaatctcagctcacagcaacctcttcctcccaggttcaagcaattctccagtctcagcctcccgagtagctgggattacagccacccgtcaccaagcccaactaatttttgtatttttagtagagatggggtttcatcatattggtcaggctggtctcaaactcctgacttcatgtgatccgcccacctcagcctcccaaagtgctgggattacaggcatgagccaccacacccgacctgttgtttattctttataagtcatcccgcatatggtatttttttcttttctttttttgagacagggtcttgctctgttacccaggctggagtacagtggcatgatcatggctcattgcagcttcaacctcctgagttcaaacaatgctcccacctcagctttccaagtatctgggacaacaggtgcatgacaccatgcctggccaattttttgatatttgtagaaatggggtctccctatgttgcccaggctggtattttcttatagaagcctgaatgaacaaagacactgtccatctttttcttttttcttttttttttttgagacagagtcttgctctgtcacccaggctggagtgcagtggtgcagtcttggctcactgcaacctccgcctcctgggttcaagcgattctcctgcctcagcgacccaagtagctgggattgcaggcaagcgccaccacacacggctaatttctgtatttttagtagagactggatttcgccatgttggccaggctggtcttgaactcctgacctcaggtgatccacctgccttggcctctcaaagtgctgggattacaggtgtgagccactgcgcctggcccatctttttttttttcttttctttttgtagagagagagagacagacagagttttgccgtgttgctcaggctgatctcaaactcctggcctcaagtgatcctcccaccttggcctcccaaaggatataatcccatgcctggaattacaggcatgaaacaccatgcctggccattcttaattttatgacatcctcacacttgtaatctcagcacttttggaggccaaggcaggtggatcaactgaggtcaggagttcgagaccagccttgccaacatggtgaaactccgtctctactaaaaataacaaaaattagctgggtgtggtggctagtgcctgtaatcccagctactcgggtggctgaggcacaagaatcacttaaactgggaggcagaggctgcagtgagctgagatcacaccactgcactctagcctgggagacagagccaggctttgtctcaaaaaaaaaaaaaaagaaaaaagttttgtgaagtccactttatcaagtttttattttatgtactgcattttcttgttgtatctaagaaatctttggtgaaaaagattttccctgtgttttattttatttgtttcagtgtctcgctctgtcacccaggctggagtgcagtagtatgatctcagcttaatgcaacctccgactcctgggttcaagtgattctcctgcctcagcctcctgagtagtttgggattacaggcccttgccaccacgcccagctaattttttcacctaatttttgtattttttggtagagatggggttttatcacgttgactaggctgctctcaaaagtactgacctcaagtgataagcctgccttgggctcccaaagtgctgggattacaggcatgagccactgtgcccggcctgaccaatcttgataaatgatttttgtgtacttggaaagaatgcatattctgctgttgttttgttggaattttttttttttttttttttagatggagtctcgctctgttacccaggctggagtgcagtgacacgatctcagctcactgcaacctctgcctcctgggttcaagcagttctcctgcctcagtctcctgagtagctagactacaagcgcacaccaccatgcctggctaatttttgtatttttactggagatggggtttcaccatgctggccaggctggtcttgagctcctgacctcgtgatccacctgcctcggcctcccaaagtgctgggattacaggcgtgagccactgtgcccggccctgattttctattctatcaattattgacaacaggatctgactataattgaagatttgtctatttctcattgattccatcaggcttttttccttcttcatgttttgaagctttttttttttttgagacggagtcttgctctgtcacccaggctggagtgcagtggcgccatctcggctcactgcaagctccgcctcccgcgttcacgccattcttctgcctcagcctccccagcagctgggactacaggcgcacgccgccacgtccggctaatgtttttgtatttttagtatagacggagtttcaccgtgttagccaggatggtctggatctcctgaccttgtgatccgcccggctcggccttccaaagtagggggattacaggcgtgagccactgcgcccagcctttttgttatttttgaataggatataagtgagaaattcaagaaagttttgaggcatttaagaacacaggttggccaggcgcagtggctcacgcctgtaatcctagcactttgggaggccgagacaggtggatcacttgaggtcaggagtttgaaaccagcctggccaacatggtgaaaccctgtctctgctaaaaatacaaagaaaattagctgggtgtggtggtgtatgcctgtaatcccagctacttgggatgctgaggcaggagaattgcttgaacctgggaggcagaggttgcagtgagctgagatcatgccactgcactctagcctgggcgacagggcgactccgtctcaaaaaaaaaaaaaaaaaaaagaacacaggctatgggttaagcaaatgatagacctcaagcttatattattctagagaacagggagcatctggcccacgcaccagccctcatttgagtgacttatttttaggctttgcaacccacattaattgctctttttttttccttttttcaacatgttctaaaatcgtatatatttgaatcaaagtacagtacatgtcaggataaagaatcaaaagaattatcaaaaatattaggttgaatcctatggagttgttaacatttgcctttgacctttaaaagaggtaatttctaggccgggcgcggtggctcatgcctgtaatcccagcactttgggaggccgaggtgggcggatcacctgaggtcgggagtttgagaccagcctgaccaacatggagaaaccccgtctctactaaaaatacaaaattagccgggcgtggtggcgcatgccataatcccagctactaggggggctgagacaggagaatcgcttgaacctgggaggcagaggttgcgatgagccgagatcatgccattgcactccagcctgggcaacaagagcgaaactccatctttaaataaataaataaataaataaataaataaaagaggtaatttcttacaaaataaggatgtttgttcattatagtttttttggaatagagaaacattgggagctatttagatgtctttcttttctatttatttatttatttagtagagagacagggtcttagtatgttccccaggctggtcttgaactcctgggctccagtgatcctcctgcctcatcttcccaaagtgctgggattacgggttgagtcaccgtgcctgtaacgtttttcatcgtaacattgttcagaatagtgaaaaaaatgagagtaatctaaatgtcaaacaaatcatgccacatccatatcacaaaattaaaatcaatgttttagatttaataactcaatccctttgtgttctcatgaacacatgatttaatattggtttcatgacattaagttccatttatacatgctggaaactcccaaatttatatctaaagtccagctatagctccccaaatccagaccaagacattgaatttcctctgtggtgtcccagcaagttctggagtatggcacctcctcatggatgtgtccttggcacctgggggcagattccaaacaagtccacttattttaaatgtctcagtaaactcatttttatttttttgagactgggtctcactctattgcccagacaggagtgcagtggcacgatctcggctcactgcaaccttcacctctggggctcaagcaatcctctcacctcagccctgcaggtagctgggaacacaggcacgtgccaccacgccaggctaatattttgtatttttagtagagacggggttttgctatgttgcccaggctagtctcgaactcctaggctcaagcaatccgactgcctcagcctcccacagtgttgagattacaggtgtgagccgctgtgcccagcctcagtaaacttctttgccacccagagagaaggttgtaccctctgtcagggtctggttcaacctcaggcagagggggctcatttagatttgccttgactcaggcctatcggttttttttgttttttgtttttgtttttgttttgggggggacggagtctcactctgttgcccaggctggagtgtagtggtgtgatctctgctcacagcaacctctgcctcctgggttcaagcgattcccctgcctcagcctccagagtagctgggactacaggcatgcgccactatgcctggctaagttttttaatttttagtagagatggggtttcaccatgttagccatgatgatctcgatctcctgacctcgtgatccgcccgcctcagcctcccaaagtgctgggattacagatgtgagccacggcgcccagccaactcagccctatagttaatggctgttccctataaatgtttttcttatattaagagttttgttttcatcacctggcatcagatcctccattattccaatttcttgttattgtttgtgataggtaatcttagttcaacttaactgggccagggtgcccagaaacttggtcaaacattattctggatactactatgaaggtgtttttggatgagattaatggttttgttttttgtttttttttgtgatggagccttgctctgtcacccaggctggagtgctgtggcatgatctcggctcactgcaacctttgcctcctgggttcaagcgattctcctgcctcagcctcctgagtagctgggattacaggcgtgtgccatcatgcccatctaatttttgtatttttagtagaggcgacgtttcaccatgttggtgaggctggtctcgaactcctgaccctgtgatccacccacctcggcctcccaaagtgctgggattacagtgcctggcgagattaacattttaattggtggacttcgagtaaagcaaattactatccgtaatatgggtgggcctcatccagtttaaggagttaatataaaaaagactgacttcctcctgagcaagaagaaattctgccagcagactgccttttggcttgaactgtctcttccctgagtctccaacctgatggcccacaataaagatttagactccccaggcctccacaattgtgtgagccaattccttaaaatgtttctctatctataacatatcctattagttctgtttctctggagaaccctaatacattatacttttttttttttttttgagacagtccctctctgttgcccaggctggagtgcagtggtgcgatctcggctcactgcaacctccgcctcccggcttcaagcaattctcctccctcagcctccagagtagctggggttacaggcacgcgccaccacgcctggctactttttgtatttttagtagagatagggtttcaccatgttgttcaggctggtctcaaactcctgacctcatgatctacccaccttggcctcccaaagtgctgggattacaggcgtgacccaccacgcccagcctacattattctttacattcaactaccccagttcaaattgctgtgtggtttctgtctcctgattggaccgtgatgaatacactattattctctcctgaactcccaatccatatgtgcagatgcttacccagcatctctatctggatgtctaaaaggtgtctcaaaagcatcgcaaatttgttatccccaaaagtagctcttgatgctcctcccacaaacttttcttttctttttttccttttttttttttgagatgaagtctcgctcttgtcccccagtctgaagtgcaatggtgcgatcttggcttactgcaacctccacctcccgggttcaagtgattctccagcctcagcctctcgagtagctgggattacaagtgtgtaccaccacgcccagct

SEQ ID NO: 1216 - DNA, 393641 bp, Homo sapiens
caaatgccgcttcttccatatgttgcagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtacgggacctgccttgttaaccacgcacatatcgttaagaatctgaaatgctgctccatggggtctggcagaagcagggcctttgattagctaaccttagaaatgctggagaaagttttctgacttagcaagaaagcccctgaaaccttagaatggacatgagagtgagctttccgattgtcatgggggtttatcttgtgtagggaaaagaaacaggtctgaatccagagctggacctgatgcttctactttctttcttttttttttttttttttgagatggagtctcactctgtcgcccacgctggagtgcagtggcgcgatctcggttcattgaggcctccgcctcccaggttcaagcgattctcctgcctcagcctccctggtagctgggactacaggcacatgccaccatgcccaactaatttttgtatttttagtagagacggggtttcaccatgttggccaggctggtcttgaactcctgaccttaagtgatccacccacctcagcctcccaaagtgctgggattacaagtgtgagccaccgtgcccagcctgatgtttctactttgttcttttgttcatttgcttctctctccattcagtctgtcaccaaagctttactaagcatgtaccagatattatttcaaatggcggagatacaaagatattaagagagcccttatagccattgtgcttcttgttacttctaaaattaggtaatttttattcttggtttgttttaaagattagtcattacaaaaaatttccaaagaggaaactgaccatatcaagaataaaacatttcagttctttgcatctttacctggaaacaggcaagtggtctacttttgatttcacgttatcagaaactgcaaatttgatttagcaaatagaagcagtgttgttggacgtctatagatatttgaagatgggtaattagaattagatcaattatggaaattgctggtaactttgaaaactttatttcaagactttgaagaaattagctaaaaatttcaaagcatggaactaaagaatgatggacaaagttctgtgctatctgtgactgccagatggtgtgtagagtgctgagaaattaagtcgatgacctggaaaatcaactcaaattgagaaaagtcatgtctcctggaagatgtcagtagatttcttctagtttgtttctgaagggtaattgagggaaagtgagactgcagttatgggatctatctggttcctgctgctgcttttggagaattaagaaaagtgcccccttataggaaaaatctcagtcattaaaaatttattacatttcttattttccttatgttttagagacaggcacagaggcagaaggctgagtcagtgggcttccatagtagagccgggcccacgtgccatgtgtggtagtgacagccacacactccttgattggtttatgatgaattctgggcaggttttgcacctagtgaaagtctgtggttgaaaaagaaggttgtactttgctgaaagaagtcaagcatcggggccgggcacagtggcttatgcctgtaatcccagcactttgggaggccaaggcgggtggatcacttgaggtcaggagtttgagaccaacctggccaacatggtgaaaccctgtctctactaaaaatacaaaaattagccaggcgtggtggtgggcacctgtaatcccagctattagggaggctgaagcaggagaattgcttgaacccaggaggtggaggttgcagtgagccaagattgtgccactgcactccagcctgggtgacagagtgagactccatctcaaataaataaatcattcacaatagggcaaatctctgctatcaacatttaaatactggagttttggaaatgtaggctctctgggcttcagatatgaatatacttatttgggataaattccatctttctttgaagcactggaactactttgcagaggacagaacaataagcatggatgtgtttactatagatttccacatgactggcctggtggcggatggatgatgtcaacatgagtctttccatattctggcaggtggctcacctgatgcttctgaagcccatgggaaggacttgagagccaatcaccaccttcttcccaaatgtaatgatcatatactaagagtgacttatttacttggcgactgacttattcatttgtgcatttaatgatccatgtgatctcaggaaaggcacttctctgaggtttattttgattgtttgtaaaccaagaataaaaatacctacctctgattaacgtttaggaccaaaagagaaagtgtgtgtaaagagggttgaaagctgtgtaaagcatcatgtaatatgaggtgcttattttattattctttaaatataatggagtgtgttgcccacaggttagttctttgcatgaagaagagctgcaaatccaaatcatgttacagtggataatcttatatgtagaaataccctgaagtgctcccaagatctcctggaaattccttgtttgtttttccattctgatgttttactaaagctatggatcatctttgagtaattcttctgtaacagattgtgtgtgtgcgtgcacgtgctcatgtgtgcttatgtgcacatggtatgcgtgtgtgcacacacgagtgtgtgtgcgtgtctgagcacaaacacgtatctgtctttacttcagcaccactcttcatggattggcgatgtcttcattggaattggaagcgacaatatttacattttcttaatctaaaatatttattttaaaacactaaattgagagatttcagtgtagagaagatgatcaggaaacagccatctgattactgggcacactgttttggagaagcctttagtcagacttttcagacagagtttgtgtaatgaatctggttgttctgtattttacctgtaggtctcctgcctaaaattgataagtattagtaagtataagtgtgtatatatattattactgtcttgttccagaaaggatgtaaagctgcttacaacaatacataaaagtaagaaaaatgaatgctaggtgaggaaagttaggcaagagaaaataagaactccccaggggccaagtggaaagtagttcagttaacttttctagcccatcttttttccactttaaaggatgtagatgaagaagccggtggggagaccctggggcctctcagcaccaaaatgtgacttaaattagcacagtgcaatgaaccaaatatagaaagacggctatctaagtccgggtgttggggcaagcaaatattccttttataagtttgaatcattttaagaaaaagaaattgggctcaacacagctgtttctctggcccaacaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtaggtcctcctcccgaaaataggcagttttctacgtggaattaatgtcagagctttttctgtaattagacaattcttgtgagttcagccctgcaccagcccttgggtttgactgtgtgtgtgtgttccctgtcggcttgttcataagggcatgaggctgtcactagaatactttcgttgtctttttacaactatttaaggactaaagaacccctgtccccaggaccactgtgggatcaaaacagaactggtgaaacaaagaacaagctgctttctgttctggttttagtgtggatagagggagtccattttccattttctctggagttgctaccatacagctgcagaggaagcgctgtgcctgcaggccatgcaaagccacagtggtcttttggggttgcaggggggctgctgggaccctgcatgtgccaggctcatgccccctgctgtgtgtgccctggagggagaagctcatgcacaccaccctgggttttgttttctaggtggctgtgttaaataatcatgaagagttagttcagttacttcttgacaaaggggcagatgcaagtgtaaaaaatgaggtaaatgagtccatctttatgtaaagattttcctcggagggggagaaaacatttataagcatgtaaaatttttgttgtttcctgtttcagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaagcatgtgcgtatgtggtaccatcattgggtgtctgtagaatggggatgttttcttgcacttgcgccttttggagttagacatgaaacaaaatatttatgcaccggagctacacaaacacacatggggtctcccactcccggctcctgccccgcaagctgtccttctaccatgctaggccttgttggaattctttccctcatgtgttttcaattaaatcctcccctcccaacttagggcttccaggctggttgtcaggccgctgctccctcctggagtggcgctcctccgaaaagcccaggagttttctcttcagctgttggcctcacatcaaagctcagaatacatatttcaggactctgattctgttctattggaggtgtctgattgagggtcagcctttttggccacagacaggtctaatgtgtttgcatatactcatgccctgacaatggaagactcagcctgctgatgggtggacgatgtagccaaagggtagtatattaaattttgtcttcagagcagaaggttttctgatgctgatcatgcagttcctagacaagtaggaattaactgcaaccatgtctgctggttgggagcttaaagacacaaatgtggtagagcttcaactcagcaaacacacttcaaaatcagcaaaaaagtgagcacacagaccacatgagtttatgtctccagagagacactggttaacttgaccccatgggaaaaccagctacataggtctgtagaggagtggattttttttttcctgtagggaaagcctaataaaaggtaattaaagctccaaagcttttgctgaggggcatagagaaaaagcacacaattttattgacgttagcaatcagctttattccaaagagcccacagaatattcgttttaggaattggatttgtggaccatatatagtccattccttagatatttcatgagtgttttaccttttgtacaaatgcaaattcctttagatttgccagattaggtttttaaaacctctttaaaaattggagcacatttacaactctccagaggtccctcctttggttggtggtcaatgttgatgttcaccttagtttcattttttggtctgttgtagactgtattcactagcctgctcttatggtaggagtgtgcatcccttctggttgacatcaagcttggcaaaactgcccaccctcccgatcgatattgaaccatccttatattcttgagatcatctccctgggttatggtggactgcaggattcttcatgctcatatgctatgtatgtttgctctttttcttctttttacttaatgagattagaaagtggcgtatacactgttagaattttcctaaagagcaactcatagttttattagctctactgtattctaatgaacttatccttaggtctacaaattcatttcttctattttttcccctgggtttattttattgttccttttataactttatagtagatattaagttccctttttcatcctttacaaattaatttatagatttagggctatgaattttcccccagcagtgctttagttacattatcatagaagttttctaaacttttctaatgaaaaattcaactgggagaacttgctaagtacacatttcgtagccccatctctgctctctgaattggaatcttcagggaaagggcatgagcaatggattttaatgggtttgaacaagcatcacaagtgaggtcttctaattctaagatcttgagaatccctaccatcacatgtgctattagaaatgttttcacttgctgttttctaatctgcaattcatctttgaaaactaatgaatcaattcatttctagggtatggaattattttttgagaatttttattcctccaaggcacttggaaagatgatatattctgtatgtttggagtatcctgtttgatatatatcaattatgtctgaagttctgtatgtactaatttttgccagcttgtgtgatcataggtggagagtggtaagaataaagacttcttcggctgggtgccgtggctcacacctgtaatcccagcattttgagaggccaaggtgggcggatcatgaggtcaggagtttgagaccagcctggccaacacagtgaaacctcatctctactataaatacaaaaattagccaggcgtggtggcacgtgcctgtaatcccagctactcaggaggctgaggcaggagaattgcttcaagccaggaggcggaggttgcagtgagctgagatagcaccattgcactccagcccgggtgacagagtgagactccgtcttaaaaaacaaaaaaaaaagactcctttattcttgttagcattttgtatttgtatttttgtattttctgtagttttattaagttggatgctgtgttttttaaataggtatctatttacacttagatttttcataccaaataactccgatattgtctctaccactgcttgcttgctttttggatttcttatgtaaatagatgagttttaaaaaattaggttatacattcacattgttcaaaaaccatatcatgccccaccccccgtgttgtgtgtgagcatcttccttcctgtgccgtggtctcacacgttcatgaggttggtagcacacaccccttatgcacccccaccctgccaaccattcttcttagtttcttatgtactgctccaaacttttctcaagcatctataaatgaatgagaatacatttttctacatgaaggccttccgccaatttttgtaacattctcagtaacaaatgagagacacattgatatttacctttatacaatttattgggtttaatattcataacaataactttttctactgaaatagcagtttgtgtttacctgtcgaaccccaatatgagaaatgtgtacaaaagcaacagactgtgatagaaaaaggtatgtgaaaaaattagcaaaccaaagcatgataaatggatgaagcactataaaattactttgctgtttacgtaactgtatctttaatctgtactgtgctaaacagcctatagccaagttttaaagagttacaggaacaactgctacacattcaaagaacaggcattcactgcagcctcctgatttgacctgatgggagggacaggagaatgagtcactctgccaccacttttcctgccttggatttgtagaggatttgttttgctctaatttgtttttcctatatctgccctactaaggtacctgcttataggccatgaaaataaaacgccattcaactttttttttgtaaagctaaaataatcacatgatacttattctttggaggatttaaaatgtgctaaatggaggactaaagagttaccttataggagaatcatggggaacagagaaactgctttttgaagatgatgtggaaggtcagggtgggttacagggcattcaacctggaagagctgaatagctttacattgagaattactttgtatgttaaatcttctggccatcattatccattattggatattttaacaattttatagttattcttaatttttctcatatgaaactgtaatggctgtactagaagctgccattactgttccaaaaagtaaaggggattttctctacaaaaggaaagaaaatggcacattcacatgtaggtaagtagcttctggaaacatcctcactgcacagaaatggttctcagcatggggctcccaaactttcttagagtgtcatttgttttagtatcagagttttcaaataggtttaaaagcagtagatgtcaataggaactttaaggtgagtcaagagaattttgtaattatagataagttgattttctgtggctaacttccccttctaattagaacaagacattgggtgggaggtcctctgctggacttaggctggtggggttgctctgggctgcagccctggagaaggttgggctttgggcatcccttgggtgggccttgtagggatagccacacactgcagcagtcaccactttggctgatctaaagtagcaatggaagtagtgatttgactgtcaaactggagatgcatcggcctgtggtttgacctgggaaaggggcttgtgtctgggtgatagggaaaggtaaacagatgtattagccactggctttgtgtgggcagctgtgttgaatcagcctgctgctgagtcacagggagtaactgcagctgcctagggctggcttctagcatggagaggagaggaaaaggggtcctgcaatgtcccccagcagcctgtcattgtgtgtgaaactcctagcctgagagccccacctctggtcagcactagtgttgggagacttctgggagggattgtgactttcagctgggtaactggtgtctggctgaggccatcttgagcgcagtgaggaaggatctccagcctgagtgtgccgtgggccccccgaatacataggggagccctgcaaagcagttttgaaatgagtagtacatctcacgaagaaagtctgcaagaggtcgaggtgcatgagaaagatctggccctgctgccctggcgccaccttgtgccctttctgctgctgggggtctcattggctcagagtgcttagtaaacatcagtggcgagggggcaggaggatgctcagccctgccagtcggcccagcaccaggctctttttagcaccgtggagaccataggctccttaagaacattttgacacagttttagccggttttttttttttttttttttttttgaggatgcattgatgtattgatttgcctgggaacaatggcctatagttcagcctgagaattctcataaagttaagaaggcataaaaatgccccccccccgagactcgtcaggagtattgactctcctacagtttaatttgctgcttttgtggtttctgtgatgtcatcccacatgtgtaagctggaaaaatccacgctgtgaaatgtaacctcctgtgtgtatttccacaatggagaatgttaggcttcgtttccctcggttgctacacatctgattacatgtgtcaggaaaacaaacttaaaaaatttcaggagacaaacctttcagcggaattgcctggaacccatgaagtgaggtcatagaacctacaactataataagctgtaggaagaaaagtagcctctgggctactttgtgtctagtcacattgactttccaggtgatggccctacaaaactcaaaccacctctattattcatgcctatacagtcttttaaaaaaatactagattgccattgaaatataagtattgattttttttgttttgaggatataaaaaagaatactccaccccgtgcctcccccaaccacaaaacaccctggttattggttcctaagttatgttaaaatggaatttgctgctaaatatgcttcacttgataaatactgcatcttggaaggattaatactgtccatattgtaagggaatattagtttaaatatgttcttattcagaaataaaatgcatggctctataataacacattagtactgtagagataagaatgtgtcatcagccatggcccctaagtggccattgatgacatggcataagatcacagttttaacctcctttaatatcaaactctcctggctctctgaaatagaagcataggaattacagctaagaacaaacaacaaaagaaaaactcagttcatatcctcttataattggaggaagggctaacatgccagatctaaggatttgggcatctaaaaagacaatgcccacgtaatgcaccataaaattctgtaaacctttttaatagtatatatatgtttggctttagtacaattaccaagtgtaatcagttacagtaattctgtatgtatctcagcagtattattttccagcatggctttacattttaaagaacttaataactatagaataaacagatgcatgctatacgagttggaatgtattagagctgggttcccttttgtgtgtgtttgtgtcacgtgtttagtttatccatagtcatgaatactatgttgcctagatacagtggggaacaccgggaaagtgaaatgcagttttgttttctggaaggcaaaccaagattcttggtacatatttttctgtttcaaagcataggaaaactgttgacccccaaaagaaggctttctcataaaacactcagagtgaattatgtaactgttgtcaattgtcttctaatgtgaaaaccagtccagaagacagaggcatcatggcattttaccttatctgagtatttttgtatttctcatgccattagtcactttaaagaccttgtgaaacatggctccctagtcaggcatttgaagagtgaagagttcaaggggatgctgcccaagccagcatctcataatatttaggaagttgataagcaagttgatttccttatcacattctgtgatgctcaacaggtaggttgcaagtgtttaagaaataggttcagactctgttaaaagcatcttttaaagattcctgcagccaagttggaaaaagaggatgccccatagagaaggttctttgtccaatatctacgaataatgatagcagacatgaactatacccatgaacatcacattccattggttgtagtttttgcaagcataaagagtctgcctaattgttaataagttgaaccttgcagtaaacagacttgattgactagatctggttaatggttcacatctgaaaatagttgtggtcccatggaaagcctcatctgtctgaatacaggatcattgtattacagtttgtggtgatttgctcagctccaagcagtatagggaggtggcggtttgcagtgcctgggcagtaggtttcttacagaaacaccacctttcccaagctaaataacctactggtggcagtgctctagaaaggacagcgagaaaaagaagtgcttggcatttctatcaagcaccgccttgagtgacactacagaccccttccaaacatgctcacggctggtcagctcagggtcaagttctggcttgtctagtgttccagtctctatcctggtgtggctacaccttaagattcctgtctgcaacccaggttctcaccaaagcttcctggccagaagccagatttctcccaggtgtccctgggagcctgcctgccagttgtcaaggggcacagggcctccctgaaagccaaacacagcctggacctgaagccccttggctctggcctgagatggggaatccagaaaatcaactgagattctacttgggatctcttgagctgcatctggtaccataagcacagctgggggtagttgggggactgctttccaataaggccttgatcagaaagcaaacacatcctgtccagaatcccatcaagcaggatatttcaagttcactaaaatactaaaagcacaacaagccttcctgccatggaaaactcagtgatggtaaaaatgcctactacagcgcactgcactgtaatcaacattctgcataaattaataatttacaagtacctgagcaagtagacagagcaccatagcacagcacagcactgacggcagtagctcaaagttcttatagtaatgatgttttaaacattaaaaaaaatcctaaaagttggtacaaaaaactccaactggagctgaaagatagtgcaaacttctgtcttcactgttgaaaaaaggtgtcggcttctcacttaatataggcggtgtgggtggatctgggcacttggtgtggatattgtggagcaggtctgaatgaagagaggagaaaaaaaaatgatcagagaccttgagaagtgattctgaggatagagaggtctggggttggagatgtattctgatagtctgaagggttttctgtgtcagataccactgcccctcataacgggggtgggaaacctgtctccaaagccgcacttcccacccacaagtcaactctagaccagcactgtcccacagaaaaaatgtgagctacacaagaaattttaaattttctagtagccacatgaaaaaagtaaagagaaaggtgcaattaattttagtaatacatttaactcagtatacctagaggattatttcaacaggtcatcatcaatagaaaaaaatggatagttgacattttagggtactaagtcttcaaaatacagtaagacttttaccaggcgcaacatgcctagcagtccctgcatcccacagcacagctccagagaacagggagcaaaggtgggcacccagtatccctaaaaaatgaaatgtgcaggacaggaccaaaatcagcaactgaccagaggtaagattggccacagcttgagggcatttaagaaaaagggcttcccctcattgttttcatgtaaagtagtgtttcttcctcaaatagaacaagaaaaataacttcaagatcaacatgcaaaccacaatgaaataattaggatgctatgcaatttttctctatttatgaagttgggaattaaacaattgtcctgaccctttgaccgcctttatctctgacatttattaagcagctctttctttcacgggccaaacattcttcccaagagctgtaataaaatcactccagtgtgtcttctccttcagagatacaggattactgaacccagggcctggccaacacagtacctttggttcttttgagctcacaaagcaggcttcctgccaagagggcatgtgtgtcagaagagtactttggctgtgggtttaactcatctgtgtgctggtaaatgttgaacagcccatggggttgggggcaggaaagcctgatttgcagtatttgccaatgtccatggtgtaaatactcctcctgtggctggtttcaagctaccacctgacatcactaaacatggaagagatgcaggcagctaccatgacctaggttttctgccatacagaaataatggatgagtgcaatctcaagagcacagacaattatagcaaaatggagaaaaatgtgaagtgagttttgagcacttattacctttgtttctaatataaaatatcataaatttgtataatttaatccttaatattggctaggtttaacacctagcttgcaaaattcctggaaattggttatctctcaccaaccagggtaagctggctcccctacaccatggggttagcctcccagcataagttgggattgaggtctctgccttcctagtggaccaagcaggataagctgtgaaaggtgattccttttgcccattgtccctgttttcccagtgtcctgctgccaggcagctgctttcccttactccccatatgtcccttgctccagccgtatgcctccaacccgactaatgtctcaggacctcaggaactgggcagattctgctgagagttgtggaggtgggcattgagatggtctgaatctgtgttcctgccccagtctcatatcaaattgtaatccccaaagttgaaggtggagccttgtgggaggtgactagatccttcatgaatggtttagcaccatctccttggttctaagtgataggagttctcattaaatctggttgtttaaaagtgtgtggcacctcccctttttctctttctcctgctccagccatgtgaagtgctggctcccccttccgccatgattgtaagtttcctgaggcctccccggaagcatatgctgccatacttcctgtacaacctacagaactgtgagccaattgaacctcttttctttaggaattacccagtcttcgatatttctttatagcaatgtgagaacagactaacacaggtgtccagtcttcatactgtcatgctacttggtagctcctctttttctttgtgtcttacaggcctggctttctgaggtactgtagttttatgacatcttgatttgctctcttaggtccactgtggctgttgataggcactgtgtgccaatgcctgtgattataagctcacagggactgcttccttcctggtaattgtcatgtctattttacggtattcccagttgtagggggagcaggaagcacggcctagaccactgcacccctgtcctggcttggattagtcgtggttggtcccacaagagtttgagagagaaagagatgggcatggcatgtcacacaaacctgaggggtgccaggcggagcccagtctcccattgtcctggggtcctggccaaggcatgagtgagccgagttgttctggccagaggatctgcaggcagaggcttctgaggggggtttggcttacaggtcccctgcaataaacatagggttaggcagggtcacttaccaggagccagcagaggcccctgagaagcagggcctgccgcttggcacaggccctgcttcctgaatatcatcctgtcaccatacaaggtgggtggaggctgacctctgttaatcttcttgccaaaattttctgtaacatttaagacttatccatggatcgtagttataaacactcaactatggggcttctggactgcccctgggccctggggtagcgttgatgttggggtttctctgtcagtgtcaccctgaggatacacactttcctgtgcttttagttaggcggcttctctgttcaccctaaaataagaagttggtgaaaatcttttcaaacatcacattcgtttcttcagttttgccaacatcacatagcaggactcgttcatctgtgggtggatgagacggtgaggatggttgtgctcagtctgccacgtgcaggcgctgttccacatgttgctctgaaggctccgcgaaatacactgaagttcttccactagatactttctcataagctcagagaattgatgcagtggtctgaggggcaagtcaagctttgtaaacacactaaggggcagggctgtgttgaccagaagccagtgtgagggagctggccagggaaggtggggttattccacgctaggttttagccaaaaatgatgctttgggacttgtgcaagtcacttgacctctttctctggaaaatgtggggaaaaagacctatctcagcattgttatgaggattaaagaaaataatgcataggaagttcccagcacacagataatagttattaatatcagcattccttcatgccgcaatttaaaaatgtttagtagaaatagaagaaaaacggcggggcgtggtagctcatgcctgtaactccagcactttgggaggccgaggcgggcggatcacctgaggtcaggagtttgagaccagcctggccaacatggtgaaactccgtctctactaaaaataccaaaaattagcctagcatggtggcacatgcctgtaatcccaggctacgcaggaggctgaggcaggagaatcgcttgaacccgggaggcagaggttgcagtgagctgagatcgtgccactgcactccagcctaggtgacagagtgagactctgtctcaaaaaaaaaaaaaaaaaaaaatgtaagaacacatgcccctttttttcgtggggcccctcctgtggatacccatgagagaggggttcattggagctgtgtccagaagtcagtaagtgttggacacatctctgctcttggccccaggtgaatgtgggtgccatgtcttgtctttgaagcccggaaacactcatgaatgcacagaatgtctgttggaaatggtgctagaacctccagggagacagaacacccctaataaccaagtgcttcaattcaccatcataggacccagtatatatctagcaacactcaacaatgatttcaaacacttgagttgaatttctctcacagtgcctatcatatgaaaattacatttctttagcagttggggctcagctgaaagaatgcaacaatataatcaccatttaacatatctttgtaaagcaaaggaagctaccacagaagtttgtaaatcacaagtgtccacaggtgtgtggaagataagctgagttggaacaacggacacattgggctaggaaaaagcccctgaacaagggacagacttagaagtgatatttctacattagttttcattaaaagaaacattaaatagaaaaaattccctagctaggaataaaggccatataatgtgcccaagagcacggattgtttatatattcaaccagttccacatacacacacagtatcctcactggtggagcagggatgatcatagtcccttcctcccgggtggatgtgagggttaaatgagatattgaggctcctagcacagggcctggcatgcaatataacccatgagtgttagctgctgctggattacaactattattaatggagtgaatttaccaccaaaaagcaccataaccctaccaacaaactttggataattaactaaggtaacaaatcaagctccccttcctatagataacagaaaactgtgagcaagacattagtgtgtcatgtaaaaatggatgtatgcactcatcaaattgaaataattagcaatactagttttgctgctaagtatgactaagctgtcttggcaataaagaataacgtcaggtttttattgcaatgctggagaaaaagtgaggtatgtatcacaatatatttggatttatcatggaaacataggagatagttaggttagccattcattctagtttgcctgggacgttcccaatttatgtttatcgtcctgtttaattattaatcacactctctcaggcatgtctcctactttagaagataaattatatggtcaccatagtgatgaaaacccaaatgactgagacgctgattgaagggtctgacctccaacctggggatcagcgcaggcaccatctgcttcctccagccatggccaggacatggtttggatggaagcatgagacaggttgcaagcaaagatgttgcctaggtaagatgctggcttcctgccagggcttaactgggacagaatggccatggaacagtgggggttagtccaagaagatgtgccttcactccttagacattaggcatggaggtgtggaacccatgatgcaagaagcaccagctgcacattttgaccctggaggaagggatgaaattgccatgctgtcttctaggtgttgcttttcattctgcctttgcaaaacctaaacctgaacctctcccagagaagtccagtgtgatcaccaagcatcatctgaagggagctgagaaatgactctaagcagattgctcacacacgataaacatttctttaaatctattttcattttaaacaaggaaatgaattcaaacctcatttttatgccctcttaacttcttccagatattgaagaaaaatccaggtatgctattaatatgctattaaatagggctgttccattcttctatattctgctcatgttctggcaatagccacatatttcagattttttagaggtttcaaaacaattttaaatccagatataaccactttgccttgaccagcatcatgaagtctcagctgttatcaacttcacatggtaaacgagagtaaacatgccctgcttatccagagaaatctctgcaggaagactggaattcatcacaggaaaatgccagagatgccccagagatccctgacgagctcatgcagggctggggcggcatcaatatgtttcactgtgcaaattcggtctacctctagctaaaaacaattgtgggaattatggctatagatcagaatataaatgtcgtaaaccctaatgtaggtatcatggaactcgccaaagttgacaggcgggtcttccatttccagtaacatggcaggctctgttgttgtgccctaccccttctctgatgaccaccaagagttacaagacagcaaatgttttaagtctaagtgaaagcagcagcttggagagggagtagtaactgaagatggaggcatctgccaagttagggaaacctaaatgtgggttttgatactctttcacagtgaggaatagagaaatccaaccaaggtcaagacatatgggcagaaaccaaatgtccaagtttaatgagagagaattctcttcctgactcctctccattcaagttgggctctacagacaagacctcaggttaagaatcttctagaagtaaatacatactataatctatccccaggatactacaaggagcattcttctggtgctggacagaccgagggagaaaaataaacctgtcaccacaaattgtccttgaggacttgaagctgaaatcacatcacctgggtatttcaataagctccaagccattttaaagtggtctcaaactggtactgcctccaggcacctggcagaggcaaaatagccctttatggaagaacacacctgcatcctaggccttgaagaactataatttaaaaaagtgaactcatggaaaaaaaaaaaaaagcatacagggaaacaaggaaccaggagtgagaagtgatagaaacttcagcagtaacatatccaaagacttcagatttgggtattattggaaaaagttttcttactatgtttaaagaagtacaagacaagctagcatagttgaattagaaccaaagagaacttctagaagcaaaaaaagtacaacatagatgagtgcaaattgcatgaaggtaagtacagtttgataccacttacgtaaagtttaaaacacgaaacactatattaatggatacatatttatacaaaaatattgaaaacattaagcaaacttatgacagtgcttgtatctggagggaggctaatgtagtgactttaatgtttcacttcttttgaaaaaggatatatatctgaaacttaaataggcatgtacatctagaaagatgtaaaactagttatttctatgtagaataaatgtgagtaaattttagtttttacttttctatattttaaatattttaaaaaataacttcaatctttgggctaaggaggaaaacagaagagaatatatagactatttaaaaaatatacactacaaattggaaccagtgagcaaggtgtaaagcaatgtttagaggaaagttcttaataatattttcatgtaactgtcacaaagtcccaaaagcaagtactattatttcacatttgtagaggggacattaaagtgatgtttccaagatctaatggtagcaagaggaagatcatataagactttgagctggttgaaggtaggggagaatgagaaaccagacaaatctaataaaacataggccaatcaaggacaaataaaataaatggtattaaggattactaggtggtcatctagaaaaaaataaaatttgattatacactaaatgggattgattcaggaaacaaatagacacatggagaacaaaaaaaaaaagcagggtgaggcaatggcccacctgggagtgacacggagccaagggaaccctcaccatgggaagtggtacaagaaaaactgaggctactggggtctggagcagacccccagcaaattgcagcagccttacagaagagtggccagactgttaaacagaaaacaacaataaccccatccaaaggtcagcaaccttaaagatcaaaggtagataagcccacaaagatgagaaagaatcaacacaaaaacactgaaaactcaaaaagccagagtgccactttttctccaaatcatggcaacacctctccagcaagtgcaaagaactgggctggggctgagatggctgacatgacagaagtaggcttgagaaggtgggtaataaagaactttgctgagctgaaggagcatgtggtaacccaattcaaagaagctaggaatcatgataaaacaatacaggagctgacagccaaaatagtttagagaggaacataactggcctgttagagctaaaaaacacactatacgaacttcacaatcacaagtattaacagcagaatagatgaagcagaggaaaaaatctcggagcttgaagactatcctgaaataagatgggcagacaagaatagagaaaaaagaatgaaaaggaatgaacagaaggtcttgagaaataccggattatgtagagagaccaaatctacaagtgattggggtacccaaaagagacgggcagaacagagcccccccagcaaattgcagcagccttacggaagagtggccagactgttaaacagaaaatgacccacaaaaatctcatccaaaggtgtcagcaacctcgaagatcaaaggtagataagcccacaaagatggaaaacatacttcaggatataatccaggataacttcccctacctggcaagacaggccaacattcaaattcaggaaatccagagaaggtaagatactccatgagaagatcaaccccaagacacataatcatcagattttccaaggtcaaaatgaaagaaaaaatgttaagggcagccagagagaaaaaccaggtcccctacaaaggaaagcctatcagactaacagcagacctcccagtggaaacccaataagctagaagagcttggggaccaatattcaacattctttaaagattttccaacccagaatttcatatctggcccaatatcatctagataatgaagaaagacccattggtgtgctgtcttcaagaaactcatgtgcaaagacacacacaggctcaaaacaaagggatggaggaaaatttaccaggcaaatggaaaacagaaaaaagtaggggttgcaatcctagtttctgacaaaacagactttaaaccaacaaagatcaaaaaaagaaaagggcattgcataatggtaaagagttcaataagaagagctaactatcctaaatatgtgtgcatcttataccacccagattcagagagcaaattcttagagacctgcagactttaacacccacctgacaatattagaaaatcaacaaagacattcaggacttgaactcagctctggagcaagtggatctgttatacaactacagaactgtccacccaaaaccaacaatctacattcttattactacacagcacttactctaaaattgatcacgtaatcagaagtaaaacactcctcagctaatgcaaaagaactgaaatcataacagtctgtcaaaccacagcgtaatcaaattaaagcttaagattaagaaattcactcaaaaccacacaactccatggaacctgaacaacctgctcctgaatgactcttgggtaaataatgaaattaaggcagaaatcaaaaagttctttgaaactaatgagaacaaagagccaacataccagaatctctgagaagcagctaaagcagaagagggaaaggtataacactaaatgcccacatcaaaaagctagaaagataaagttaacaaagttaacaacctaacatcacagctaaaagaactagagaaacaagagcaaaccccaaagctagcaaaagacaagaaataaccaagatcagagtggaactgaaggagatagacatgaaaaactcttcaacaaatcagtgaatccaggagctagtttttttgaaaaaattactaaaatagatcactagctagactataaagaatcaaatagacacaatcagaaatgataagggggatatcaccattgatcccacagaaatacaactatcagagaatactataaacacctctatgcacataaactagaaaatctagagcacatacagtctctgagactgaaccaggaagaaattgaatccctgaataggccaataatgagtcctgaaattgaggcagtagtaaatagcctaccaaccaaacaaaacccaggaccaggcagattcacagctgaactctacaagaggtagaaaatagagctggtaccatttctactgaaactattccaaaaaaattggaaagaagagactcctctctaactcattctgtgaggccaacagcatcctggtaccaacacctgggagagataaaaaaaaacctcaggccaatatccttgatgaacattgatgcaaaaatcctcaacaaaatacaggcaaacagaatctggcagcacatcaaaaagcttatccaccacaatcaagtaggcttcgtcccaagatgcaaggttggttcgggatatgcaaatcaataaatgtgattcatcacataaacagaactagagacaaaaaccatatgattatctcaatagatgcagaaaaagtcttcaataaaattcaccccataatataaaaaactcccaataaactaggtattaaaggaacatacctcaaaataatagccatctatgacaaacccacagctaatatcctgaatgagtaaaagctggaagctttccccttgaaaaccagcacaagatgccctctctcaccactcctagtcaacatagtattggaagttctgggaagggcaatcaggcaagagaaaggaagtgtattcaaataggaagagaggaagtcaaactaactttgtttgcagatgacgtgatcctatatcttgaaaaccccattgtcttagcccaaaagcttcttgagcaatttcaacaaagtctcagtatataaaatcaatgtgcaaaaattgctagcattcctatacaccaacaggcaagccaacagccaaatcatgaactcccattcagaattgccacaaaaataataaaatacctaggaatgcagctacaagggacatgaaggacctcttcaaggagaactacaccactgctcaaagaaatcagaggacataaacaaatggaaaagcattccatgcttatggatagaaagaagcaatatgaaaatggccatactgcccaaatagaatcaatgctatccccatcaaactactattgacattcttcaccaaattagaaaaaactaaaaattcatatggaaccccaaaagagcccaaatagccaagacaatcctaagcaaaaagaacaaagctggaggcatcacgctacctgacttcaaactatactacaaagctatagtaaccaaaatggcatggtactgatacagacacatagaccaatggaacaaaatagagaacccaggaataagactgcacgcctacaaccatctgatcttcaacaaacctgagaaaaagcaatggggaaaggattccctatttaataaatagtctggaagaactggatagccatatgcagaaaattgaagctggaccccttccttacaccatatacaaaaataaactcaggatcgattaaagacttacatataaaacccaaaactataaaaaccttaggagaaaatctaggcaacaccatcgaggacataggcatgcgaaaagatttcatgacaacatcaagagcaaaaattgacaaacgggatctaattaaagagtgtctgcagcaaaagaaacacagaatgaacaacctacagaatgggagaaagtttttcaatctatccatctgacaaaggtctaatagctagcatctataaggaatttaaaattacaagaaaacagtaaaaagtgggcaaaagacatgaacagacacttctcaaaagaagacattcatggagccaacaaacatgaaaaaaagctcaacatcactgatcattagagaaatgcaaatcaaaaccacaatgagctaccatctcatgccagtcagaatggcaattattaaaaagttaacagatgctagaaaggttgcagagcaaaaggaatgcttttacactgttggtgggagtgtaaattagttcaaccattgtggaagacagtgtgatgattcctcaaagacctagcagcagagatgccatttgacccaggaatcccattattgggtatatacccaaaggaatagaaatcattctattatacacgcatgcatatgttcactgcagcactattcacaatagcaaagacatggaatcaacctaagtgcccatcagtgatatactgggtaagaaaatgtggtaaatatacaccatggaatactatgcagccataaaaaggaatgagatcatgtcttttgcagagacatggatggagctggaggccattatcctcagcaaactaatgcaggaacagaaaaccaaataccccatgttttcacttattaagtgggagctgaatgatgagaacacatggacacaatggggcagggggaggaggaaagcatcaggacgaatagctaatggatgcccagcttaatacctgggtgatgagatctgtgctgcaaaccactgtggcacatgtttaccgatgtaacaaacctgcacatcctgcacatgtaccccgatcttaaattttaaaaatggcaaagatgaaaaggcagttcatgaaaaagaaaatcttaaacctgtgaaaaggtatttcatctcactatgaagtatttcctatgaagaaaaacatggagaccactgtttttaacctatcgattggcaaagagatgaaaaacctccgaacacactgtgttggtgaggagctggataatagaatagctgaaacagctcctttaaaggcagcttcactcagtctatcaaatttctaaatgcatatgacttttgcacagcaattgtgctttcaggaatttatccatcttgggcaagattatgcctgtgtgacgtagcaaatgattgaaaacaacccatctgggaatctggaagggacaggttaaagaagtcatggtatagcttcacaaataatgatgtagccagtgaaaagaatgaagcagatgtataaaactaataaggaataaccaaagtagaagaaagtacataatgtgttgccatttgaattcaaaacaaggatgtaagatgagtgacagcaagttgacggttgctgaagttgagtgatgggtagatagggtttcactgtactcttctctccaattttgagtgtttgaaaatttccataatctctcctagcagagaggtgggtggggggtagagctgagacttttcattgtatcccaaattgcgttttataaaagcctagtaacagtgacgattgcttctgggaagggagactggtgacaggtgtgaaggagactgttttccgaatgaccctttatactgttgagatttttaattataggcctatattacctattagcaaatgtaaaggctaaaatatcaggcatctgctttttatgtaattttcatgtttatagtaacaaataagtgggaaacaaatacccctttgaaccctgtaatcacgtgaacaacttcccttgaaaacatgttctgagaagttcccttcagggagagatcatgcttccgtggataactgatacccttaaagacatttgatgtttgtgtctgatgaataattagtatatgatgccaaagaaagttcagctaaagtttctggaagtattgggtaggtggcagggagagtccaagaccttggtagctgtgttttagatttacagggggaatggactcattgtcattaatccgtaactgagtgtgatggcgccatggagaatgacactgtgacaactgattttttactattttaagtccacatcaattcagcatatttcctacacatctattatgttcgaggggctggacttagctgtgcctgggatcagtctatgccttcagaagtagggcagagctggcatactggtaactccaggctacggcagcaggtgatcagaggtcctggagggaggactgtggagaggtcttaggggagggtgagatctggaatgcagggaaagggcacagaaggacactcaccagcacctttaccagttattagcctgtgctttgtgtgtagcaacagaagctctcataaaactcagttttcttgtatttcatcttcttcaggagaacatactaacaaatgggtcttctttttctcattacaaattggcatttctgatgagcaaggacctaatccccagatttctaggctctgcaagtgcaggtttcaatatcagacacccacacaggtccagaagggcacatgcccttatccattcggagccaaattcattttgttgaacagtttgaaagtttggacttaacctctgaactggccagcacctgactgatctacaatcgtggcttaaattaattggctttgctcacatctgcatcctgaccaggcatttgaaggagtagctgctgtttaccagtaacagccccagctcatcattcatcaccttttataaaggtttgaggaggaagaggaatttggacttccttgtaatagctgccaccgtcttcccatggcaacttaaacaaagtagccttttcttagatgagactgtgccagactggtgagtcttgtgttataaaatattatatgttgcatataatacagacagataaaagttgttgattaggagaaatgttgtgttttgacagcatcactgaactgaagatctccacctctgcagaaaatgcatagagccttctttaagatgcagtgaacagctagatgaatacactgaattatttttcctctaatatagctgatgggatgaaaaaagtttgtttccttgatcaagactggggagttaggatgagaagcttgaattccaagggtccttttaccatgaaggaagtggtacattgcaaaggtatgtttgtggacaagagggtacattcattcagctctccttcatttataagtcaaacagaacatttatagaaaatgaaatggtttctataaagacctagcttacagtttaaatgtgaggtggaccaagatggtgtttgtggtagtgttttcttctggaatgcttagtacattgggacaaatgaagcaggattagctgtgtgtcacgttgtcctgggcagggcatgaggaaccccaaagtacaaaatgtcagtggattcaatttgtgctgccaaacaagagtcacctccaaatattctccacacctgcatggaattaatttccgttccctatgtgtgatgggagagaaatcacccacttaatctatatcatatgtcttagaaaagttccagacagacaccagcctggagtgagaaatgtggatttttcagtgactgatgtttaaagggtaacatttccttagtttcataaaacagaatgaaggactttttcgggcctgctttaaaggaaatcttgcaagagtccctgctggtggagaaaaaaacaccagcagtaggaataccttcctctgataacatggtctgttagccccagtttgacatggtacacaggtgagttgcttaaaataaataaaaaagttcaggatgaggggtacatgggaaaggagcttctctgctctttggctacctgaaatgtgcacacaaaatgctaatattggtgcattttatgagttcatagcttttgtcagattctcaagtccacggaccagaaaagtttagggcatgctcaccaccttccatgactgcaaatctaaaacaaattagaaaaacaaatgtaaaagaactgtcaataaacagaagaaattatatatggactttcactaataatgaaatgggagtggactttgcaagcatgaaaggaatgggaaaattcacaaaagaaaaattcaatattcaaaaccagaattattcttatgccaaaaaatcataactaaaattacattaaaatatttttaaaagaaacttataaaccaagaagaaaacctctacctctcaaacagaaataaataggcaaaggataggaaaagacaagtcacagaacaaatacagtgaacagcagtggtatgcttgagctggctggtactggctcataactgccagttccctactcctcattcagtaatgtcacactagtagcttgaaactggccacaatgggaagttttataccagagaaatcagctgtaaatcagaatttttttttaaaagggccagtttgccagcataccattggctaatggatacataaaaagtagttcaagtgtaccagtaatcaaaaaaatacaaggagaaatgaggtctggacaaggtggaataagtacatttcaccctatttctcctgctaagtgcaacaaaaatgtctggacataaagtatgctggctagggatctcagaactcaaggaactacccagtggtgtgtttgtgtgtgtgtgttcttttatatatcttggcctgggctctggataggcccacaactggaaaagcctgctatcttgagccaaaagactagagaaagagcagtccagaaacacagaagtgttttgaccatacctgaccttactccagctcaacacttgaaaaaagccatgcctccctcctgctcctcaccaggcatcatagcctagagactggcagatctctactttctatcacttcttgcaataacatgccacatcccttccctggaacagagactatgggtagaacttttagtggatttctcatcaccatggagtccagaaggaaggggaacaacatttttaaagtactgaatggagaaaacagtcaacgcagaattctatatccagcaaaactatcctctaggaataaatacattctcagataaaggaaaatgaagagaatttgtcacctacagatttgctttaaaaaatggctaaagaaagtttttcagacagaaaataataagcaaagttaagttttaaagattatgtttggctgaaagcaaaattacaacatctgcagtgactcttagtacacataaaggtagtatttaagacatctgtattataaaaggaagaggaaaagcgacctaaaaggtgatagtttctgtattctacttaaagtgaagaaatattgactagtagactgtgataaagtaagtacatacatactgtaatctttagagcagtggttttcaatcaagggaggttatgcctttcagaggacattttggcaatgtttggaaacataattacacatgttacttccatctagttgatagaggccatggatgctgctaaacattctacaatgcataggaaaaccccacataacagagtattcagtacaatatgtcaaaatgctgaggttgagaaactgccctagtgtaatcatacaaaaaaaatacaaagatatatactcaaaaacataaatgcagataaatcaatatggaatactaatctacaggaacacagaaaaagcacaatgaaacaaaaaccagagagaacaaacagaataatattaacatggtagacttaaatccaaacatatcaacaattgcattaaatatgaatgttctaaacacacctattaaaatatagtgactggctaaatggatgaaaaaatctatatgctgtctacaagaaacgcttttcaaatgtaattccataggtatgttaaaaggatggaaaaattcatactttgctttttatcctgtttttagaagtaaccatttctgtttgctgcaatcatgaatgatgtttcctattgtgaaatatcattcatgattgcaaaaagacaacactaatactaatcaaaataaaactggagtggatataataatatcagataaagtagattttagaacaaagattaccagagctaaacagagacatgacataatgataaaagggtcactttactaagatgacacaacaatcctaattgtgtgtatcgcaaacaacagagcttcaaaatacatgaagcaaaaactgatgaactcaaaggagacacaattatagtggaaaagtccaacatctcctcttggtaactgacagaactactagacagcaacaaattgagatattttgttgtatttatcaaactggtaaaagttaaaatttagtgttagcaaagtcatggtgagaaagacaataacaatgtgggaacgcaaatgtatatgagttctgaaaaaatatttttatattatgaggcttaaaatggtcatacaatctttcaacccaatattttacttttaagaatctctcctaggggaataaagaggtcccaagatttacctctctagaactttctaacagcaaaaaatgatacatcaatacatgcccaataatttgcaagtacttaaacatttatattcaagtatagtgttattattaaataggatttttaatgccattgtaaatgggactaatttttaaggcaaaacaaagcagcatataaaactgtgtacaaataaattatgttaaaatacacaattataaacaaaaaatattaatagcagtgaaaaattaccagtgattatctcctacttatttgcttgttttctcctcccttcaagttttctattgtgaaatatcattcgttattgcagcaaacagaaatggttacttccaaaaacagcataaaaatgagatgatatacataaacaatacagtgctaagtttggtacggagacactctgtatataggtggtatagttcttgtaaataattttgaaataaaatgatgagagagtataactgatgcttcttagggtgaccatctgtcttagattgcctgtctctattttactgtacaggcctaattattactagtccctctgctattctcaatagtgtcatcgtttagttgcatgagtggtctaactattcaaatacttaaaaaattataactagtaaattaaaatatatgacactcttattattatactccaggcaccaaactaactgctttatgtggattatctcatttaaccatctgagtagctgaattatctccattttacagaggcaccgagaagttaagcaacttatctaagctcacacattaacaagtagcagaatctggatttgaactacatcctatcatattagtactgaaagcatacctgggcctgcctaagtgcaggcttggctggcaggggtctggcagggacgctaggtgcacgtggagcccggtggaggggaggaagcactcgctgagttgactggggctgagggacattcaggccgttgaggggtctgctgatgtcaacattctgacactgcagcaatctcctgggattgtcctgtacagtcaaagtaaaaagccatgctatagcgggtttcaaaaatatcagtaactccttaaggaaaaagcagtgctaactcatctgttatagctgaaggccaaggtggggtaaaggaaagaaatcaaggatgtacacaagaggggaattatttttgtatttatttaaacttcaaaattcaaacagaagcatcacctgcctccaccccaccaaatctggaatagaaggatcgatttttgtttagattttaaaaaactgtttaacaaataggtgcaaagcacttgaaaaagtaccaagtataaagaaagacacggaccgagatcttagggaagttacaaaagagatgtgaaaataagatacagcttaatgtgttcaaggctcaatgagaactgagaaaaccactggggaaaggagagttgcggcttcaggaagccagggctgaggttggggcttggagttggagacgttctcccatatggtaacccttgttcttagaacaggtgctgcagggacccttatacctcaggcttctaccccttccttcctctctttctaaaaacagcttaattgaggtatagttgacataaagtatacaacttggtcattttttgacgtgtttacacccatgaaaccctcacaacaaacaagtggacaaatgaatgcatccatcaccccaaagagttttcttgtcatgcttctcccttccctctccctccaatcatcagtctgctttctgtcactatcagtttgcatttgtcagaattgtatataagtgggatcacagagtatatactctggcttttcttcttttactcagaataattatctagagattcatcctcaatgttgtatacatcaatggttcattccattgtgcaaatataccattgtttatccttttactggttgatggatatttggattgtttctagtttggggctctcaaaaataaggctgtgctttttttttttttttaatagagctgcatttttcttttttacgaaaatgaagatgtgcttttggctaccacacaaagccgttctcgcttatggttccacctttggggacgagcaggggtaaagcttattgggaatggcagcctcctccttggagccccaccctttgcgttttttggatcaagggagttaaaacagtttattgcctactgcatatgcagcaatgatttttcaatcacttattttttttgacaccaatcttgttcactgttataatttggactcttgttgactaagttcaatattcaagaattcttgtgggtacatcagaaaaactcggtggggaagaactattagaatgaactctagctgtaattcaccagggtagcaagagggttaagagacagcagggagccgtgaggtactctgggttaaggatccagttctctgaaaccacagggtggacagggcttcctcagctcagggctggagcaaaatggtcaattctgagagctccatgtaacttttgaaaaatattttaagagtaacagtgggctaaagcagctcacctaaagccaggtggtggcatttggaaaccatggtggggctggcattgggggctggtgtcaggagccagctcgggctgcagacccagtggggccccagaaatgtggctggtctgggtgactgaagggatcacagctcacactatgctgcaccatatcatgcagggggcactgagtgcgccaacaggatctaggtgggcttccatgggggcaccgtggggcctccctctggccccagatcacagagaccctccctcagagcctgctgacctagtgaggctgactcagcatttcacaggcagcgcctctaggatcccattcttattcagtctcgtattgaaaacctcatgtctgcatgtgtgccctgagcactcacatctactcaagactcaccttcggtgggtaggaatctggcggcttcctcatcaggccttttccaaggtggccgaggtgagcctgacagggttggaagccacggggtggccgggaagggcgcacacacctgcaacagaatcccatacctgctgaccaagcgtgtttccccttctcactgacttgactttttacactttgctcatagtggcactcaaaagacagtttacttaactcagtgtgctaaacatgcaaaggaaaaattacctaataacactcttaggagattaaaaaataaatactggtttttccctcaaaacctctattttgtcaaattagttctcacgctccatagaaatgcagtgtagtgacacctggaagatgatttgtatgaagctggcatttcagcgataatgtctttgaatatatttggatcaaaagctaccccatctgatgaaaatatttcaatgtctccatgttgtataaaaattactaatataagggtgggagaaaacacatcagtggaatttcctgacaccctgctagcttatgtaataagcagcacattgttgtttgaagggaagtaaaggaggcagctgatctggcagaaatttaaaacaagaaaccccccaaaaaagaaccaagtcccaggtttatgatccagaaaatctgacctttgctaaaaaaatgaagtgagaagcagtttgctgtacattttctgagacaccatttctttttttttttttttttttttttttgagatggagtcttgctctctcgcccaggctggagtgcagtggagtgatcgcaactcactgcaagctccgcctcccgggttcacgccattctcatgcctcagcctcccgagtagatgggactacaggcacccaccaccgcgcccggctgatattttgtatttttagtagagacggggtttcaccgtggtctcgatctcctgacctcgtgatccgcccgcctcagcctcccaaagtgctgggattacaggcttgagccaccgcacccagcctctgagccaccatttctagaacagatgacaagctaaacccagggtaccttagtttttcaatggtggtcttcttatttgtaaacagcagtcgtatcaaggtcttccttttgagataaaccacaaatccggcagcaagaagacacaggatggtcaccagaattcctatggttaaaccttggttatctgaaacaaaacacatggggctcacagaaggaggcagttacaatgaaatatgggaggtatcaagttgtgacgtttatggcaaagtgaactctgaagcaacagaaatgaagagagtacacccgtgagtgatgtactaataaactgtcttacttcagatgccatgtttgaggttcaatctatgttaccatcattcatttctgacaactctagaacttgctaaacaggaatatatagtcgggtaggtggggtgatggtctggaccacgcaggttccctgaggcgtgacaacggcacagtggaccatggtagccacagaaggtagcagggagccatcactgaagcctcactggaatcacagccatccccaggctcaaatgtttccagtccccagcacagatttgccattccaaagtgcttttctttactcattctgtagttgggttctgctttatctcttttcgtgtttttaaaaaatgaattgctttcttgctggacatctcaaagtagatagtgaaaaaagagaaagaaaactcatttaaatgaaacacccatgggttttgctttgttatgttggggacttaaaaacacagcctttgtgggggaaacccttttcctgggaggaagctattttctctatgaaaacatcttcttttctatgacctgctgccattttgtttaatacagttaagagcctcctcaagggtagggaaaggaaggaaaaaaatcaaaccatcaggttggtttcttacagtagctatggtcagcggctgtctgggaaggactctaaatgctcagacttagaggaggtctacctgtgatttcaactggacagtgaatttttagaggacagggatcttgattcatttgtcttcccatcagcaaggatcagggtgtacttcacatcaggtaagtgtgcaacagtcctttccggctgctggtgatcgccgtgatgcagttacctgggctctcctcggccctgcctcccacctggaccctcagctggctgtggatcactgcagcagcagctcctactccagggaaagaatgtctttcacaccttcttggtttctggaccccatcccccactaacaaggcctatcagggatgtgtcttagcctaagcaagacagccaacagatgacagtcttgacttacttgttggtgttactggaaaagcattgcttctggtttcctgggcaaaatgtcactcttttcagacccttagtagtgatcacagggggctctagctagagttctggtgtctcataacaaagttaattaaagttaatttaaaaagtgaacagcaaaaatcttgaactataatttctagttccataaagtgaatccataaatcttcaatacatcaatctatgaaactgaacatttacagggcccccacactgaacctgctgaactccccagggttgctcaagccagaggcccgggcagtgactgactccatttccctcttccccaggaccagcacgagcaccgtgtcctgtgtcccctcctgttggcccagtccgcactctagaatctgagcccaggccagtccacactcctctagatcttcgcacagccagctatctcggcttcagaatgcatgtttccctcgcccccttcagacctcaacagatgcagggtccccaggagccttcctgacaaccccctgccgctctgtgggggttgctcccctcccatgatgccctctctccctgcagtcgtacccctcacttatgccatgtcattcttgcttaatgtctctccaggacccaggagagtggctggtgtgtggcagacacacaagtacttgtttaatgagcccctgagccatggccaggccagggagcagtgagccatgcttgctcatggcctgccttgattttatatatgtatgaacagggtggaggcagcggtatttcaaatgcactctattttatgcagtaatggccacgggggatggagttaggctcttacattgttttcactttttaacattcttacttgttaaatgaagggttggtgactctgtgggttccctggctttctgcaaaccctcaaacctgagtactgctggtcacgcatgtccacagcaaagagccagagttcaccgccctttctcctaccttcttctccagtttgtttcattgccattcagtttgcttggatggagatggaatgggtggcagggtctctgataaattaaaaactaaaaccctgctattttcatataataaatgctaaaagccatatcagagcattaagttgcagccagagaccagtcatcagggctgccaaggctgaggtgtcactggggaaaggggacactgggcccaacccttgcttctcccccactgctgtggaggctcagtgaaaggccagacttttgagtcctcttcctccttgctgcagggctggggcctgccagagtggtaacctgctactctctcaggagcagcactgaagcatgtccatgttttagcagaagctcaaccaggaagtcgctgcccttccttgcactgtttctgcagacgtgcctggtaggctggacttcccctcctgagccccgagaactgtgttgtgtctgttgtcatggaaacgatggcaaagccacagagtcaatgctgccagtcacaggaggccttggggacgcgtgacctcctctgcagcagcactggtcacggtctccatgtcatgggagggctcagatgagtgtcagtgaggcagtagacgcatgctcctgcgatcccacgggctcctggccctggccgcgctccctgttggactctgcagcttcctgccttgcttctttccctcgaaaagaggcatcatttagacttgcccctgaattgcccaataagaactcagagaaaacagcaccgcaccagtaaaccatttctaaaggtcatccgaggagaaatggccacgagttcaagcacagctgctactaagagcttcttgggggacaggcagacctgtgtgtgtgtaaatcttagcgagatcacattaggcaaattacttaacttccctgagcctcaggtcctaggtatgtgagaaaagaatcataccaccttcttcagagttgtataaggaggggatgacatcatgggcataaaatgcaccacacagcacctgcacacatcattccatatgcaaaagctgttgcaatgactcccactgctgccgtgactgtcacctttactaagaggtgggtgtctttccagtaagatttttaaaaggcattaaacttcacaccttgtcaccctaccacacagatgtcggcctttacaaagtactttgatacagtgatgacattcatacccattcagcagttcactatagaaatgaccttagttaagaaaagtgtcgcaggctaaggaactggcaaactcagccactcagtcaaagcagagagcaaggagcctcagagaagatcgggcagggatgagaggggcatctggaaactgcgggagaccctaggctgtgtagacccatgtggggtccccactgggtttcttgttggctctacctgcacccatgctgacagctggcgagcccacccgcccccaggtgctcagcctcctcccaccgggatgcaggggcttcactgacctgcttgccggatggggccgctgtctgtgcttcctccaaagccaaacttgtcacagaagggaggtgcccagtgggcctcgcagtggcagttcttcctgttgttgcacacctttcagggcagaggggagggacgtggggttagggcatatgctctgtgcatcaccacagcagaagcaaggggggccatggtcagagcccccccccaacactgacacagccagactcagcacacgccatggtgcgaataagcccaaagccggcactacacaccacacaggggcgaccaaacctgaggctgtgaagatgcatcatctgcctattagtggctgtaaagagagtgatgaagattatttgggttcatcagcttgcctcccccacccacctcacttccttctccatctccccatcttcctttttcaatctggaaaactgtctgaccatgaggagaagccccctcagcagtgaggagggaccgtgctttggggctacagacccagagccctggggcaccgcgggacctgacagatgcttggcgcatccctgtctccttcagacagaaggctcagagaggctggtgactgccgggtcccacgccaggctggggtccgaggcaggccccccgtttcctgagcaaaggaatcctgtttcctgcaatcctagcagggtgcatgggatttccactaatacttcctgaagcctgtccccgtgtgtccttcctgcaacgcctgcctccttcttgcagaggttcccagtggctgttccctggctcccagtcacgcaccagggtgcgaatccaacagtggattcttttcattgtgaaataagagaatggttctggcacggcgggaaagggagaccaagaaagcccgaggaggctgtgcttcacccttgttgggcccagctcatagaccagagcattccatgcaggggccagcagcccctgcccacctggttaccaagggctactgatggcggccactcccaagcctgtccatgctggttggactcgctattatgccagatgtaactaactgaaagtacatgatccaatggaagatgaccatgaagatgatatatatttaatatatttttttctatgaaaattaggttgtcaagtccaggcacggtggctcatgcctgtaatcccagcaagtgggaggccaaggtgggcagatcacttgaggccaggagttcaagaccagcctagccaacgtggtgaaaccctgtctttataaagataaaaaaaaaaaaagttaaaaaaaattaggttgaatcctttgggaacactggattaaaaaagagaaatcactaaaagaatttctgaaaaattaggaatgagtgggactactgcacaatgattgggaagagctgcagaggacaaggaggaggctgttcttggatgctgttgagtgtctaaggttcccttccacaaaaagaaacgaactagaagttgttgatgatgcatttttgggtggtttatatcaggaagtcgatgcacaatgacattcagtaaatcaatcctaaaggcctcagcccgccatcaaaatatggctgccagatatacagtttcatattttaaggcaaaataaaatgcgtagagtatatgtctcccatgtaatgctttcctgcttcaaccgacttgttttgatgaatcaaccacctaccctcattgcttcagataagaaggccgactgtcaagataggctttaataagttagaaagtagactgctataaagcagaaattgagtagaacttgtcagcaagtggcagagcctacgtcaaatgtaagtgtcttgcctgtcccctcaaagatgctgctgtggacgtactagccccagattcatgcctgcccctcatggcttctctctgcaacttgtggtcatgcgccttgttttaaaacccacaggaaggtgctgccgggagcctgcccttgttagggtgggactgtggccaagctacccttcagcaaggctgggtaggctccacctacccagcaaatgcgggcctctccgctcccatgtgtggataaggccaaggggtattggaaagggagtggtccagggtcctcaaccagcttgcagcttgccggccatattaccttgggcacaccatccccacagctcagggcctggcttcttcagtaaaataataggactggacttgatcatctcttaacagccatcagaaaataatctatgatccaatgaagacataagaagattccattgtatattgggagttagctaaccttaccgtcaacacccccatctgaggtgacactgtgatcctttatggttccagcatgatggtaatttacaaccccctccccccatgcacccggtaattctgtgtaagaatcattggcaagtgtctacaagttttaaaataaagaatttggagcaggatttctgtaggaaaggtttcaggaaaacaaatgaacctctggtgtggttaatcaagactaatatgattccattggaaataagcccatcaagaaaaataaattatgttttcagcaattagagtcctcttctaccctaaaggttctctgaactaaaataacagccttctttagttgaaacccattgtgtgtgatttcaagaacatgtgtttaatatgatctgttgtccttgttttaattccttttggaaatatttcagttcagacactggttctgaatgttggtagtaagaggaacagcacagtttgaaatgttattttgaaactcttcatgaaggaaggttgcttttcaaattactttgaacaacaaaagtcttttttaaaatcatagaatgttaatttaaaaggtaattacagctcagtctgattttctttgttaaataaaagtcacatgaaaaggtcaaaagaaatgaatacctttagaagaaaatatttcaaacacaataactgctctatttaaaaaatgctatggattgcaaaaccttttacaaatgaatgtattattacttaacttgttatgggctggctgtaaaagggcagctcagcctactcacccctctgccgtggcactgcattgcacactcgtgaaccccaaagacactaatattttgacattgacgattcaggcagatctgtaggaggaggaaaacacagcaaatctcttagtatttctccaacccctccagcatgcatacatacctgtattcaaacaaaaagcaagcaaaagaaagcttggagaagacccaaccttgtctcagttaatacggatggagcataacaatacattttatactggactcaggcatggatcttattgcctgactcctccaaactcagcacattttgagactaagttcaatgtcaacactattaaattattttgcattttatggcttttaatataactttcagttgatcctaaaattataactgattttcttatgagttttgtttggagcttgtaaagaaatctatgtactgcagtatttttttcttccattaaaagatacaggagagggcgaggttgggcacggttgctcactcctgtaataccagcactttgggaggccgaggcaggcagaacacgaggtcaggagatcgagactctcctggaaaacatggtgaaaccctgtctctactgaaaatacaaaaattagctgggtgtggtggcacgtgcctgtaattccagcttcttgggaggccgaggcaggagaatcgcttgaaccagggagttggaggttgcagtgagccgagatcatgctactgcactccagtctggcgacagagagagattccgtctcaaaaaaaaaaaaaaaaaaaaaaaaaagatataggggagggcgagacagattactccttatcccagggcctggatagacatagatggagactccaagaatccagggttgaagagtcttttaagggagaggttgaaatatgggaactttttccagatactgactgacaagtagtatcatcaatgacataaaccatcagcaacgaggctcagcagaggaaaacagacggctccttgaatttatcaagctgttgtagtggtaggcatttcctaagtgatactgggctggctgaaagaactcagcctcatttcaaatgtgcataatatactccagactcaagggatgcagccctttatctcctataagattttacaaatccgtggagtcaaaggaaaaagagtctaacgttcaaatggcagaagaatttttaatcaagtagaaccttcctattgaggaggtcaccatccgaccccaacagctcatataagggcaagaggcatagcctttgggagaagcgctggcccaagcagcactgagggattcccactcggtgggtgcgaatcctggccaaggggatggtcacattccagctgataaaagaacctgtcctggattacagtgaacacagcaggaccctcatgggaatcactgcggatccctgagccctcagagaaccaaggttctgagatcaaagcacatttcatcttgaacgtggaaaacaaatttgatgataaattgagcccttggaattggaatgtccagatgcacctggccctggctgttcaggctacagtttaaaaaaaaggtgtcagtcagaatggctgttattaaaaagtcaaaaaacaacagatgctggcaaggttgtggagaaaaaggaacacttatatactgctggtggagtgtaaattagttcaaccattgtggaaaacagtgcagtcgttcctcaaaggcctaaaacagaaattaccatttgacccagccaacccactactgggtaatacccaaagaaatataaatcattctatcataaagacacatgcactcatatgttcattgcagcactactcacaatagcaaagacatggactcaaactaaacgtccatcaatgatagactggataaagaaaatgtggtacatatacaccatggaatactatgcagccataaaaaagaatgagatcatgtcctttgcaggaacatggatggaactggaggctgttttcataagcaaattaattcaggaacagaaaaccaactaccacatgttctcacttataagtaggagctaaatgatgagaacacataggcacatacaggggaacaaaacacactgggcctatcagagagtagagggtgaatgagggagaggatcaggaagaataactaatgggtactaggcttagtatctgagtgacaaaataatctgtaccacaagcccccatgacacaagtttacctgtataacaaacctgcacatgtacccctgaacctaaaagttaaaagacaaaatatgatttgagcctaaaaatatcagatgtcattttaatgtcaaggcctgaatatgagcaaatgtgggtaaggagacattcagaatgtataagaagattcatgtacgatcctatttctcaaggaaaaaggatttgtggctcagggtgtgtggggccaaagacaggagagtggaggcaacacctgtcctcaggattctgtctctgcctctgtcttttcttgcctgtgtgacctcatgttagtgagtgatttcaagaccatgttgaaaatggagtcctaagaagcatttgggggttgtttcatccttttcttaaaacattgtattcgcttgctgtcatttagtctgatgagaaagtttggtgaaaaaaaaaaaatcagtatggcagagcatgaaaatctcaaattctttttttcttccaaaaaaaaaaaaagtttgactttatttctaaacctcaaaatatctccatgtatctttctccctgttctctgaaaggactcccctctggttttgagtttcttccactcctttccctctcctattcttctctctacagggttctaaaaatacatctgatttcccattctgttcaggtgaggacaagcccccaagaactctgtgctaaaaaccaagccacatatccaaaaccaatagaatatgcgattgtatttctttccaaagtaatttcctggctagaagtcctcatgccacctggagtgtagaaatgacttattaacactcaaggcctaagaagacaggcttgatttttccccaatctgcattttaatagtcagaccaggatctaggatttattgactttttcttctaggtgcatctgagaagaagtagatttaggaaaaccaacaaaccttgtaacccagttcttgctgtttttcaatgggccctgttccagacttacatttatgatccaagcaaacatttgggtcttacttttccatctgcacactttgtgcctgcaagcacaagccctgggtccggcatgtcatcgcccaagtacacgtgggtcccccggcacagaatccggcctccttgctgcagggggatgtttgtttctatggaaacggcattggtaccaatgactggccggctggcacctccttgacactggatttttccacatttagcatctctggaagggtaagaacaaacaattcccaaggagaaaccatttggaaccaaccctatgcaatgtgggaaggtcagagcaaagactttgccaggatgtctggattccatacctcatctcgcatttggcaaaggaactcttcgagactttgccacagttgccataaggatcacctgcagaattgactctctcaaagcagatcccaggggcaggtttagcacctgaaacagaagcagaactgcattttcatctcctgcaggtgattttttttttttcatggctgtaggcctctcaaatggttacggggagacgtgctcaaagcaatcacacccagtgtctgtcccgactcatggtgggagctggccaggggaagcctagggtgtcagcagctcgcatcctctcttgactcggcctctggcagagcacatgttccaatgcttactcttccttaggtctgctctctgggcttgtggcatgtgtggcctctcaggaaatgaggcctggctgtggaatgagatctgatccagggcagaaaggaggtggctggctggctggctggctggctggctggctggctggctggctgcagagaaggggaagtttgctctctttaacaacatcccacacaattccggtgaggaaatgcaagccagggcaggctccaaaggagcaatgaagatatcttctatgatatttttagtcccataaagctccctataagagaaagtactaccttcttttaataccttctattttatttgcaaggcagagatttctctcagaggccatggagtcataaaccctggtaatccctatgtacaacatgacggttcccagcaaagagggtcatggcagccagagagctcagaaatggccatttttagcacatcttccagccacggagagagcacatataatcagcatttgcagccaaagttctggaggactcctgaatcctggacatagtgatgtctgttgaagactattgagcaagtcaagaaaacatgccacattctttagaacaaaccatgccctgcggcgtggtcccttttctctccctgattggtgtcctgtttggcactttatctcacatcgcttctgatggccaggatgccgacactccagagcctcactctgactcctgcccttctctgctctccaccctggggaggctttgctttccaaggtgacaacggatttatttaagatacctcgtcccagggaacagaagatgttcttcttactaaaaacatcccccttcgttagcctgcacctgatcccttctcatcagctactagcagacatgatcatctcattcaacacacacgtgccacaccaccttgccatcatttgatgtgaacagtgtgctcagcgctccaatctctgcaatgagccagccttgcacctctccttttctcatttcttttataagccatgttagagaagcctctgcaatctcttttttcaggggcattagcccagactggacacaattctctgtcatggagaaagatgaggtccctagctcctcacatcacatgccctttccttccatctgttccacatctgccttgctcacagtaggatgacaccaccgacacactcagctcctattagggacctgatttgtccgcattctgccttctttttctctttcgtctatctgtcagagcagggaaggatggggagggagagcctcagtgtggaacctgcactttgtgcttaatttaatcctgtttggcagcacttttgatcaaagtactgggatctgattgatcaaagcagtttggaaaaactggcatctagaatagtaacaattcaacaattgtttgtgtttttgcacacaccctatgtatttgttgcttgcctaactctatctccctcccaaccatccttctttccctctttttcctccctccttcccttcctacttccttccatcatccatttatatacccatctatccattcatccatccatccactcgtccatccagccagccacccagccacccgtccatccatccgtccagccagccacccgtccatccacccgtccatccatccatccatccagccagccagccacccatccatccatccatccatccatccatccatccatccatccatccatccatccagccagccagccacctgtccatccatccagccagccacccgtccatccatccagccagccagccggccacccatccatccagccagccagccagccagccatcatgttgcaggcttcaatcagacacatgtatttattcagcacctactatcttccagacattgggagtataagagggaccaaactggacaaacctcctgcttgcttgaaaattgcaaggagacacagaaaaaagacccaaatgattatgttcctctaaagcccagtgttagggaatgctatgaaggtagaaacagagtaggagggttcaggggactgttgcttttaaaggcaggctggtcaaggaagacctcttagagaagacatcatgagctgaatcctaccatttaatcctacaaggtaggtctcattattccattttatggacaagaaaattagcacatcagaggttaaatatatttctcagattcacataggtaacgaaggcaggatcatctaagggtgaagccaggcttctgggctgttccctcctgtgctccatcctcacaggtgctggaccctgcactgggtctcaggtgtagagagcagattaagacctggccctgcagcccaagcaacaacaggttcagtggatgtggggtgtgctgctgcagctgcctgtggaagggctaagaaaatggggcaggaaatggctttgttgcttctttccctacttcataaggctaggactcggaaatacaagcagctcctagtgactgcttagctcctaggaaatgggtgggtggagttgacatcactgtgccattgcacgcaatgctattctgatgtcctagattctgctacctttattataaagtaatttctttcttgggaattgtgaccacttaaaaaatacatataccatgacacaattcaagtatgtcagttgatacatttgttttccttatagggagctctaaagagactttgggcagtttcagacacgtgagcttacaaacagctcaacagcagcctgggaggagagttggacaaggttggactggggagtacagaaggataaaaacaaagagaggaagggggagagagagaggacgagaaagagaccaacctcaacagggattgaagacgctgcaaatgtactggcaaagcaaaggggaagcttgatacgtgaataccagataaagggctatcgttatgataggaagtcaagcaaaggcatggaaacagtgtgtaatcaagtataaaagcattctggaagtgaaaacactggatctctacttgggaatccaaagctgaaacacactgagccttctgggtcagagtgtgacgtggtttggatctgtgtccccaccaagtctcatgtagaattataattcccaatgttggaggtaggacctggtaggaggcgattggatcatgggggcagtttctcttgaatggtttagcaccatcaccttggtgctattcttgggatagtgagttgagatctggtcgtttaaaagtgtgtggcacctcccttttccttctctctcttgctcctgctccggccgcgtgatgtgcctgcttctccttcaccttctgccatgattggaagctttctgaggcctccccagaagcagaagctactctgcttcctgtaaagcctgcagaaccaagaaccaattaaaccttttttctttataaattacccagtctcaggtatttatttatttatagcagtgtgagaacagactaatacagggtgtgcttatgattgtaatgccccaaatgctggtggagcagcacagctcagaaaaccaggtgtgtgtaagatgcaatgccttgtttaccaataacgcagaagcatggtacacgccccagcagaaggccacctggcatttcaggagcaccgccattctcccaaagacaaaccctcagaaaggcttgtggccaattcgaatatgtgaatttttaccaacacagatgacacagtcaagcatcatcttataatatgctgtcaattaacttaatgagaaacagttaaaagaatcacattttaatttagattgtcttaaaaaaaaaacctctcccacaccgtggaacaattttactgagatgacgtttcctttggtctcagtctttttattttttttgagagagagtttcgctcttgttgcccaggctcgagtgcaatggtgtgatctcggctcactgcaacctctgcctcccgggttcaagctattctcctgcctcagcctctcatttagctggaattacaggtgcccaccaccacgactggctaatattttgtatttttagtagagatggggtttcaccatgttggccagggtggtctcgaactcctgacctcaggtgattcacccacctcagcctcccaaaatgctgggattacaggcgtgagccaccgtacctggcctggtctcagtcttcttgctttccatggcacattccctgcacttccggctttctcaagatgctgacattttttcttctgttatgttatcactggaaatcttgtttctaggttcaagtacccactcttccaacactttttaatagagaaagtgagcactttctctattagcccagtgggtgtatattcataacctccacaactgaaccacccactctattgcttatgaaagtgaacccttaaaagctcttttaccagaataaccaaaatgggatgaagtcacagccgaagaataatatttaagcatgtgatagatgcacctgcctttttttaaacctgattttgtcaggcagccttgatgaacctgcgtggatgcaggatgatgagcgccaaagcgccttcccacctgctctgcgacatccaaaaggtgtggctgagagagtgacaggtcagtggttagcgattctttttgctggctactttcagggggaagccttgttttatagctgggcatgtatggggtctaagaaaaatacctaatgcctatcagtcttcagcctttttagattgccccctcctgtctgactgatctactcagtaaccatgcttcagagttggaagaacaaaggcttggaactcgggctgatctggcattcaatgtccaaaaggccttgttgtacaagctctcgaggttctgtcccctcatctgtaaaatggggacaaggacctgactcaaaggtgctgtggaggtgcatcagtgtgtagagctcctggcatgtggcagacccctaggaaacccaagtgataatgaagaccaccttggactgtggggaaggtgtggcttctggactttagggctgggggtgtgtgtggggagaagagagttccttgtaccagcccctgctcgcatcacttaccacacctgtaacgattcatgatcacgtcagtaggggctttacatccatctccctcacacttcatggtctccagggccttacacattaagggcaactagtggagactgtgggctaaccagatgcctcaggaaatgagaaggaaagaagagaatctcatctgaaaccctaatagtttttgcacatcctttgcatataaatcagaactatcatccagcacaaggatttcaacttccctgcacccatccccttactcctttcaatgagtgtggttccccacggcccccaaatcccagctggttctgggaaccctcctggcctgggcttccagactccccctgagtcagcacccagtgccacattgaaagaggcagcaggcaaccctgggcaaagacccttgagtctgacttctctttatgccactcaaccctagaacaaagatcattttcctgtcattactctccttgctcttaacaaacacacacactttaaatgaacgatacattttagatcatcagcaggccacttgtaattaaagtatggtgctggatacagcacgcggtatcatctttgatccttatagccaccctgtaaggtctacattctccccatttcagagattttcacttagactcagcgttttagcaacttgccgaagatcacaatgtaaatggcaaagttgggtttgtctcatgggtttaaagccaaaacccatgatccagccatgatcctgtgctgccttcctcttggaaaccccctacttgactatagactcctgtccctgccatcctttcctcttcggaaccaccaacatattctcctgtaatccagctgctcatggagtcaacaacttcttcaccaaatctttttccaaaaaatctcctgacaggtgaggacgacagctgcctcatgctcatgtctcaggtgctgaactgacctgggtcacggcctaccccctgcacctgagcatgcttagtgagatttccctttaaaactgggacaatggaggcaggcagcagatatttgtatgctttttgttgcatctatactgattcagggaaagaaatgaaaaattcggagtagaatgacttggaaacctctgagggagcagttcctcaagaaataaatctcagtgaagtttggccagtaaaactgactccactctgccattaattcatccagtggcttgaacgatgcgaggttctaaaggttaactttctgtctacctccaggaaggcaataacggtcaccttctaagagtttcattcatttgagctttcacccaaaacatgagggagtgagggatgccatatcatactttaccactgaaatatggccaggaagtgatgtccctgaggcacagcaatgatagggctcactgccacatggcaaagaaaaggggcatttgcaggagaggcaggctatgatttcatcagccatgtaaacacggggataggacagatgcatttctctatggaatcaaaggcccgaatgcatactccagcccctgtcatctactttgttcattctcttccctggagaatgaagaaaagtggctaactcacgggtagccccaatagatacgatcttttgcttccttttatcagtcctctgaaactgctgctgctttaatttggtagtggtggtgagggtttgcaaggaaggtgggaggaagatggagcagagccctgtttacaatgcttactcttgagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcccggggtcgggggaggggggagggatagcattgggagatatacctaatgctagatgacacgttagtgggtgcagcgcaccagcatggcacatgtatacatatgtaactaacctgcacaatgtgcacatgttccctaaaacttagagtataataaaaaaaaaattaaaaaacaaaaaaacaaaaaaacaaaaaaaaaaaacaatgcttactcttatccagttggccagggtgccttaccctggagtctccaggctgtaatgagaaatctcccatgaggaacacggatgtttaaaggctaaggggtttcaaatgaaccaaacttctaaggacgcagcggccggaacttggtcctgtttgcaacacgcccctgctgccccaaactccaatgttaggttgtaggatggtaccatggtgggctctgggccacttcctggggccagggagctgccagctagtggtcgccagagtgattcagcacaactccttccagaaccacacactggccacacccctccagggtgaaatctacctgtgtggtaggaggttgctctgggagcttggagcagcaacagcactttgtgaaaacggactgtggggtaggagacacagggttattgttttgttgaacacctctcccatatcccttcttctaggaacgagaacattttccccatgggaaatccattttttatagttaattggagctaactttcctatctaatggcagaggtatgcacataagattgaatcagagaggtccatcccacaggttatatgatcgggtcaatgctgggcacatgaccgaagccaggggagtcagtgtcttccttggaactcgatgcctgagccagctggatcagggtccagggctcccgtgtccttcagggctctcctctgcccccagctttgccatggaggcagggattggccctcctttccctcctcccaaggttgtcttcctcttgtatttaccacacttgcttttgcctcctgagaggccccagggctcctacctgtgggcagggatgctgcctcgggccagcgcatagcagatgtgttccaagaacgaatgagtgaaaagccatttggggaaagcacatcatgtctccagtgcccttcccggaggaagtcaactgtggttctgcaaacacagcagcctgggtaaatgaacgctgtctgctggtttatcttttctatgtctctggatttccacttattcattgacatcaaatgaagtattactgtgggatcttatgtaaggtcataaaaagacagacgttttacttcctggaaaggtaaattgttattccctcaaagttaaggaagaaaacttataagcagggaaaccaaagggggctgagtgctgaccttgggagcagatgcagctccagcactgaaagaaaacatcattaaaggaaagaggctcaaaggcacggagcccgcagacaactctctgcgcgccctgcctgtccagaacctgctgatcccggtcaggatagcggaggaggggccaacagagtgcttcccgtggcttttgtgcgttagctgccatctggcatttatcttagagacagagtggtcaataatttaaaaagtgcaaatgacttctatccacttgtaagatgttacaaaggcagagatttggttcaaagttgctgcattaaaaaatgtctgtcttcatgaagacaagcgatttcacatctcttagaaagaatgacaatggttttcttatcactaccatattacatcaatgtagagcctttgagtccttaataatggaacacttaggtattttgccattatcaaaagataaaatttagcctttcagagggaattttgataccatactatattttataatgatgtagaaagtgatggattttaattaccagttttatcttcagagtgctataacttatatttgtaattgtagtttggaagttcccaatgtcattatattttttttgaaagagaaatgatggcatcttgaattaagcccacagtttactcaatctaatcttacttaaaatgactccacgatgcaaatgtacttccccagttcagtcaaatcagctcctccttccctgtgtcactgatttccctaacccctgccactaacatccacagacaaaggcatttttacagacaactggagactgtattgtccttcccatctctcttcttcagacggacctttgtattcatcagaaaatgaagtccaaatgaacaaatttgatcatttctttctcacttgatgggacaaaagggagactttcctgacttctaaacaataagacttctggcaaaaatctctttttttcccatctgtggccacaggagttgtaggtgattcataaatgcactgccccaagtgggtcacaataaaccaagctcatgtaaaccagatttgcaaataaacactgagtattcaccagcccataaaaatggtctggtcagctcacactgcagaaaccaaacattgcattctggtgagtgataaaatagaaaaaactaacacatttcgggaattctctgatgccagttgttcgtgactatagatgtgtagttatctgtaagattaattgccaaggaatattttcagtaaccatgctggtggttctcacaaaaaacattggtaaaagtaaatttgctacctaaacaaaaatatccagctatatttcagaaggagtaaaggtcatgtcatattgacagaaaatctttgtagatattaagactaaactgggcaaagagagctaaacgccaaccacacagtttgaactgtgaataacatttgtatgtttgaaatcaacataggaagtcttgagataccagatttgtgggacaaaaatcagtgagaaaaaaattatactctcagccaacgagaacgtacgttatcaacaacaaaaacaattagaacaacaaataaatgaacaaaaaacccaaaggcattctcaaagtgtattgctttgccagttagaagttgcaggcatgtgttttgaattttctgttgttttatttgtagaaagatttggaagcaggattgttttattgaaatataacgccagattgagaaaagcccatttcaaaagggaatcattagttggaaggaagggcttcgtccagtcagtgtttgggtcgccagatctggagggtgagtaatggacatcctgaatgtaactggagaattctgggcaactcagcaactcgggcaaggtcactggggtgcaaatgtcaagggccggtggggcaaggactcaaggactcttagagctctgagttcctacatttcccaggaggcctgtgatgaccccagtgcatacgtgatccagatcctgaagcatttgctcctgggtggggaaatactgcaaatgcaaacttgacaataagttttcctttctgaatcatgaaaagctaattcaaaccaaccactacaacaaagcattgaaatgttctcaatggtatatctggctggccaggggcctggctgaggaagtcacctccgctcccaggactgcatttgtccgggatccatgcctcccgggaggatattgtgaaggattcacatccgccctcccctccagatccaggcaggagtgcacagggactgtgggaagtgtgtcactctggcagagtcggggctcttgagtcagcatcttacacacagcaggacatcaacaaatacttgacaaatgagagaatggtgtggcagttgaggatctctgctcttcaaggcacagcccaagctctacacacacagaactacctgcacttgccctggttggccccactgtccctttgtgccctgagctgttgctgttctgtatactggaaatatccatcctcttccacccctggcaaaccactattccacggcaaccttgtcttcaaagcctcctagttggctgctttcctccaccccaacatatctggcccatgaccctcttacagcccgttttacagaccccaaggatttgagtaccttgctcactagtctaagcttcctgggagtgcagctgcatcttatttatagagtttagatttactaggagctctgcatctagcatagaaccacatatattacatggaatagattataggctatgttggagcataacagacccttggggtaggtagatcactatccttattttacagatgaggcataacaaggttgagcaatttgcagaaggtcccttgctagtaagtggtctgttcaatgcctgtggctcccctaaaaggcccacatccttgtctaaaacctatgcacatgttatctgacatggcaaaagggactttgaagatgtgattacttttaggatcttgaggtggggagatcaccctggacaatctgggtgagcctgatggaatcaaaagggtccttataagaggaaggcaggagagtcagtgtcagagaaagggatgtgactacagaagcagaagtcggagagggacagagacttgcagatgctgtgctgttggcctcgaagatggaggaaggggccatgagccaaggaatgcaagtggcctctaaaagttgggaaaggcaaggaaacagatgctccccagagcctcccaaagcaatgctgccttgccagtatcttgatttcaggatttctgacctccagaactgtaaaatgaagcatttataagccattaagtttgtgctaatttgttacagtagccatgggaaactcacacagcgcctgtaaactggaaaccaggcggaaacaccgacaaggggaggaaggagcacactgcactcccaaaggaggtggtcaaaggcccattccaagagctccctggcatcaagggccacagtgggttgcagccttccctgctctctgctctcccaaggaagtctgtataatgatctgaagaactgaggaggggcgggcaggacagaccaaaacccaggaagtcacaagcccgaggtggcttcccaagcctggtctctgtgctgtggctttcaggaaccctgagccaaagataaagcctcttcaccaaaactttacatttgttaccaacagtcctgatgccatggatgttccatgctgtgtgcagtggccacacacgacaccacccaccaccaccccagcaaaggcctcctggttaccagggagagagtgggtgggagagagtagagctaagccaggagctcccagggaagccccctccttaggaagaggacgtggctacctgggtgctcagacctccagcctccccctccatcatggggatgatgagagcccaagcaggtgacttcctattgctcttgcttttgaaaagctcagtctgtgggtcaggttgtcagtctgtctgcctgtctggttctctctctggtcaggcagctacagaaggactagactgatgagataataaataccagctttggtcaccatgaatcagaggcacacagccagctgagtcacacaatgggggtggctcagacagcactgtcgagttccctctgacctcactctggaaacggggccagctgttcgaatacggcagggcattaaggaacacatttcactcccaaagctccaagtgttgtgtgtgctctggccacaaaatgctttttggaaaggagcttcatcacagcccttgtaactcaagaaaaggagactgctgattctggagaaaggctgggacggggacggcactagggatgcctgaagccatgaagatttggcctgcagcagtagccgcagtcccaaagtgacctcagttggctaaaagctgcctgaagtcactaaaccatgtcaagcccaaacaccattcaatgtgtatagcgagtactggcttagtccttgtcattgcaacagggtgtcccccactgctcctgccccctgctttgcccagggtgccccaaggcccagcaggcgatgatgccaggactgagggctgctcagggtccaaggatgaagtactaagggcccgggaactgcaggcctccccatcccacctgcccacgcgcatccctgagtgctgaggagcatcagaacaactcctcagaggccgagctaaagaggcctgcgctcgtccctccttgctaccaagctgccctttcttttcccccccagaaagctccaagtacagaggacatcgctggctggcaggggacatgggcctcccagcaggacccagctccgagagacatccatcttgttttccatgcctgggcgtggcttttacattccattgaaaacccaggcttcgaggtttagtcatcaatttctgttccactttatttccctcatcactcctaaaaccaaagcctcacaacaaaagtctgacaaaggtcctatcaggtttccctcccgctagagatcctgcctgattctgcttggctttcagcctgggcctggccgaccacaagaggccttgccagagctggggtctctggcctgggctgaggtcatttctgcagccagcaggaggagggagtgacaaaggactcaaccacattatcataagggaaagagaactgcaggacagggtggggcctgcacttgtggatttcacggttggactcctgggagctggacacaggcattgaatctcaaatggttctggggtgacggggccttggagtccagggctgcccaatgaggccttggatctctgaccccagaaggtggggcatggaggagagacacgcaggggatggattcttcccttttgcatctgagcttctgcttcattttggagctttggtggagctttagagcaacacctccctcttcagggtgactgtgcattgtgggagtaacacatgggcattgggtcacagtaacccaggttcaaatcctagcccggagacctggggaaactgacatttggtctcagagtttgagcatcatcttctgtaaagcttcatagtccccacttcaggggcttgttggagggtcagaagagacaaagtgtgccaagtgcccagcctgaactggtgaaatggtgaactgatggtctcttgtttgacgcaaccaccccactttcccatttgagagccactcactgctgctctcaggccttctgattacagacacactcatgcttcaagtctgatcagggccttccccatggagccctgggcccctcacttggttggggtcctcttatgagtacaaaggggcattactaaaatctcagtggtggtgggaaagttctgtctgtctgtccaactacgtgctatgctatctgagggcaggagtcatggtggattcatccctgccatccctcggggcacgcagtaggtgctcctgcagctcccgtatctcccggggcacacaggtgctcctgcatcttctgtatcccccggggcgcacagtaggtgctcctgcagctcctgttggaccgcactgagcttcttaaggccaggctccaggcagtgtccatttctgtgcaccccatgcccagtgcggcctcagaccctccctgggagtcaatcactcccgactgaacacaccggatgctgtgtggacagcgcccgccaggagtgggggctaaccaaaacagagcacatgcccccagtcccacagcccaggtctgccagtgcctctcctgatgccgagcttgtggcggccacgtacctggtccccagagcgtgacacactgctgctcgtgagtctggcagatgccattgtagcagtagccgtccacatcctgacatgagtgcccatcgtgcaggtacacgttggctgggcagtgagggctggcccctgtgcagaactctgggaggtcacaggagttgctggagtccctgcacgctgttcctgcaggcttcagctggaaggagagggccatttatgacacatgcacccggggaaagggagaggcagctctcagcattactcctgggctggagtggacaaggccataagtcccacataaggggtgaggatttcaaaggaagttgcttctaatgtagagatacctcattaaatcatcagattctcgttctggggttcactgttccactctaaagtgggtgggacaaccaagagcagcctctggttaatgtcatgcaacatcagggttctccaagaaacacacaagctggctgctggcacttggcacctcagaggaagaagaaggagggaagcgttggctgctggcctggttgattcttaagaaaaaggtctctgggtgtcaacactatgacacatttcaaggggacatttgcatttatggtgttggcatgtgtgggcaagttaataaaaataactttaaggtcacaatcacgatagcaattttagtcagtcgtcaaatcatagaactggaactctctctttactgctttatgggaagaacaggagaagaacaagggagaggtaaaggatgttagaagccatctgaccaatggctcagctttttgtggttgaagaaattaaggctcagagtagcccgtctgaggctacacagctagggaaccctgcgagtcctgggcttagttccctgcatactcctcaaacgcaaagagataagacccctgccaacttctagaagatctggaagtcgaaagcaattgttaaaaagtcataacctaaaagtgaaccacaatcaggcattgccctgtggtcctccctccccttacttgggcatcccctgggcacaggctcagacttgcttcccccttcccccgactcccttccaggcaccttccttcaccagttactgggagccagggagagccagctgcttataacattccccagaagttaatcagcattaggaagaggatgaaggctattttaaagccgaacattaaatgttataatgcacttctaaatcaccgtgctcacgtggggcagctaagagggagtttcctgcaagcagaatgtcaggatcaattgcttaattaaaatgaaataaaactctacccttggaactgttgaatcaaaagctcaggcttctactctcagatatcagctctgaataatgagacaatggaactgccaaaagaaacgcagtcctagccagcagcaatggcgagagtataaaactgccattcttggctgggcggggttggtggcaacttcttttgggaggacattaagattgagttgtttatacaaaacttctgggacaagccagcaggcagatgtccgcgggatcaagaagatgaacctgggggaacctgagtgacagtggatggggacttgttctcgccttgctcttcttgtcagcatagtagaaccccatgtgcctctgacggcacaaatggagcatttaaagttgaactagggtttatcggtctgatcagttgtcagcccctaaataaataaacacaagtgactggcaactgaagcgtgcatttcaccccaagattggaagctaaacagtaagaggtgggtaacaccaactggcgtgagaaggagggatggtgcgtgctgtggtgagtgctgggaaaccttccagccacactgcttgccctgcatcagatctgaaccacctgaacctgttggcgacctgggggtcaagttgtagctccggtgactcacctggcagtcttcacagcacagcccatgtgcgcacacagcgtccggcttcagggtacaggtggtggcattgcagcagcgattcatacattcctggaaaggggaatggcatttgtttgacagggtcttatggagtatgcactcactgaatgcaaacatcacaccttaaatggctgcaaaaagcaagaaagaccaagagggcccagctcctgaactgcacacctgcctgtttccgtctgttaggaaagcaaagcttctgctttttatgaaccaactgggtctacgagtccctggaaaaagccagtagcacacaagtgccctcatgaaaggtaaagcagttgtaacataggctggccggctggggacatcactctagtcagcagtacactggggctctgtagaggggtgtccaggcggatctcattgcagtggactgcatcaggatccctggaggactttgaaattacccaatcaaaaatatacatagatgcatacaatctgtactcttcaaaaatgaaccttttttgatttagagagtactggcaggaaatgaagtcaaaccagtggtttcaaccacaattccctgcaatctcgccagggttgtggatgagacccttgagcagcccgggtaagttgtctggcctgacaattccatcactcggaaagtcagaaatggaccttataacaagcaagtggccggcaggaggcctgtgggctgtgcccattgatttgcgagggatttaaatggatagttcaagcattagatgtactgtcctctctgaaacaaaagtgagaaaagaaagtaactcctttataatgctgtgctccacacgtacccattgcttccattttttcctaacaaaaacaagagattgacatttttcgctcagttctcaacaaaaggcctgcacgcatttatcaagtgaagtccttgtacttgagaacattcaagtaactgcagtttacacattttagaagaaatgtaattatcataagatggaacagttcatagatctttaatactgagtaatttatcaatgttcttttattttatccagtatatgatatgctttgaaaaatttatataccattggctggggtgaagctaatcacatactagtttaataatataatactttactcctgaaaaccatctttcttgaatggatttatcatgagttttataaatgcaattaataaaattttgtcaataatccagaagatttatggcaaacccagatactgaaactatatcctatgtaaaactctaattatgctctcatttgatgttccatttgattctattatacagacttccaaagttattaaattttaaatttgcttgaggactttataaacatccagaatgcgtaatatatacaataagataaaactgtcaaccagaagtcatagctgtaacttttatgacagtaagggtttctaacttgtggacttacaattctaaaagagtttaggaactttttttaaaaaaagtagtccattaattgcatttttaaatcagtgtcatcaaatgcacaccactgctatcctggtccttatggtctaaatggctctatggatgacacatttaccaaattacaagttttcttgaaattccatgttaaatcagccatcctaaatctgggtcctaaaattctttaagaaatatcttcccccctctctcaaatcacccagtaatataagcagcagctcaaatggaaatgcagccatgccaaatggctctgacttcaaaggggatgataatgtgagaaagataactaagtttaaaagatattcgcaagctactggcatcctattgactttaaacaaggagataaggctgctttcccaatcctgttagctggaagaatgagtgagttgtcaggatttccttatgttgatataaatccaatgccctgtccgggaaggcttcagcaatcaacctgccttcaaaccacccaggatctatttcttctgcagtaccatatttctcagaagagacacattcttcatctgctgctacattgattattttagtcctcaatagagaagtccaacagagccaatgaataccaagtctccaaagaagaaagaataatgaaagcattagagaattctctgcaaagccctaattgtcattctcaggttgtaggtagcagacacagattcttaatcacaatgaactgggagaagactagaagccatcttcttgaaaatgatggagattatttctgggagcaagggagaagctggtttccattgggtgctggcagttgtttttcggatcccatttactactccttccctgatgtcgtaacacactgggtccctctgtgggccagggaatggccaggtcaatctgatgtaagggcatgcagaataaccagggcctgagcactgggtagggggataaagaacccaggttaacaagtctttttgcctaaaattcttaggcaaagcagtttggaaactgtaaataggttgtcacactgccaaacacaatttgagtttgaaccttgaaactattattttctaataataactacttgaaactattttttgaaaagcaaaaaataaaaaaaagcaaatctaaaaagtgaggcaaaaggctcacctgtaactttcaaagaaagaactttggatgaggggaatgagagctatcttcaaatatcaagaagttatcctacaaaataaggaccttaaccgcagaaatacaaagttggtaactgcatgcaagcagtttggctctgtacaaggagggagtttgtaataatcaaagctaccctataatgcaacatgccacctggcgagacagcaccctgtcaagccgcatgactccttcatggagaaaagagggaggatcagaatatgagtggctgacacattttaggcactcaagcatttgctgatgtgatggtggtggtggggataatgataggggtggggatggtagcagtgatgctggtagcgatgtggatactggtgtggccacggtggtggcagtagctgtggagatggcagtggttacaatagtggggtgatggtgagggctgtagtgatgacggtggcggcagtggcagtgatatggtgatgatggtcatgagagaaatggtgatgatgttgggtggaggaggtggtggtggcgattgtggagatggtgatgttagcaatggtggtcgtgattgtagcagtgatgtggctgctgctggtggcatatggagtaaatgactgctaacgaaatcattccaaacccgagagttcatggcttcatgaagagctgtcaaatttatttagatgaacaaacaatcataagaagttcaaagacaaaccattttcagccaacatggcctctcctgagaaaggtgagaaacttaaactaattcattttttcctttaagaaattaacaaggcctacaaggaatttcccctttgcataccccaacccatgatggttttaagttttcctctgctaatcttgagaagagtttctgtaacactataattaggacttgctcctacacagcaaccattccctgctcatggtgagcaaaattagacacccctccagacaatgtcattatcatggttaagttctgagtttggcaagggcataaaaacatttgaagaaaccacttctacatcacatccccccttactcccacccaatacttacatacttccagcgttcttgcagaaactgtcagaccaagctcattcctcctggtatggaaaacctcagagacttgaagatggggatatgatgaacattctgtttgccagttgtttgtgtgatgaacacaggaatataccggatgcgccagtctcaacacgatttctcctccaccctaaactccctctttcagagcagcccttggagatgctcttcctaagccctcattaagtccatctgtgaatttagctaagcctgccttgaacttgtctactatttcagcttgcataaactctcggggagggagtcccacatggaggctgcctgctgtacaactgcttgctttgatttattctaaacacaacctcctccagacttcgagggggcacctgttttactaggaggtctcatgctgtcttctctctttccttcttgagattattcagagattaaaaagtgacttttataatttttatagtgattatcttgggccctattaaaacaaggacatttcctgatattggctggaaaacagggttaagccctgtgctagataaaaacgttccctgccttcacttattgcttctgaaagctacaagctcgagaggcagaagcctcaagtcatgcatacagaggcgtctgcagcagcaaggcagaatttcaactgcagaggaagctcctggttaaaaatgaatgctgcttattcagattcccctctggtagcacaccttatgaagaaaaagaaatggtgcttattagctatttgaagctagaattccagggctttcttctctgtcaaactcaaagctaaacacttttttttattgtttttggcctcatcttgctgagaatgctgtacccttcgataagattatttatctttttaaatgaagtgatcacttattccatgcaatagttaaaattcaagaaagccaccctagctcacggggcttgttcaggatgggcagataggactcttccttcctgagttctagtactttcatctggctgtacagttcctccaagttctctcttctttgcctagccgaggatacaagtcttcttgtatccttgttctgggaatggttcttacctctggctccccacagtcacactcctctccttcttccacaaatctgttcccacacttctggcccccgaaagactccctgacttccggcaggttaaacaggcacacccccattcctttctccaggctggtctccaagtccttcctgctgcaactgctgaacaccatgggaaatgggtacctgagaaaggagagcccagaacagtaagtcacagggcatggaatggctttgtctgcccttcttgtgcccacaagaaggcacccactggccacatctgcccaggtgttcactggtggtctcaatgaacaatgcatatcaaaaaactcagatatgcagtgtcaagtgaggcacattcagttccatcccgacatccattccgtacagtgccaacgcggctgatgaagaagtgctttatcaaaaaagaaatgatctttcgatggttttcaaatcaataagttcaggcagagtctcattaaagacattattaatagttctgggtgaaatgatgctacgaaaagtgaattcgtagggactgtagcttgtaatacaaacacataacaatgtccttattggaaagtgcaaagaagaaaagagtacaaatgacggtgtttattaattccatggttccaaggacacatggttccactgtagggcagggcctgctgatgctggcattcaggtctataaaggccaagtccctatcttcccccagcacagttgtaagagaatggaggtgatccagaaatgcaggtcttacccttgtctctaaattccacggtgtggcagggtctaaacaaccgggtgcctctaaacaaccgggtgtggcagggtcagccaactccccagcaaagttatgctccccttctgtgctctagaagggctgcccagcccccatgtacctgggtgggctgtatgacattcttggcactagaacatgaacaaaagtgatataggtcacttttggctgatggtatttaagcgagtattccttcttcatatcctttctttccccatctgccagctgagattagagtatcccacggttttaggagatggaggtgtcaggcatggcatctggtcctaactcactgtatggaggaaggccacctgcagcctagagcctcagagcatcatacagaaggaaaacacgcttctaatatggtaacccactgagcatttggggtttgattccaaagcagccagtgttatccaacatacacagagtgtctcactttttacaaatgcattttcccatgtcttgaggcagcaaggattattaaggtataagcatgccagaaacccagaaagttttattacttagagagggagcaggggctgctgtccagcaaacccaagcaccctctcccaatggagacatttataaggatgacattagaactggatctcaatcaattggccaaaccaacgcaagctgctacgctcccctgatgatggtagaccagcggccacttaatgattgagcttggtgaattttgagatcatgctgatttccaggaccaaactgataacactgcaccatcctctccgagtggtttcccttttcttccccaagtatataaggcatactattaggcacagatttttaatgaccaggtatttattttttcttaacttcattttctgagaccgagtctcactctgttgcccatgctggagtgcagtgtctcactgcaacctccgcctcccggattcaagtaactctcctgcctcagcctctcaagtagctgggattacaggcgcccaccaccatgcctggctaattttgtatttttagtagagatggggtttcaccatgttggccaggctggcctcaaactcctgagctcaggtgatctgcccgcctcggcctcccaaagtgctgggattataggcatgagcctttaagcctggcccttaactttttttttttaactttaattgtaggttcaggggtacatgggcaggtttgttatgtaggtagactgcatgttagcgaggtttggtgtacagattatttcatcacccaggcaataagcacagttctccacagggagtcttttgatcctctcctttcccagtgtctgttgttcccttctttgcatccatatgtactcaatgttagctcccacttataaatgagaacatgcagtatttggttttctgttcctgcattagttttccctccaagtggtttctatcaacctcgggctattaactctggagtatattaataattctaatttacaaataaattaataaatgaaagtgctcctctgtggatgcaaaggcaacataccaggacttactcatagtgctgtaacaatcttgaaatctttgtaacttcccctggcagacagactggttattcctggtatcaaaatatactaactaggttcaaacaatgattcacaagaaaaatgataatgtttttgcaatttagaagggtattatattgaagtaattggtatattacacagggacttaagagcagttcttctctttgcaaaaagaaagaaagaaagaaataaaaatcaatttcatggaggtacagatggaaacttcttctgtatctgagagttttcctaggacatatatgtctccaggcctgatctaggagatgaaacatcattctcactcagtgatacgcaacttagttctgtgacaaaccattatcagttcattctagaagggaagtgatttctagaaaatattagagttaattaggaaagactctaggataaatgttaagtctcaggaagggtttatagccagaatcacagcaattaagagaagcctggaaaagagtggtctgaattggcctgtttcccaaaggagcagagaacgtccgtagaccccagggattggagagctgagaccagctccgttcactaagctcagacatgccttccccatctcattcctttcaaagcaacaaacacacaaacattgggttttttgggggtttcccatccaaataggatgaaggagaacagtttaagtccaggatttaaacttcagaatgtgtaggagaggagaacagaacagatcatcattggcaaagatcatcattgtatttttgtgtctgcattgggtgttgtcagactgtatagtgatctgtgtaataatctatttctacttcccttagcttttcctcattctgctgaaggacaactcccaagtgttaacaaaattctttctcatttagaatcatgcatacataaatggtcgtcatccaattcacgggttttcaaccttgctctgaggaacagcatcctagcattaattcttcagggatgcctctgttttaaaaggaaagtagcgatgtcctcctcagatgcgaaatgaggtcttgatgaattcaccaacactgaacagatcctttctcagggctcctttccacatggcctgagctcaccagcatgccgcctgccttccaggtcaggacaattcaaacttccagcaactcctgaccatgggtgacagctccagccatgagcaggtgtgagtggcttctcttcccaccaacctggggtttttctgacttgctcaggcgacccagcaaggtcaatggggagtccagcagcccttccacaaacattcctgccatttcctcggactgggtcagccaatatcgctaccatttcctctatgtaatgaagaaaaaaatgcctcgtttattgttcaagaacttacttttgatgacgaatggtgatgaggctgagaagtattttctacctgtaggatgtcattactcatcccatcctttcatgatttctcagcaaggaggcaggtgactattcactctgataggatatttatgaaccctatttgggcagttagaggaagtcaggctttagaggaagaaaatcagaacagcctatcacacatcattccattattccccaagtatttattcaacaccgactaggtgccaggcattgttctaggctttggggatatgggaatgaagagaacaaaaaaatctcagccctcatggagcttgcattcagtggggccaacagataataggcaagctaagggaacagaatgagttagaaagagtagaattaaggagaaaaaaataaaagagcaagggaagagggtgtgtattgaacttttagggacagtggacctcaccaggaaacctcaccagtaagagggtcatttgagcccctcacccgaagggaagaaggtgtgagtgcacctcgggaaagagctggtacaagtgtctgcagacaggactggcctggaggaacttactcaacagtgggaaacagtctgctcttcctgcagacacacacccagagaggcaacccattttctacttggcatcattcttagataggtcaaggtcatgctgatggtgagaagatcccatggagtgtcaatacactgggagctgtgcctctgtatgggccaggcactgggaatgactgaaggtatttttatttattttaaataatttcaacttttattagcaatgaaggggtacatgtgcaaatttgtcacatggatatattgcatgatgctggggtctggggtcctgtcacccaggtagtgagcatagtacccaataggtggtttttcagctcttgctcccctcccatcctcccccatctaatagtccccagtgtctgttgtactcatctttacatctacgtgtattcaatgtttagtgcccacttataagtgagaacacgtggtatttgacttgctattcttgcactaatttgcttaggataatggcctccggctccatccatgttgctgcaaaggacataatttcgttcttttgatggctgtgtagtattccataccacgttttctttatccaatccactgttgaagggcacctaggttgattccatgtcttcgctattgtgaatagcgctataatgaaagtatgagggcacgtgtctttttggtagaatgagttattttcttttggatatatacacagtagtggggttgctgggtcaaatgggagttctgttttaagttcttcgagaaactgccaaactgctttccacagtggctagccttgccagcatctgttatttctgactttttaataatcgccattctgactggtgtgagatggtatctcactgtggttttgatttgcatttccctgatgattagtgttgttgaacattttttcatatggtcacttgtatgtctccttttgagaggtgtctgtttatgtcctttgcccatttttaaattgaactatttgttttttacttgttgatttaagttccttgtagattctggatattagacctttgtcagatgcatagtttgtgaatattttctcccattctgtaggctgtctgttggtaatttctttggctgtgcagaagctctttaattaggtcccacttgtcaatttttgtttatgttgcaattgcttttggggactcagccataaattatttgccaaagccaaaataaaaggcatccaaataggaaaagaagaagtcaaactttctctctttgctgacaatataattctatacatagaaaatgctaaaaattctgccaaaaggctcctggagctgataaatgaactcagtaaagtttcaggatacaaaatcaatgtacaaaaaccagtagcatttctctacaccaataatgttctagctgagaacaaaatcaagaacacaatcccatttgcaatagtcacacagaaaaaggaaatacctaggaatctatctagccaaggagaggaaagttctctataagagaactacaaaacactgctgaaagaaatcagagatgacccaaataaacaaaaaaatattccatgctcatggattggaagaatcaatattgttaacatgttcatactacccaaagcaatgtacagattacaatgtaaataacaatgtaatttttcacagaattagaaaaaactatcctaaaattcatatggaaccaaaaaggagcctgaataaccaaagctatcttaggcaaaaagaacaaagccagaggtatcatattatctgactttaaactatattataaggctacagtaaccaaaacagcatggtagtggtacaaaaacagacacatagaccaatggaacagaatagagaccccagaaataaaccccgacacctataaccatctaatctttgacaaaaattgacaaaaataaacaatggtgaaaggactccctattcaataataaatgctgctgggataactggctaaccatatgcagaagattgaaactgaacccctacctctcaccatttacaaaaattaactcaagatggattaaagatttaaaggtgtttttcataagaactccaaacccttattcccccacctttttatttttttaaagcaaactgctttttaagcaggcaaaggtctgctcctcatctcccttttgctgctctaagatagtctcatttgatcaagacacagaactaagtatggaaaacttacagcaaacccaatgactgccccccaatacaaaaaatttaataaatgaaaattacttcaaatcttaagagataagggaaatttgccagtagcgaatattagattcctctaatggtaacaccatcttaatccacacatattagaatattttctacatcctaagtagccactggttacctagtgcctagagcaaagcaggtgccaatgctcagcaaggccaggtgcatcacctgctccccaggtgctgactctgcctacatacctctgatgatggcagaatacaactttgagtggcaaattcacaactctctcatttattcactcacttatggagcaatagttttcaagtgtctattatactcaaagcactgaagaggatcccaattccaatatgacctgaacctggtcccatgccccccttgccaagctccttccttaagggatgtgcccaccctcctatctcatttcctctccagccgttctccaaggcccatataattccactcctccagaaacggtctttgaagtcccaaacccccagaaacatatcttttatgccacataaatggagtctgagtggaactgtgcagtccaaggctgtgttgtaagttctcgctgccttcatgtgtcaccatattctggccacaacattataaattcccaagactagtaattgagttaaaatatataatttttttggcataactatttatggagtacctgcttttagctaggtgatatggtggtgctttctcatggtaatatttttcttcttttatacttttttttgaatttaaaattttggaacaatccaatgaaacagttattattgctccatttgcaaatgaggtgaagggatttgacagttcacagttaggggatggcagtactagatttcaccaattcttatgattccacgttcaggtactaaaaaccattttctttattaccagtgccagttcagcactggatgaccagcagtgaatgctgaaacacagaaggtgattgattaatcctcaatgtaccgatttaaacacaggagacaaatcctgctgtgatcccacatatgcctggaccagtggttctcaaagtgtgctcccaggacaagcagcaccaggaactttctagaaatgcacattctcaagccccactcagacctactaagtcagaaaactcaaggtaggggcctagcaacctgtattttaataagctctgcagacgatttgctaaattgatgttgaatttacacaacataaaattcatcctttaagtcacttcgaaatatgtaatccaatgtttttttccagcacattcacaatgttgtgtagccatcactactaactgcagaacttccccccacccctcaaacaaaccccacatccatgaagccatcactcctcattctccattccccacccagcccctgccaaccacgaatctgctttctgtctctacagatcgcctgttctgttcatttcatgtacacggaatcctacaccatgtggccttttgtgtttggctcctttcccttagaatagtgttctcgaggttcagccacatggtagcatgcatcggaacctcattccttcttatggctggatgatattccattgcaagtgagaccataccacaatttgctatctgctcatctgttaatgatccaggtgattttgatgcccattagagactggaaacaacttccctagatttaaaattcaaatgctgttgtacctatttgtgtcgtgacaataaaaaatgcaatctagactcaccatgggccacttgtcatatcctaaaaaataattctgttttgctctcttgtcccatcttctaagaaaagcccaatgtatggcattttgaaaacctgacctgattttgtgatcacatgaaagatgtgccaatggacaacaggcaaggcaaggaatcataggcaggatctgtcagtgcgatcgttgataagactgctatggctcacttagccatgccagagagaggatgctggcaagatgctactgatctgattttaggcatgtgctaaaaatcccaagagtatctgtcttataaacaaacttcatatcagaaatgaattttcaagtacctggaagtgttatgtgaaattgactaatcctcatactgcacagtaattaaagtgtaggaaaagttctggttgtgaacagagtgatgtttcccttccacctgcttccaaatccaaagtatggtacatggtcattgtgcctcctttgtgcttgtatttttcttatttaacagctttattccccggagcatccatgaaaagaacattgacttgggccaggtagttgctcatgacatcaaagatctcatacagcccctcgtctgtggttaaaaagacaagcctcagtttcttccgtagcttttggcaagctcatcacaatgtactttttaacatgtctaataaattatcccacatgtgccaggacagcagctaactgaagtgacctatagcagtgagagactggtgcaaagcaataaaactggagaattactcaggaaagaagccctttagcacgatcctttcccttggcgtgagaatgctttaaaatggtgatacctgcggcccaggaaaaaaaagtgctgctttcagctcagaggcagagaatttatctccaaagccgtggcagggtgactgtggcccccgctacgatgtgacctcttttgttagccttgctttcctttttctctaatatttaactaccagggacacttgaggcaagtttaccatgttgaatgcaaggttaaaaataaaaagaggatgaaacagacagctgggtgattttggggaaaaaaacaccacttttaaaaagaggaatgccacttacagctccccaccataaaggcagtcacagcttcatattttagccatcacaaagctgccaagtaaaatattattagggcttacttttactttgaaaaatctgcagtcagaaggttcttttcttgtaggagcctattgtgcgtctcactgctatattcttgggggtgaatcacactaggccaatttatcaacctcgacagtagaagtcgggagttatctgacttgcaaaagctctctgggtatgattcggagacaactgcttttcttgctggaaattaggcgtctggagaaaccagctataatcaggctggattcaagggggctgcaggtcagggtcctgctgcttcctgtgactctgcggcctcattaataaacacgcactgagtctaggttccccacctccaagctcaggggctcacatctgtctgagtgctgacggcaggaaaggagtggaagtgaccgaggaagaaggatggaacagccaggcagcggctgagaacagcttggagccgacataactgtgtgataggaaaagccaaagttgcagggaaccggggatgggaatccatccagatttttcagtttaaactgattgggggaaaaaaacaaaacaaaacaaaaaacaacctcatatcgtccacagctgacaaatgattagatggtaaagggctaactggttttggaaaatatgttgctgacattctgcttcccactggtttctttttgcagaccaaaatggagttttgtttttctcctgacagcagatgccacagattgggcagacccaggaggctcttctttacctgggcgtgtggtgagaactcaagtccgaagcctatgtctgagcagcctatctgtacttcattgagcctctgttttcacatctataaaatagggataacaactacctcattgcactgaagtggaggctaaacgagcttcaaacaaaaagatcaaagtctggttaacttccaagcactgtgaaatgctagctcctagtactgacaggcaaaagatgtgtctttctttctcccattgggagttgccctgactgcgaatccccccgtatatgatagtgctcaagaacatttccaatatggtatagaatgtagtacttgtagccaaaatagagcacgctttacactgtaaaaccacaaatacaagtaaatttgagagcaagatgattcaggaggcgaagggatgagcaaacagttaaagatcattccctccgtttaatacatagatggtgtcaaagaagcaaaacagcctgttccattctggaagggccagtttttctttagctcaacaagagcatgtagttaggagcacaaccaaccaatgaagcaatccacaaacaaaacaaaaacgccatttagatggctgttacctgctacgcagctgtggttgtcttctgttcctgaaagcttttttctggcccttttcataaagctcatgtcacatgagctcaccccacatcttccgtccatttcctggccacagccaagtccaggcactgagctcagagtgagacgtggccacaaattgtgggatccattctctggagaagacaatctaatgactgttttttttttttttttttttttttatgtggagtttcgctctgtagcccaggttggagttcagtggtgcgatctcggctcaccgtaacttccgcctcccgggttcaagcgattctcctgcctcagcttcctgagtagctgggattacaggtgcacaccaccatgcctggctaatttttttgtatttttattagagatggggttttgccatgttggccaggctggtctcaaactcctgacctcgggtgatccacccacctcggcctcccaaagtgctgggattacaggcgtgagccaccatgccggccacaacttttatcattcattccataactagcttgctgagcttttccaaaaacaacttagccattcttagttcacagccagttctacatattcctagtcccttgagaagcataagcccaacatgaattccctcttctcttcccaagtgagagcgaggtcctcttacagtatgagggggcaggggaccacagtgtggggaatggacattgcttggacaagctgctgaccaaaaattctagggccatcttcaggaaaatcttcaggtctttccccagttatgcccaacaataaaaactttcaatcaccacacacagaatttatgtgcaaccaagtagcacgcctggtaggccagggcggtggcatttgtactcgcaggtgaccggcctcatgttcagtgccgtggcaggcctgctgtggatgcaaggaggtcatctcattttaggggctttttactccatgctgcctggagcggggctggccaggagccaccatttgtttagtgaaaccctgctggggaccagaagcctggcagacattctctcactgacacctctgggagccaattatgactcctattttagagatgaggaagctgagtgcaggcagcttgggttccttgccgggaccctgcagttcctgcgtggagactgaaagcacagatctgactagaaggcctgtgttcttcccactcaaccacaccgtctcgagggctatcaggagctgccccagggcagggcctctgggcagcctcaggcatgacccagcacaaatggctatgccagcagcagtagtatccatgggttgggagaggcagctgctccgatgcctcgggactccctggagccagacgtaaacagaaggaacacccaaggttctacacttccttccaggtgtaccttagaggacttccctaaaggtctttggtgtaacagaagacaaaggcccagtcttgggattcatccagctagcctgaggtgatacctgggccagatcgtgcacacctgaggagggctgcaagcctgttgagaccctaatgagctgcaggcaggggaaataggcgccccgcctcaaaagcctcgtgactcctcctcatggtgtgatgggagagggagctgggcctgagtcagcccactctgcctgcccagcggtgcacagggacacagctctgaccacacaggctcaaacgatagaacagaaccgaggctgaagctaatggggcaatccatcctcacgtccactccagaaacagaaagtgactgccttataactggacgctgagccagtgggccaaccagacggaccacagaaagctaagaaaaccaccaggccaggagcaaatgaccagaaagatccttagtaggccatttccattgttaatagcaaacacctgggccccagaatgcagccatctgcagcacattataattcatggtcttaacttgtgaactttgacctctgctcctcctccctgaaaccaatttaagtgcaaatataatttcccagaatttttaataaagtcaccaactgagctctggtcagttgagacatgtacaggaagcttctggacgttaccagaaagtggacttttcacttctgagctacgatggctatttcttcctgcaccaagtcctgaaagaccaagaacccaggggcgggggacacagtgtccatattaaaaggacctcagcccatcagaggccatgtatcagacgagctactcagcttcattgcaagaaatgactgctgaatttgtgtgggggttgttggaggagcagactctcgtagacatggacagatgcagtggttaataatggacagtgggcatgtctgaaatggtaccaccctttcttcctagcccagtagacagacctgcacagaatacgctagttctttctgctgacttagcaagcctgtaacaggatagaggcttctaatcaaacatgatagaaaaagcagtcacggtagatatctacaagcctgccaccagggctgaagtctacatgtgcccagttcttgccccactgagcaactgacactgaagttaccaccagggcaatgtggaactcaagaatgggaaagagctgtccctctcaaccctccccatccccaagcctgcgagccaaaggctcacaggtacccagtgaaaggccaaagaatggatcaggagcctgaggctgcaggctgagatccagaatgaccctgaccacctgtgggccctctggccttcctgagcctcagtgtgctcacctgtaaaatggagacgattgtacctgttctttatttttagggctgtgacaatgaaaggagatgccaaagatctttgtaaactggagaatggttctacaaagtcttatgctcacaactgcttttagatttgatatttttgatctctctcttcccactttagctaaattaagcaaagactttcaggggaaggccctgctggaaagactctactgtttgaaagcaaattgtttccctcacccaggtctccatggattatgtacagaaaagcagtggactctgcctcctatttatctgggttttctctgctctattttgtttttattttcttctatttattgtattgtgtgtatcattgcaaactattgtaaatccattgtagaatgatgtggaataaacaaaaaatgaaaatgctgctgctgcaattgctagatttagtacaaaagacagtggcctcagagcgttctccccagagattttgccattacacagataaggaagagaaaacctcactctgcacttatctaattgtgctgtactcatcatcgctctctccatccgcccacccagccaacgtctatccatctgtccattgtaccatctatctatccattatctgtccatttctatctatccattatccatttccacctacccattatccattcatccacctatccacctacctatcattgatttatccatctacccatctttccttctttccatccatcctttgtctgtctgtccatccgtccatccatccatcattccacccacccattatccattcatccactgacccatctacctattatttatctatccttccttcctcccatccatgcatccatcatccagccacccgctcatggatcctttcagtcaagaagtatttattgagctctactatgtgtcaggcactgttctaggtgctggggattcagcaataaacaaaacacaaattcctgaccttgtggagctgaaaatgagtccttttggatattgtctgttgtagagaagtctagaaataatcctttaccctacactgtggcctctgtgcctggggagaggaggaagccatgggggtaagtgtgtgggagggggattgcaggattggcaggatttcagctgaaatgttttcacacatgctgtacaacaaataaaatgctgggttaacgagccagtgacaggaaagcattctctgctgttggaacataaattgaaggaggtttgcagaattaaatggcttaaaaatggggctacctcccacctcccagaggttgcacagggacatggctctgtactgaggcagctttagttctctcataaagcccagatgtgttcacggccacttccatgtgtcaaacacactgggaaaaagccgcttgactttatgtcctggggcttctacttaggtcggtctggaaaaatgcaagcagttcatttaacactctgagctccagtaatatgggtatagttggccaggtgcggtggctcacacctgtaatcccagcactttaggaggccaaggcaggtggatcactcgaggccagcagtttgagaccagcctggccaacatggtaaaaccccatctccactaaaaatacaaagaatcagccaggtgtggtggtgcacgcctgtaatcccagctacttgggaggctgaggaacaagaatcatttgaacctgggatgcagaggttgcagtgagccgagatggccccaatggactctgcctcaaaaaaaaaaaaaaaaaaaaaaaaaaaaaatatatatatatatatatatatatataaaataaaataggtatagtcatgaccatctcactaagttcatccatgggccaggtgcgtggctcacacctgtatcccagcactttgggaagccgaggctcacagatcacttgaggtcaggagttccagaccagcctggccaacatggtgaaaccctgtctctactaaaatacaaaaattagctgggtttggtagtgtgcacctgtaatcccagcaactcgggaggctgaggcaggagaattgcttgaactggggaggtggaggttgcagtgagccaagatcgtgccactgtattccagcctaggtgacagagcgaggctcagctcaaaaaaattaaattaaatttaaaaagttcatcgatgaaacaggacaccatgaatgcagtccttcagggtcaatatcccctaaactggatattcaaggatcagtggccacacagaatcagcctcccgagcttgacctctattttgtgtacagcttaacggggaggacaattctaacttgggcagcagcttttcatattctaatggaattgcacacaaattctttcattttccagtgagcaatatctaattacatggagaagaaacaagaacaggctgcatattgatgcgcccttcttgaactgttttcaagaatccctcctgccagttcatttttccctgtgataatgtcggggtacagctgactccattactctggctgagtaattaaattgattctaactagtagtgttttcatcttaccagagttcctcattctgtagctgttcctccttttttctctctctctggataaagatttccattttttcacctaacactttgaggaaggaaatgaagattttcttaaacttttcattgagaaaaaaattatcactctcaaatgaagagttaagatggaaaaataattcccttcaattccatcttggtaaaattccagcatgacaaatgtatttcataatctccaacagcaccccaaagttcgagggagaattctaacgatatgtattgtccactgattttcaggaaagcaagttctacagagtgtggactttcccgctacattgaatttctatcaattcctaccacttccaaagcccttgggggatttttttcactgaaaattgcagttcattttaccctcttaaaacaccttttcaggcagaaatctcttccaagagaaatccagttttcccacagtatgaggtaggaattttcagggagcggtctgcccagcctgtatttaattcttccgagatcggtttagactggactctattccaggatatcttttctgcctgctgcctcttctaacctttgctccctgtttgcaataaattattggtcgctttttaaaagatgtgaaatgatgttatggttatagatttttctctctgtcttttagaggcccacactgaaatcacttctagatggtgcttgatacccggactgtgtaagcagatttgatgaggtaccctgcagtgaggtccctgaagtcaaggatcctgccttgtgtttctgtgcctgctccgaaactgctccccaggatctggcctctagagggtacacagtaaatactagtggagtaaatgagtggctttgctctgcctggtggccagctgcgcgtctgttgacctcatttcctgtagcaagcttgtcctgagtcaggggcagggctgctgtcttctctgatgtcattagagaaggccgaggctgtgcatggtcacttacacctgcattcctagcactacgggaggctgaggcaggcggatcacttgaggtcaggagttcaagaccagcctgtccaacatgatgaaaccccatctctattaaatataccaaaaaaaaaaaaattagctgggcatggtggtgtgtgcctgtaatcccagctactcgggaggctgaggtgggaggattgcttgaacctgggagacagaggttgcagtaagccgagactgtgtcactgcacactccagcctgggtgacagggagagactacatctcaaaaaacaaaaacaaaaagagagagagaaggctgacctgggtggaggccacctagacctggggacacatctgtttgtgttccgtgtccaggcaggtgtgccatgaatgtgtcctgaatggaattaaatgtaatcgaatgggccagttatacatgcttgcggggaagtaggatggcaacacattctccttaaacgtggtcatttgatctgggtgtagattgcagaaggtctgacctcagcttaatgtgaatgatttgcaccccaggagagcagggggtaaccctcatttgcttattttctcatcccacattatcctcagtgcacaacacgaacacgctgcccgccccaactcccagttggcagctggggacacactcgtcagttgaagccatttgccagtatagacccagcaaaacccagacaggcccaaactcctgatttcagcatccgtgtgacaactgtggcaacaattcttttcagatacacatgaagaaaatgtgaatgtgctccttggtggctctctgacagaatccctaaaggatgctcactataggaaaaggaaaaagaaatctcaaaccaaaagaaatattttacatcaagtgtacaaggctggagaggtgagtgtggagcgtggcgtgatgagcaccgagtgtgctggtgaaggatccttcctcttcacagtttccaaatgcctatgaattacaccagaactaaactagaattcacacactattattacttgttcttctaaaggaagcctccctcttcttttttgtacagacagaaaaccccttaacttggcaaactacaatatctcagaggctgcatggtcttcttaaaaatgaggaaaccttaaaagataaatcagatcatattcctatcttgcctgagaagcttcaatgatgtcccgctgctctgcagataagaatccacgttcctgctctggccaactgggctttgctggctctggttcctccatttctacccagcatcacttccctccagccccccacagccccaaggctcctggcagcaaggtgtccccacagcgcccacaggcccatggtcccctgcacctgaactcccttccttccatgctttgcaggctctccatccctgtcttccttttggcctcccccaaacccccacttaaagtgggctccctcaccccatgtttcctctctttgtcctcttcctttgcttccttcacagcactccttccaacctgcaatttattacttttatttttttattttaaaaatagagacagggtcttgctatgttgcccatgctggtcttgaactcctggcctcaagcaatcctcctgccttggcctcccaaagtgctgagattacaggtgtgaaccaccacacctggcccaaactgcaagttttaaattttccatttttcaactcttttcaccactagaacaccagttccaagagggcaagaaacaggcttgtcctgttcacagctgtgtccctaacacctatcagtgtgtaacagtggcaggggctcggtgaatatgacttgcagattcacctaccccacccgaggagatggccctattcctccaactctcatttaacagaaactttctgcaaaaaaaaaaaaaaaaaggaatctgtaagagtcattttttgaatgttaatattgccttttttcctactctaggaagtgacatttactattacgctaaatattctttgctatgagtgttcaagtcattcacaattttcttactcctataaatgcagcatacgtagccctcacctccctaagaccaagggctccaagctcattaatggataaactcaactgagttaaactcccacatgaatccccagatactgcttttgccaaagagtcatttccaggacaggtcttaaatgtttagagacataaaacacacactcttacacacacttaaagccttgcagtaattaatgatacaatccataaggaaccccctccaaccatccctgcaatgtgcaactgaagtcacacaagtcttaagttgaaataggactctatccttgtatttacaggcctcaggtcccatttgtcagtgacagcaattggttaatgttttcagagttaggattctggaatgttttgataaagaataaacaaggtatatgaagggatatacttttctcctttaagccatctacaatacttggttctttttgattctgagatgttaatatcattaaagcagttactgattcatctctgaatcacctttggagctgagactgaatttaactgacatccccaagcctccatcagtggtgggaggaggaagacacaggctggctggtgtttggatgtgggccagtttaaagtgagccatcacacggaaactgtggacatgctgctgagtgactgctaagggcactgggagtctttccagcaatgatgagtaggaattctgaaaaaagcctttaactttttgatagttccaaaacccctgtaagctaagtaataatatactacctttgtggaatgatttacaatttacagacatgtgatctcattgagtccattctcccactctctcggagacactatgaggtaagagaaccaccattttgagataataccggagcagccgggaaaactccaccacgggtgatggatgactgagggttgactgagccgctcgacctccccctcactgtgggcttttgtgattaattcacctacttgcttaggaagttgctttccatctgagaaaattaaaaacaccactctctggacaggaatgtgggatcataaatgagaagcaaatagaaaagatttatacaaaagcacaagctcagcaaaagagaaaactcagaaattgctaatatggtataaatcaaataaaggctattagcaaacccctggtaatgggggaaaaaaaagccttttaaatgatttgtcgagctcttaacaataccatttctacctacggtgttcaaatatctctggggcgatctggcttgcattcttcagcactgccatgaagactttccaattggaaaggatttagataaaaccatatagagtgccagaaaatatgccttgctattgtgccttcagaattatataatttttagagctgtagagtcttcatcatctgtgcattcctccccacgagcacaggggtcaaaaatatttgtttaatatgtgaacaagtgggtggagagacagatggaaagaaaggaggaaggaagggtggatgggtggatggatagatggttggatgggtggatgaagactgactcactcatcttattgatgaggaatgtaagagccagggggttactaaactgcctatattattttaaaaaatggtgtgagaattgggacaaccagatctcttcaagtccagtgttcttgatctaggttttcctctcttccattggtttatcaataattaaaaaacattaacaatattaacaatatgatcttcttagtcatgggaaaccatttctggaggcccataggctaatgtatttgtgcccatctgatgatcagggaaattagacacacagtgcattttctatggctatgagttcattgagagtgagaaaacacgaaggccactcagttgcacatcagtctcctgccaaactcactgtctgaaagtcacccagcgtgtggcccagcatagcgatcagggcttgtgaaatgttggaaacagaaggcatctataggcccttggcccaaccttataccctaagaaggaaatccttgccccaaatgtccagcaaacaattactgtgcttcctctcagacacctttagtgactaggaacatattactttttagggtggcctcccttttggagagacacacatgttagtatcttgagttttgcaatatttcatttcctatcggttagtactttgactttgtgtacagatccttggtttctgtcattacacactcacaaagcaacttcctcaacaaagtcttggtgactcccttgaattatgcttaagagggaaccacaaacagaaagatgcccctgaagcctctgcccaaatgggggcgatgaacatgaggaatcagtcacttgctgtaagaagatgcctcctgatggctcccatgaaaggacaatcccctgatgagctgtgtggttctgctcagttcttgtttcaagggcaactcaatgccctacaaactatttcccaggaggcccacaaggctattgcttgaaaaagcacagacacattctttaacaattcctccctctactgggtcttttaaaccgcagtagcaggtatcccctcacaccacgcttgtcccctggccagcaagtcttcacagagatgagtcactgggctgctcagagcacttgcctcttgccccagtgtctccttttgggaaacccagagagcaggcttgggctggaatgttccatgaaagtcagtgttcataaggtttcaaggtataataaagaagatagcattgtatccagcgcatgcttcccgttactaatgagaatcttcttaaactagcacaaagttctagtttgggataggccctttatagatataagaacacatctgaatctctaatccctccaaggtgcatctgtttccacttcgtttgaacactccaaataatggaactgtcttgctcttttctggttgaaccaagtcgggagtgtcaggaaagcattaaataaggaacagcattgtaatataccaaagcagagaaatcatttcatttaaacctctaagatctggtaaggtgatgtcagggcagagacactacaaacccccaagctaccgacttcagagacaccctagggccaaccctggggaaagaaataccttctacccagcaccctctaaagacatgtggcccatctccactctgcccagtgagtttacatgtggcccatctccactgcccaggctttcagatggctggctcctgggactgcctggcagctggagccgtaggctcaaataaaaaacacttgctgggacaggaagataattagcgatttctaaacacagacagcatccatgcccaccattcctcaaggaaaaggtcagccctcttccttgtacacaccatgtagcattgccatctggctgcccatggctctccagagtagcacaggccacccttgcttcttgggaaggaattactttttggaagcttccctgggtgctctgaccagaaaaccagagacactttgactcatctggttcccaacacacacttcaagccatgcacactgtcaaagcagatggaagcaatggtacttgcccggtggaagcgttcatgatgcagcctcctttctcaaccgccatttgacagctacagcccctgtccagtgtgtcatgattcatcccgaaattgtggcccagctcatgtgccagggtcacggctgcaccaaggggattgtctgaatggtcctcaaagaaaacacaaaagtacaggtgtataattcatatctccttggccttatttcccaggtctccctccccacagaaatatacctttcattaacatttgacttaatgtaattccttataagggaccaaggtaaaacgctatcatttagtttaaacttaaaaagatataatttgacatttcattaagccagtttggggtcctttcggctgaggaatgtctgtatgccgcacgtatacatgtgtgattctttatgtttttacatgacatcttcaaggcagggtctccattctgcttcctacaattgccccacaaaactcttccattgaatgaagcaaaaagtcatcctgcatcataggaaaagctcattccttcatgggccatagaagtatcattttacctttgattgagatgatgctgatataaaggtgacaggtgcaagcacgcttaatgacattctaaatgagccctgagaggttgtcattgagcctgcctcttcctgtgtgcttggtcggggaggacagttggaaaattcacaatacttcataataaatctgaccacattgagtcatctgtttgaagagccattcatttcatttaagattataaaccagctatatcttattcttgctggctctttgtgttgccaggcagactttggaaatgggaggtgtcccgattctctgactcttgcggctgggggttcattaaccttttgcttggatatggaaggcggcttctccattcaacaagcactacttggccacccctaacttagtggagtgcctggatggcttggctcaaacagatactagaaattaactaaaaaatatagttacttaacttttacaaactgaaattagttaattagcatatatgatctacagaaacagtgcctatatacaacatttctgaaaaggcctgtataccatggagtaaggaaaataccctgtttgaatcttgctttgtgctacttaggaaagagataagatgttttccaagaggcttccaagaaacagtgctgctatgctttgaaggtttgttccctccaaaacgcatgctgaagcttaatcccaatatggcagtattggacgtgaggcctttaagaagtgattgggtcaggccaggcgcagtggctcacgcctgtaatcccagcactttgcgaggctgaggcagggggatcatgaggtcaggagatcaagaccatcctggctaacacagttaaaccctgtctctactaaaaatacaaaaaactagccgggcgtggtggcgggcgcctgtagtcccagctactctggaagctgaggcaggagaatggcgtgaacccgggaggcggagcttgcagtgagccaagatcccaccactgcactctagcctgggtgacagagcgagactctgtctcaaaaaaaaaaaaaaaaaaaaaaaaaagtgattgggtcatggggactctgccctcataatgtattaatccattcatggactaatgggttaatgcattcatggtttatcatgagagtgggaccagtggctttataagaagaagagggacctgagctagtttgtttagcccccttgccatgtgatcccccgcactgccttgggactcttcagagagtcctcaccctcaagaagccctatcaggtgtgcccccctaccttgaacttctcagcctctgtaactgtaagaaataaattccctttctttataaattatccagtttcaagtattctgttagaatcaacagaaaatgggctaaaacaaatatgatactgaatttcagagagcacactgatacagtctgtgtgaggctcctggataaaagtgtgctcatgtaagatcttacaggtttgttgacagtgtttacaatgaggcttctgtctaagaaaacaatagcatatcaaggaaccaagataatcttacagtagatgaaattcctaataaattactttgtttagattttagagtttcctgttgtaggaagtttacaaatatgtttcaggaaatcggttctcgaaaataacacaatggtgaagagaatgtagtcagtctaagaacataggggctgaagttaccatgctctggcacaaaattcaaggaattcacccttaaaaaatattcttctgattcttttgtgtcattgaatgtcttggtttttagttgccagattgttttacattctttcatgcatcaatgattataaacagaatgtctcttaaaagaccttgataaacagtttacatttgtagtaagaaaaaatatctctttattcatgttattaatattatttccaaagcaaggctgttttaggccagttagataaaaaggaatgactttcagtcactaaaattaatgatttgctctatattggaaaatacagaaatggtactacaatcctgttttcaattttatgaggatctctgcttccttgctacattgattccttcctcttagatttgtggtcctctaatgaagcacagtcacacgggatgcccgtgaatgtaactttacagacacaggagaagaaagtgagtctagaagtttttggtctggtcaagatgttgatcttgctgatttcatgacttttgtagaaatcaaaggtgctgaggcatttttatcctatttgatgtttctgttatatgtggaacgtgtaagcagtgtgtctaaggatgatgttaactgctgtcaaattgctaaaacatatttcctgataattaactttgatcttcaattgaatcttattgcatgacacataatttgcttatatttcccacattcattttcatataccttttttaaaaatagccttccctgtatccttttaaagaaggaattttcatcaaatgcttgtatggaaatggaataagggacacgagctgaagaaagccgcttactctggtgagatgggttacaggcccatttcagcaccgcacagcagcagaacttaccatgcttatgaagaattgagttccagctctaaaaaaaatatgatgccaacttgaagtggcaaagtcagtagcaactgaccatggaaccatgaaacagaaaattattccctcttaaaaatgtacagtctgctctgtaaaaatagagttgggatctgacttgaagtgaacctggcatcacaaaaaccaaacttgccaaggacctgccatggtggagatcacatgcagggcctccaggtccacagaaaacaaggcagtcaccactcaagccagaaatccagtaagtgggggcaatccctccacgcagctttgacccttagtgcaggcttacattaatgaccaatctctgaacccacagaagagggaaatgttggttccgtatattcatgaagaatatctgattaggcagtaggtggagagaaagtaatcatcagcagaacataactccttccactatgtaatacaactgaacattcacacatgttctgtttaaaaaacatggaggaactcacagtttcttgggagggcagggttctatttgtttaatggagatggaagaatggtctctgaggatactccctgtctgaggtctggtgcagaggagacactaaattttcagagcagggacagcatagggtgaaaacctctcctttaattatctgatgaagtggagcacaagccccctgctggcaagcctatcaaagctacctccctcctacattcataacgagacccaaatagttttcccactgtatttcctttcacaaacatatatagcttatatatgacaaaatggtccttgtaaagcaataaacctgggtttctgacttccaagaataaggttattttaaagacaaactgtatactggccagaaggcatgtaaagcatttgcagtggtaaaaagctaaaaacctcagactttgggccattgggcttggagacagaaccatcagaaaaccatccaaacgggaacgtctggtgagaccacagggcgtcccaacagctgcatgacgagggcaaccccaatgccctggctcaccccagtgctgcgaggaattcctggtttggaaagtcctggttgaaaatgtttctccataaaagaggtaggcttgcctctgctgagctattttacatgcccacctttcctgtgtgcaatttgcttttaaatggttcctaaaacactgtgggatatataaaattataaatacagctacagtaaaaatagagttaaatctaaaaagcattaaaggaaaggatctatcttcacaaagtctgataaaagtagtgacttcctggggaatcattatcaaggggaaccagctcccaatgcccttggcttaccatgacaattcccccagactggtctgccgtgcacatgctcatgattggggccatgccgatggtggtcccttggaaataaaccccactaggaaataaaagagaggactttctttaatcaaattagaacgggggcattctctaatatttaaaaattctgttggatattcctgcaataaaatacgcaaaaataaaaatagctgtatgagggtatattcacatgtgattttatcttttttccctgaaaattttatttctgcagttgcgtcatggttctgtcattttttagagttttgttttcaagactcagatgacaactagttattacttttgtacttatgagttgtaatctgcctatttcctaatggactgtaggaagctgctccatttaaacaatgtctgctgatggaaaggctgaaaatagtcacagagaatcactgttaactaaaagaaatgcattagatggtttactagattttcaccatagcttaactgctttcctgggtaacttactacagttctgccagacacccaaattctttcaaattgtcccgctaagatagcttgcaaaattgaaatgggcagaaaaattatcaaccctggagccggtgtagaacaagtgagcacccacaaagccttggcacctagggaggaagcttctggaaggggacttcatggcttcaatgcagtcgtccttctatctggaatcttaacctgatcatgaatctaatgacaccaagggcctgttgaacacaagtgctgttaattccaacctcatgcatgaaaaacaaaacgctgtatttgttgaatttcctttaaaggagtcaaatgacttaccaatgctatcttggccatgtatgtatacagatatattgtttgaaaagttagatattttagctatggtcaattgaacagaaagtggtaagtgtatataaaaccttctccctccttccctccctccctctctccctccctctctccctccctccctctctatccacctatcccactatacttatatttacagtggtagaaatttcggcctttatttacatctatatagactatatgaacagatataattatacatgtatataaataataaagttacataagatgataatttatttccagatgttcaagttggacagactccatttgggaaaaatatcaaaacactctgactcaaaatacataaaatgtacttttagtagttcaagactaatcaatgcataaaatgtgaggcaaccacaaatatccaagggtaggggcaggggggaaccctgtgaaaatggccgaagtaaattatcaaagaatgccaacagcctcagttcagacgtaggcattttctgaagtgacaatggggtaggactggttttttaactttccacaaatgttcaatagctacattgggtttgtcaaaggaaagtctctgtcccagaagctttcctttctgtgctataagccacatgacaacaaaagaataatagcacaaagtatttaaagatttaaataaaaatttgtcacttctagaaacatctacttcatactaatttagattgttccttttttttttaagtataaaagcatcggcaacatctcaacaatttttgtgttataatagagctatgctttgccttagtttatcatcttccagttgatcctgctgaaattgtcctctttattgttgtctctcagtagagtggagacttctgagagcagggagatttacagtgttggtcaccactgtgttcaaagccccccaaacactctttggttcctaacgggtgatgcatattgatttaaagagggaacacaaggttaatgtgctatgcttcccggtattctctgatctagaaaaccaaagagtcacagccacaacaggaggaggaataaagtcttttttccctccaggaatctgacagtattcacccaaagtactgtccttagatattgtataaacatacattttccactaataatgatgaatctttaaaaacaggctcctcggcctggcgcggtggctcatgcctgtaatcccagcactttgggaggccgaggtgggcggatcatgaggtcaggagattgagaccatcttggccaacatggtgaaaccctgtctctactaaaaaaaaaaaaaaaaaatacaaaaattagctgggcgtggtggcgtgtgcctgtaatctcagctactcgggaggttgaggcaggagaatcacttaaaccagggagctggaggttgcagtgagctgagatcatgccactgcactccagcctggtgacagagagagactctgtctcaaaaacaaacaaacaaacaaaaaacaaaacaaaaaaataggctactcagaacaactttacatcacagctaaaatcagaaaaattggtatagaagaaaatgtccgggttctagaagaaggaaatgagagttctgtagagggacaggttttccagggtgttcagagggagactttcctagcagaccttcagttccaggtgagggtggcatctgcccccctggtgtgagctgagaagcccccttgcacaaggcagtgtgctctgcagaaaggtggcagctcctggggctgtgcaggtgaaacgaagggcttcgccgagagcactccttttttttttaagcagacaagacgtaactccctacctgacaagctgcgcattgtcatgggatttgcgaggtagaagcttcatcttcctccagtccagaaattcatggaggctggtgaatgggtcctgacttacagagcatttgtccatgtcattccacacttccacgcctaccaacacgatccgaatgttcagtggtctgtaaaactgggcaaaacaggcaaaactggcattggagttgggatcacgttaataaaaactcgaaatgaaaattagaacagatttgcgttatttgagggtcactgacacaggtgagaaaaatatctctgtgctctttggttcctgtggtgttggaatttaagaaatatttgcagtgcctaatgcaaagtgatgtgttaactaggttctcgaagattgaccaattagatgctgaagttatcagcttttttactgtctacttgcatttgtatggaagcatacatttcaaatgactcactggtgatttaaaatgtacatacagatgtgtattatagctaaagatggccagttaatatccactgcaagtgaaacaataagtgaattaggatctttcagacacttctgccaaggacaataacttgttcattttgagcaaaatgttctgcttattagttactgaaaatgaatctgtattaatttttcagcaaagtctcagctctggctaacactatcatattctgtcacctataatcaacgcaggttttaataaaataaagaagtcaatatctttcagaataacaaaggcataaacagagcccttcttcaggaacattaatgactatcctccccacagccagaagttagctcaccaacagtgtcatggaaaggtctgttaaatgaagttcctcttttatgcgcctgtgaaacaaagcatccggcacaccactgaaagcaagacttctcactcccctgcctgcccccaccatctttgggtgttcctgacttcagcctatggcccatacctgactacacctacaggcaggtcgttctgggtcagggcagggaaaagcaactcctccagggactaagggatggctttgtctcataggagttcagagggccaggatgagcggtcagggtagaggtatgacctacccattgtcctcataggcatcacatagacaagcagatggctttgtactcatggttgagggggctaggacatggtgtcacctggtgggctgtcaaatctttcaatgcccctagtgtatgaggcagcacacagggagaaagccctcatcttctgagatcccaggtagccacggagaaaagggtggctagtgatagcagccaaagccaagcaccagatgaaagcaggtcctattctcagttgctggaagcatctggccaataacaaaacttatagaagttctgcatttgctagttaggcaccattccaacatggtgaactaaagtagaagaaactgctcaaagttgaacatctgaccctagattctaacccacataaggtgagctcatcttttcccttgctggtccccacagtcatctggtgagcattgggttagcaggagaatatgaccaggatacaaagtgcatcacagaatatatgctgattgcattggtccaacttggtttcaaacagatcacaattacagacattacattaatgagttaacgagacgattacatgactacaacacagcccaacagtttgttttcaatcaagaattgcatggcccacgctatctacttgcaaactcccagcccaggcttccggggcgaaagtaagttcctggccggctctggaactctgaatgcacatgtttggctgctgtccactgagagattacattttcagctctattatatacaaaggtaacagtgatcagaaagcagaaacggaggcgatccaatgctgatgctcacaccagcttgctaagagatgtccttggggtcagacaccttgcgtgggctcagggttggcatctgggaaggagacactaggtttgcctcccaggagtgttgcatggagccagtaatgaaggtcagcaaaggactaattgtcatcattccttagtgctaggtttgctgcttcctcatcaaggagcttttcatgataatgatgggttttgcatctccacctactaggcttctcaaaccacatccttagaacagatttcatacttagtagtaatataacagacaacctcccctctccaaaattagtgccattgtttgactgtcatttatgctaaactcacatcaagtcatcatacatgatgcctttgctgcctgctctaaaagttctttccagggctgctgacgggttccttttgattcttcctaataaccaccaccacagctaatgtttagtgagcattactgcatcacaggcatgatgccacggtggtttctgtgctgtggcttaatcctgaaaacaactccatgtgttaagaattattattatttctattttatagtcaaagacacggaggcttggagaagtcaggtgacttaagattgcaactccatggctggggttggaacacaggccagctaaccctgacgctcatgtttgaacccactaggtaacactgccatcttctgtgagcactaagactcccttccaagacggcccactgtgaccccaggcccggagagaagctcacgggcctctgctgtacaaatggagcttggcagctgcctgcctgacttacaaagcccagaacatatgtggacacagtcagagatccagctgaagcgattcacctgtttacacaacagcaacaaatattttcttgcctcttgctgtgggctgggccggcagtggcagagagagcaaagatttggatgccctcgctcctgccacccaaatgctcagaggtcaccaggggcttaaggcatggcacactgaactgtcagttcagttaactccaatacagtgaactgccaagcagtggtgcacataggaagtccagggacgctgcactggagacttttgggaagaaacagtgaggcggaatcccctggggtctaatgaaggaaactgcatccttcaggcaactggtttgggacaggaggagaagaaaactgtcacatgagtgaaaatatcctaagaaattcaatacacagaggctggacatggtggctcatgcctgtaatcccggcactttgggaggctgaggcaggcagatcacttgaggttaggagtttgaggccagcctgtccaacatggtgaaactccatctctactaaaaatacaaaaattagtcaggcctgatggtgggtgcctgtaatcctagctactcgggaagctgaggcaggagaatcgcttgaacctgggaggtggaggctgcagtgagccaagatggcgccattgcactccagccttggggatagagcaagactctgtctaaaaaaaaaaaaaaaaagaaagaaagaaagaaaagaaattaaatacatagacgatgagtcctttcagaagcaggtccctgaatttgcagctgacactaacttcctaatgaataaggaggacagtctggaggtgaagggtggaagatgcaaactccacgatagctccatgggcaggtgcactccccgggctcctgtgggaatgtaatgaggacccggggaaaattctcagcgtctggcctagaagcatgagtgtcagacatgccttctgtgttttgctcatggggggatttcctgaacattccagaatgtcaccttcatcactaaaccactcgtctgttttccagtctaggatgtcctctttctccacgcagcaagcagttattaagttagaatggtccaggagagccaagacttcagcaaatgaggaagttgccactggcacagtcgttgttttctggactgagacactttcatttgtagagttgaaaaactgaaatttagaattgtgtaacagagctgggagtcatctgttcatagacttggaagcaccaagtctcccagggggcctgggtatctcctccaaggtctttggcgtctgctggggatggacagggatgtcagggccaggggtagctgtgtgctcagcaaatcggctctctccctgccagaaacacaaggacagccaggccggcaaactccacggagtccgttaggacttttccgaggcacagtgttttttaattaccagtgcaagttattaacaaacccctaattgctcatttttggttttgcaaactgaagcaagatataacctagaataaatgtgaagaaatacaaacacagaggacccaaacacatcccttttttaaaatggggcttcagcaatttccagtttgggtttaatatagtttatcatttccttttgctcccgaggtctaagaagaactcgtgttttcttctcgttggacagtctgaggatagcctgaggccgttggggcaatggtccaactcgctcaccttggagtggcacctgcgctcccagctcaggcacctaagccttccgccctctaggccagtgcgtctcagtcccacttcatgttaggataactggaggaccctggagaatatctgtgcctaggccctgtgccaggtcaatcaaatcagaatccctgggccaaggtgtgggaatcaatatttcctaaagtaaacatataaacaaatagacaaacaaactcccctccaggggttctaatgtccagtctagaccgaggtccagttctaactgccgtgctatctttgatgtctcctctaagacccacccttcatcccccctgccaggatttgcctttcaccaggattctcctgcacctggactatgggataaagttgaatctgcaaagagtaactactgaaaacacatcaacaggcaggggttgccaggaagtttgacctgcttcaaaggtggacaagggcaatatcatcccaggatatcaacggccatgtgggtttttctgacttccagaaagttccatgtagccatagcctctctctgagtggcaaacccagatctctgactgttcagagtgcccttcaaactcctcttcctgctccccctttcctggggtatgaagcatcgtctacctgcccctccactccaacgaaactggcggtcatgtggtctcccactcgccctcagcctctgcttggtcatcatgaggtcccgggactcacagtagggggagtagagtcaaagccaagagcccctgctgctgggagttggcaagactagcactcatccctcgtcctgcaaatgaataacctctgcccatctcagcctcctctgctttaaaaataagaacaatagtgtgtacctgagagtgtgtgcaaagcacttagagcccggcacacagtaactggtaaaaataataatcaggaaacacatcccttcgagcctctctcaatccttgtccttctcacttccccacttcccctgccctgggtcaggtcaggcctttatcccttctttttcttcttcttcttttttttttttttttttgagatggagtctcgctctgtcaccaggctagagtgcgatggcgtgatctcggctcactgcaacctctgcttcccgggttcaagcaattctcctgcctcagcctcccgagtagctgggactacaggcgcatgccaccacgcccagctagtttttgtatttttagtagagacggggtttcaccatgttggccaggatggtctcgatctcttgacctcgtgatccgcccgcctcggcctcccaaagtgctgggattacaggcgtaagccaccgcgcccgctcaggcctttatcatttctatgcaataggctcctctcagccctatttgtctttggttatcccaccctccacactaactgcaggaatatttttctactatcatgtgtgtctctcccctgcttaaaaacattcacctagctctctattcactgcagaataacatcaagatggcttcgtagaacagccggggccttgagcaccgtgaatctttgcagcttcatctcctcctgccctagctctgcatgcatacatttgcatacaatatgagcatgcatgtacacaaacacacatacatgcatgcagggcacacacacgtatgaacacacacatgaacacatataggaacacacatgcatgtacatgtacatgaagcacatacatgtccacatcacacatactccttcttctgctatgctcacagtgaaactgaacttacctttgaggatcctctccctgcaaagactccctggccctgggaagaagtaagtgattctcttctgcatccccataaacctccattcatagcatggatctagttcttaatgccttggaccatgctgtgtgggttgcatgtctgcttccctacacagccttgacgttctcaagtggagggaccacatctgattcattctgaattattgatgcagagtgcataaggtcttgtaatatggagccgaatttctgaaaggacctttgccttcatttttctgaaaacttagagaatgcaattcaaatcgaataagattgcttggaaacaaggctagagtgaggcaccctcacaaaccactatgtgtaaaatctgctgtttcagaggaccatggatgtgaaaggctcagccatgaccagatcccttctcacactgtccccacaggcaagagactcagtattgctgagagactatggttgctttaggacagcggtcaccatccacattgcacatgagaattgctggggagcttctgaaaattcgaggtctaacctcccccccgccctgccccttgagggcagcaatgctttcagaagctcacagggcaactccaatatgcggggcttgtgagaagcctattttaggctaagggtcgtcagcagcaaatagccaacatcctctccagcaggatacactgaggaaggacaggtggtttagacagagagcgctgccattttctttgccggcccgcagtgtgaggagcggttagtgaacaagtaccccaggagtaggacctggtttgcaggggctcctccagcaaggaaatcatctttgtgaaaggtgagtttctgacctacttgttcttggcgagggattttccaatagctgatttagctgaaagtcaacttctgtgttccaggacagtgaagcctatggatcccttataaatgcaagcccaccctcagggttacattggtacaggcctgcaatgatggggacagattgaaggggcctgtgggatccgtcatcgggagacctgggagaggcccggctcaggaggaatccaaaggatcaggtgaactctgtaggggttctggagctaatcgggaagtccaaaacaccctcagactggtattccacctgaccggaagagagcctggaggaagacatgtcaccaaggccaccatagtccagactgctgtggtttggcatctcctgaagctgccccaggacccaggaattacacactcagaggacaggaaacagttccaaaccaaggcccagaggcagaacctcatctccttgctaagtcagatgaggtcccccaacctcatttccaaacatttacatgatctgaatgatttaactactgaaaaagaacttaccttgtcaacgtgattagcaatctctattaatcgctgcttaactttttccagatcttttccttgcctctgaaacttaacaattttaaatggcagcattaataccagcaagaatatcaatcacgtttcatcttcctggcttctggaaatgtgaagtcttgggattttacaaaccactggggaccctccacagttcacggtaaaatgagcttgcatcctgccgactaactttcccggctggggactccctgaaattccctgaaatttgcctaagccaagtgctctcaagacagcaacttctgcaattttccagcctcataaatgatggaggcagtgacttgttttggcaaagaggaaacagacaactagaagtcagtccaaagccatttttcatatcatcaacttgattttaacttcctgagaaattttctttatatttgtttttaaaaattaaaaagtaaaagtcatagaagctcatggcagcttgtcaaacaatacagaggagaatagacaaaaaaatcaacaaatttcccattcccctctctaatctgaccttccagaatgggaatcattttctgaaaaatagtcaagcctgtttcattcataggtgttgaaagagtctatgagaaaatatcacccaatcacccaattcatatatgccaatgaggcagtaaatacagagaagataatctttagaaaaactaattcaaaattaattaaaataaaaaatgaatgtagtatcaagctatagctcagaggggaggatttttctgctgtgtctctatagccttcattcataccttcatttattcattttgattaatgacatatgggatattttttaaatgtcccattttaaagactaaacttttccccaaaatgttttagaatataatctaaagccttctgtcattcctctcagttaattctccttgtttggagagctgagctatagagcaactctgttttttcctgcaggctttgccattactttatatatcaaataaatttttaatattgtatgctttataaaatcagaaaaccattgtttcaatgggttgtttccattgcttttaagagcacataggaaatgaggttcattaaagcaagtaataacttgcaaaacatgtccttttttcttttatctctaaccaaccatactgagaaattttaaaaagttcttacctctcggttgtctgccacgatcaccagctccacatacttagttgccttgagggtctctcttttatgctgccaagagtaaacatgcacttaatctctcttaatgcctctctggcattaagactgtcaatgtctctcaatctaaacactttaggttgagaatgtatatcccccatccccgccaggcccccacacctccattccatctagaagtttaccccaactccaaccaactctttgtaaaaccttctcaacatgagtaaccagcttccatttccacttggaaaacccttaaaaaggagtttaagctttctgctgaatcatggattattggagcagcaaatcaagattattaaacaaaacgagcacataaacaaacaaaaccaaagcactctctagaacaggagccagtcaaaagtcatttatttcagaccacgtgtaggtcttctctgatgaccacatttgaaggtcatcagagaagacgacggagttcaatgcactgtggctgttccctttgtctttatggtccaagtgtacctgttttgagacttaagaaaagtggaggagaatacattttgaacaggaactgtataatcattttttaaatgataatgtaaaaatctagttagaagcaatggaagaccggggtggtctggagaaaaggaaactgtcagactaatgaacagagaagtgagaaaggtatgaggagaaaaaaaaaagagcaaagagaaagagaacggaaagaaacagagttaagaaaaaactaagactgcaatatgcccctggagaacagggatttcgtaagagtgagacagttgagagaacatggaaagtggatatggaagtggatgaatggagatgattcaggcagcagaaataggaaccccgtcccccacaaaggcagctcctgaagtggatcacattttaatcaaacttcctcaaaaagcattcacactcttctgtgaattactggaagaattccaaatgcatttttaagagaaataaagcagttcgtggagggtggtctcaaaaagcaaacattaaaaacaaaaaacaaagccttctgtttctgccataaaatgcagttggaggaagtgggggttaagttggtctttggtcctgatgactgatattgctggtttatgagttaactacacacactgcttcaagtttaaaacttgcatgttataaccactctttcagacaaaagcaaaagaaaatcacaaaagtatgctttgaatcaggtttccagtcacataatcctgagggaaacatcttttataaaacaaatccccatcagtccgggatcttccaaacagacttttacaagaaaaatgtttgtattatagcagtgttccttcttgctgcccagctgtgctaattcatgaatttaggtgttcctaaagatatctggaaaccttatggaaaaggaaaaataaagcaccaggaaaggtacaatttctcatatctttacaatgttacaagaagaaactgttacgctttgtaactatatgttgtaggcatgctttatggtgataactatgcgttacttataaaagaaaagacatttgcccccatggtgcccacgggtgcacacaaaatgagacaccttctgaaagtgtgaagatcttgccctttttcctcattgaggcgtgaaagaggcagaaccctctctgttgtccataattccctaattaatcattaaaaaaatttggctaattatgcagaagaaaatatagctctagaaatgaaaaactaatctctcattgaaaagctcatggaaaggaatctggttgtttagacgtttacacttttcagcctgcagaggggtgaaataaacgaccatgggatatttccaactggcttaagatccccatttagaaaatacacaattccagataataaaaacaaacatgtgaacacaattttcctgtctctgcaattttcagagaagtctacattttctcatgaattcagagaactgcaagctcagagggaagcttaaccacataataaagagaagcactgggggagtcgccggctcagggcggaggtttattctcctgttagctgcacacacagagagaggtttacattatccccacgtgatttccacctatctggctgtccagttaaaaaaacaacaacaaagaatcatgtttttaaatttgtgatatggagagcaacatttgaaactggttgctgaagacatggaaccaatccaaatgcccatcactgatagaccggataaagaaaatgtggtatatacatacaccacggaatactatgctgccataaaaaggaatgagatcgtgtcctttgcagggacatggatgaagctggaggccatcatactcagcaaactaatataggaacagagaaccaagtgggagttgaacaataagaacacatggacacagggaggggaacaacacacaccagggcctgttgaggggtgggggatgagaggagggaatttagaggatgggtcagtaggtgcagcaaaccaccatggcacacgtatacctatgtaacaaacctgcacgttttgcacatgtatcctgtttttttttttttaaagaagaaattaaaataataattttaaaaaatttaaaaaaagaaactggttgctctactggattttcattttggggggttatgaacaaaagcccttcctcaaacgggaacatcagcctctgggattagcccaaaagtctccgttcccaggtggaggcagaggccttctttgaatcttgctcaagaaagaaccagttcctgggcctctcaaagtcatcacagccaagttccccaggataaataacccccgatcagcctgcaatgaggactctggcaatgggaacttaactcaagttagaaaagcaagttgacattggggctataataaatcctcattgcaattctttcttcatatgggtcagaccatttgtataacatttattcatcccatgctatctaccagggatgctgtttgcactaggccctgtgtagggtgctggggatacagtgtggacaggaaactcatattcctgaaacccagtgtcctcctgaaactcatattcctgaaacccagtgtcctcctgaaacccatattcctgaaacccagtgtcttcctgaaactcatattcaggaaacccatattcgggaaatccagtgtcctcctgaaactcatattctggtggggcctgggagaaggtgagcccatgcagaattaacgaaagaaagagagagtctgtgaaaagtacaacaaaggaaataaacagggttctgcaggtaggatgaagctgggcagtgggcaggccaaaggtagctgaggcctgaaggatgagaaagaggcatgtgtggaaagattgtgggaacagtgtttcaggtagatggaatggcaacagcagatgtcctgaggctggggagagcttgtgggtgttggcaacaggccgtatggctggagtctggcgaatggcggacaagagtggacgagaggaggtggaagatggggacaggacactggggccatggcaaggaggttgagtgatagcctaataatctaagagcatgggggccttgaatgtgagattttaaaaatattgcaactgggcgtggtggcttacgcctgtaatcccagcactttgggaggctgaggtgggcgaatccctcgcggtcaggagttcaagaccagcctgatcaacatggtaaaaccctgtctctgctaaaaacagataaattagccaggtgtagtggtacacgcctgtagtcccagctactcgggaggctgaggcacaagaattacttgaacctgggaggtggaggttgcagtgagccgagatggcaccactgactccagcctgggcaacacagtgagactccgtctcaaaaaaaaaaaaaaaaaaaaaaaaaaaaaatatatatatatatatatatatatatatatatatatatatatataatatattgctctggctactggaaggagaacggattctagggagatgatattggatgatactggaagctgagagtgcagcaaggaggccatgcagtcgtccaggtgagaggtgacagtcatgatggacatgggtagccacatgcaagccagctgtgctatcacctgacagcgagaaaacaacaatcacaatgagaccacagccaaagtgtccatcgccagcaatatcagcaaatgaaatgaatcaaaagtttggtttctcttcctctaggcaagaaaacaatcagtattagctcaagcaagcaacgctccatgccttgactctaacatcactttctgcgtatttgtaagttgagctccaatttcggttaggaaaggttgtctctaccatccttgaccgtgactggcatggggacagcacacactgatcatatccacacaggatacagcctctgacacctggccgacatgtaggcgggcagaagtaaacaaatgagacattctgccaggagaacaggctgaatccggcaaactgaatgttaatagggagaaatgtgaagtattgaaattaagccttaaaaacgaatggcacaagtgagatctattatttatttatccagagcttcagtggatttgaaactcactaggaatccacacctggaaaactggagcctccactcacataaatagatattcaaagcccagggccaaggaagtggtgctgccccgttccccaccaagcggttcttttgttttgttttttgttttgagacgagtttcactcttgtcgcccaggctagagtgcaatggcatgatctcagctcactacaacctctgcctcctggtttcaagtgattctcctgcctcagcctcccaggtagctgggattacaggtgcctgccactacgccctgctaatttttgtatttttcgtagagatggggtttcaccacgttggccaggttggtcttgaactcctgacctcaggtgatctgcctgcttcagcctcccaaagtgctgggactacaggcgtgagcccccaccaccaagctttaagaacaactaaggtagtaaaagaacatgatagtctcttagaagaggcatggaagcaaggatggttgttagagaggaattcagtatgcctgtcatatttaaggagttttcaaacagttctggccagttcctgatattcaactctcattaggctctacatataatgtgctatatactgctatggctacaaataccccaccactactgtgccttctattaaacaaatacgataggctgtctagaaacacaaaagcaatagcaccagttcatttcagaatggccaccttcgaggaagcaaaacagcacctccccaactcgctgtcctatatgtacacagtacccaagcaaacatttcttttcagagaaggcagcaacttttctatttgactcataattatccatactaacggaggggaacaatggcacagataatccctaaagaaaaggcaattcaaaaataatttgcatttgcctttgggatgtcttatgtgattttctccagtagatttaccatctttgccttgctcagagcttgcttaggatgatgttaaaattagtttgcattcttgaatgagtagccgatggagagggaaggagtctgctgtgggggagctgaacagtaaggaggcttcaggatggagactcaaaaatccacagagagaacgagctgactgtgacgctccctgtttctctgtgcccttcgaggggcagcctgggttctcactaaaatctaatgtggagccttgtaaaaatgacaaacaatagctcaggtttatatcacagccagtgtataccctgagtgcagatttattcctgatgctctgtgaagaaaaacgcaaacatctgcagaaaaatcagagtctgcaaaccagtctttgcaatagttaacatttagtgggggcagaaaaatgcagggaaaaagcaaatgcagttgctgcattgcataaacaagattagttagcagcctttctattgatttttttttaagagtgaaataaaggcagcataagtggggcaggaaatgtccctttcatatttaccgtaggtgctaaccaaaacaatctactatataattccaattcacaaggattccacatatttgaaattatttttcgcaccattttcattatatacatgcattttaagtccaggatgctttctcttccataaaaaccatcacagtgctttctagagagaaatattgagaactgagttgaccggcattgatgccttcccttttcaatttaaaggttcatttgcacttcaatatgcattattaacaaagcaccgttgttattcccattctccccatttctccacaagtcaaaatgactggaaattacaatcatgcttctagaaagctgtaagctaaaagaattaaaatatggctggcaagtacagaccaagtgtgtacttctatatgaaacgacaaacatatttgagtgtcatttaagccatcaaattataaatcttgtaacgtgggcaacgtgcattcaacaaggtactcaaagcaaagagcctggaaaacaaaatgcaaatgttctacttgtttatgaccggtaaagctacagcttaatcacatcttctccaaggtttggaatcaaaggcaaaagcatttgaagagtaaaataaacctgccgtgggaccccagaggctgatctttaaatccaccactaagacaggttgcggggagaagcacaagttgaaaagtctcttgagcttgtaagggtagaggttgggggggtaattttcaagctctgttccttgggattaggatacagtgttctgccaccaagcagccatgtcaaggtgagccacagtaccagatgggagagttcctccccttcctgtgatggggcaggaaacgaaaaagaggttgtgagcacctgccatagaaagtcttagaaacatactagcaaacagaagacgtgagggttacacaagtagaatacctggactgaaagaatgaatgtaaaattagagttaaaagtcctgaactggttccgataagagcagttttaggggaacagacatctatccacaggtatgaggggaattctaagaattagaaggtatcatttgggataacccctactgtttccaactagaaaaatgatttagaatgaaccaagaataatattcattaaatattgagtgctaagcagtggtctactgaaattcaagttaggagacaacaacgggttaggagaaacctagaagaaatgttctcggacagtcaaatataagcacaagcgacatcctatctataaattttcttgatttcttgtcaacagaggaacaggaaatccagaaatggaaaatcaggaaattgttgataatttcctatctgtttctgctcatttaaattcagggcctccagccaaatgttgggaacgattgcctttaatccttattaaaagagctctactgtagcctctgttgcccacataatgccagagagaaaaggggcaggccacccttaggggtggaggtttcatggtgtgacactacacgtgtcaggaagggaagtctgtctgcagcacagactcccttaggcaactactctttccagtgctgctgcaaaaaggaagacattttatcagcagatccaggggctggtggccagaaaacacagactgcttggacggtcccaggagggaactaggacaagcatttgcagcttggactgtggataagcaagattcctgagccacatcacgtggaggaaggcccagttcacctctgcataagtgtgtaggcaaagagtgagaattctctgcaaattataagaacccaaacttgctaataaggaaggctctatgtagtctttcacctccagtagatggagagctgctagagagtgggtcagggtccaatcttgtcttgcttgtcatggtggcgcccaaccctgggcctaggaccatagtagggtctcttgggagattccatgaatcttgagcttgtgggggtagaagttgggggggcgtaattttgtcatcctttgatcccaactgtgtgactttcctcagcatattttaatgagtctgagactgacatctgcagtacagtgatggggatttggcttatggttgtgtcccactgtataatgtctaccacctccagataaactgggcacttccatcccccagatgccgcatcatctagatggcaacatttctccagatgtcctagtgtggggtatccgtagcttgagctcctagctttccagaaacacaaaatcaggtatcccccttacccttcttgcccatgtctgagagggtggtggaaacacattctttgcagcgaggtttggtgtgttgtgatgtgatccacatgatccccggacgcttttcagcttcttcgctgggaagagtttgtatctgttggttgcacttttcattggttctaagacatagctttcattttcaaacacaataagtcccctgttgaaaaagaaacaagaaaaaatatataattttaaggacagcttcttgtttatggccaagacacagttcttaacaagagagagaatgaaaacagaaacaccaatttacttatattctcagattttgattggaaaggacgtttctgtgacatatgtttgcattgattcatttggcaaatcttttggaaagttagcctaggaattttcttctgtttgaaatattttatggtaaagaatacagtgcattttgcttttgtatgtttttatctctttttatgtctcaaagatatattgccgggaagaagaatgaggaaaaagatgttttaactgcttagaagataactgtatctgaattagcagacacatttcaaaaggaaaatgtttacttttaaaatatttcaatagcctcaggggtacagtagcctttggttacgtggataaattgtgtaatggtgaagtctaggattttagtgcacctgtcatctgagtagtgtacgttgtaccccacaggtattctttcatccctctcccgcctcttggcctcccccttctgagtctccaatgtccattatattactctggatgcctttgtgtacccatagcttacttcccacttagaagtcagaaaatgccatatttgtttttcaattcctgagttatttcatttacaataatggccctagttccatccaagttgctccaaaagccattaggaaatctttttataaaaggacaattcctacatctaattatttatcctgatcagccctattccctaaatatttgatggaattataagcaccatgagtacaaatttatatttttttatttacttatttaatttgtgggagatgtgtgaataaaggaacccacttaagtacacagaacattagcactgcttcttggaggctgaggtccggcctctggatcctgtgttcagctctttctggaatcaagaacactacagggagaagtgccagtctcaacgctgcaagggtggcctctggagtctggaagctctgggtttgagttccagttttttacttactagttatgtgaccttaactttgagccctggtttcttcacctgtaaaatggggataatggtacctacttctcagggttgctatgtcatcgagtcaaaacgcttagcccaggggaggccccaggtcagtgcttgagagatggtagctttctttactattaataagggcagattcatggattaggcatctgttaacaggttaactgaaagactgacaacttcaggaaagttctgtattttgttaacccatctgctcataggaatactggtcactcatggctctgtgatataaaatatagcattaaaaatataaatacatttctgggaatgacaataactaagaaagaaccttttgagccagtctttaggtttgggaaagaaagcatagattctttttaaaaatggacaaatttgctgaagactctaacttgcagagatagaaggtgacatttagccatggaccatgacacatgtctgaccttctggagctcacagctaaggccacatcccactgcctggaaatgagtaatgctagccttgggctgtcgggttccttcaaacgatgggaacctcggcctgcagcttggttttcatttctctctttgctaaggtggggcagtgaagtgctttaatttaaaaggtgcttcctgatgttgagagaaaggttttctttggagaaatgacaatttgggtaacagcaaactggcatctctgaattcccatgtgtctagtaccttatgttatttagcgaggtgaccactatctctccactttagaaagacacaaaattttcatgtaaaattcatctgactggaaatggacccttctaatacagtgactactaaccttttgtgagacatgaacctccttagactcttcctagaataattcacatacatacctgtaggggctaagggaaaatgtcctcctttgccctctgaaagttcactacaaatcaactgacaaaaggcagaaatattatgggagaaaaggcatacaattttattttaacagtcatagcacaggtgaattgtagaagaatgattactcaatgggggcacagatggttatacacccttcttcttaggagaaagggagatagggaagtatggataattttagggggtgagtaaatgatttttaggggaattcattgggctggaagaacatacaatggcctgggacaaagtctgttgggcctgcagaacagacaacggtttatgacaaaagtctgtctggatgtgttgacaggcttcagtctttcttcctgtgacattagttaatgaaaactcagagagggaccaaggtaatttatttcttttttggagggtctatagtttaggcagataagggaatgtcagagaacaacttcatcctgtgcttttggagagtcagatggggtgaaggtgggtgccaggggccagagagaccttgagggttttccttcagttcagcatgtcaaagatccatattttggggtatcattttctgagccccaacatacataaccacaaaattttgcagattattttagcaaattcaggagtgaggataaggtctatgtaaatggaatgaggtttagggcattagttctaatatataataatacacaatatataataatatatattatataatatatatgcaatataattatatattatatattacatatgtaatataatatatattatatattacatatgcaatatagcatatattatatattacatatgcaatataatatatattatatattatatatgcaatataatatattatatgcaatataattaaatatattatatattagatgtataatatactatattatatatagtatatatatagtatatatactatatactatatatactatatatactatatatactatatatactatatacactatatactatatatatactatatactatatatattatatactatagtatatatactatatagtatatacatactatatattatataatatataatatactatattatattatacatgtaatatatattatatatgcaatacataatatatattatcttacatgtaacatatattatatattacatatgcaattatatattatatgcaatatataatatattgcatattatataatatgcaatatattatatattgcatattatataatatgcaatatgttatatatcagaaattatataatatgtaacaatatataatataatagaaaattatatattatataattatataataatatataatcttatataataattagttctaatatataatttatattgcagcaacccaaggatctaggtatacatcaatcctcgaggaatagctggtcaagttgcaaactccatcagttttcctcaatctaagcttctttccaaagaagggactgtgtaaggtgttcctatgtcattcattactgcttacatatttgttcagtcattcatcatcctatgctcattgatggcccattcgtaggtagtatttaacaactcttaaattttaatagattgacagtatctcaacgctcaaatgatacggaaggaagaggcttgagttagtcaagtatctattttgaacacaactggtaagcaaatacagactaatcaactcattagtatttaactggcttactccaccaatcctgttttatgagttgtcatgggcaatgggagaaacagatctatcatgctcaggatactggtatcctaatagacaaggcagcatcgagatatccgggacaattagaaatcctgtgagagctaagatgtgcatttgaagaaccgtaacacttaatccttcagagaagaaggggtccaatgtggtttggagcaactaaaacatttttcaatattttcaaatcccaaatctgtagaaattgttacttagtcatgaaaatgttctcatgtctccttctaagtcatccaaagtccagattgactaaaagtcattctatgaagtgttgccttcccccacactggtgtccacgtatatcaccaaacagatcattcagggattactttggtcatcaactctgtggggtggcttgtgtctccttctctgagatgttctttatgaaataaaatgtagacttctaactttggaataggtaggagaggatttttgtttattaaagttgattttattaaggatgcgaacttaaaaaaataggcaaagggaggcagggtgcggtggctcacgcctgtaattccagcactttgggaggccgaggtgggtggatcacctgtggtcaggagttcaagaccagccggacaacatggcgaaactccatctctattaaaaatacaaaaagtagctgggtgtggtggcacgcacctgtagtcccagctacttgggaggctgatgtgggagaatcgcttgaacccaggaggcagaggttgcagtgagccgagatgtgccactgtactccagcctgggtgacagaacgagagtccctctcaaaaacaaaaaaaacaaaaacaggcaaggggaaagtggaaatgaataccatcaattctgccctaaaaagaaaatggcagtaacatttcattttgtattgcaacattttctattttacatcggatctaaataagctgaacacttaactgtaaaacatgtcaccacattctaatcatgagaagcaaattactgaaaaagtttttctacatagtggaatatttctagcaattgttacttagtcgtaaaaatattctcttatcttcttttatcttttaagtcatccaaaggccagatgttgagaaatcaggatgaaggccttccctttactgcaaacaattggcagcctataataagcttaattaaataattgctttggactgtcttgggtataattaatcatttagctctaaagaattgctggaaacaacagtggacacaaaattgaagcattcagggtttctgagatacattttgatgttctcacagcccttactggccctgagttagataagtgaatgtaatttgttttaagttgaatgtcacagatatttagttgtaaacctgaagttggaagactctcagagcatggaatttaaatccagtggactttgcgtgtggggttctttctccctaggtagagtagggggaaaagatgagaagaaagtctccaatgtttgggaaagatgaagaccgtgggtcccttctctagagcgacaggaggaggccggcccagccatcaccccaggctcaggccaagttctggggcagagagaagggggttctcagggtggtcagggtcacccccctgtggcactcttctaggatccaggttctgggctgcgctccgtacactgatcactctgctgaccatggctgcagctcccgccatgaccccactgtccaaggtgcgcaggtggcagagctggggacccaggcgggacctgtgtgccccgggcttgggcctctcaaccccacactcgcctgcttccctttgtgcagttttgagagaggggcccagaaccagcaggagcatgaaaaaagcagaattaaaaatgaaaaggactagaattagaattagaaagagaaaatggagccgctgctttgaaaaccagcggccttcctttaacatgtaaaatcctgttgtttttccttgacaggaaacaaagaggaatctattaaaattttattagttgattattttagctttcaaagtggacactcaagagacctatatttcctcaagataagtttttgtccttctgaaaattagtttttaatctccaaagccacgatgcagcaggcaccggggccgcttaatgtctgatcctgatttttttgactgcacccggcaagcaggacagtggcacatggattttgactgcctgtaataagatgatgattagaaaacatgaattatcctggctagctcagtgtccaactgctaactgaatttcctagaaaaagacttttggtctcagtgtggtgctgtcaatcatgtggtggaaaagcagttggcttgaaatttaatttcggctttttttttttttggagcaactcctgggtaaaagtaatatctcaccccatacatgtttgataaacagtcgtggcagcagtattacttaacacatacgcaccacagggcttcagtaatttccatgtgaactactcaggtacagtcaaaacaaatattctttatccttttactatgcgcgagacactaggctagacatacaaagaccccttgcccgtggctcccatttcaaatatatctcatgaccagggtgtgggagcacgacagaggaggtaagagtttaaactgtgataaaacacattaagaatagttattaccaagggctgggcatggtggctcatgcctgtaatcctggcattttgggaggctgagactggcagatcacttgaggtcaggagttccagtccagcctgggcaacattgtgaaaccccattcctactgaaaatacaaaaattagcatgtgtgatagtgcgtgcctgtaatcccatctactcgggaggctgaggtaggagaatcacttgaacctgggaggcggaggttgcagtgagccaagatcgcaccactgcacttcagcctgggtgacacagtgagtgagacaccgtctcaaaaaaaaaaaaaaaagaaaaagaaaagtgttattaccagcattaccagcacatcaataataataatagcagctatgatgtatgaaaagattccctgagtcaggctccttttttaaatttcagtgttatggaaaaataattcacacagcattaagttcactccttgaaagcatgcaatccaatggtttctagcttattcactgagtcatgcaaacatcaccactatctaattgcagacattttcatcattccccccaaaactctggacctatcagcagtcactcttgatccttcatggcccccatgagccaggctctcgaatgtattacttccttttttttttcttttcttttcttttttttttttttgaaacggagtctcgctttgtcaccaggctacagtacagtggcgtgatctcagctcactgcaacctctgactccctggttcaagggattctcctgcctcagcctcctgagtagctgggattacaggcatgtgccaccacacccagctagcttttgtatttttagtagagatggggtttcaccatgttggccaggagggtctcgatttcctgaccccgtgatccgccagcctcggcctcccaaagtgctggaattacaggcatgagccactgtgctcagccaggaatatattattttctttaatatttacagcaatcctgtaaagcagataacatgagcccattttactaatgaggaaaataaagatgagagtccccaggtcactgcagggggttgaatagtgtcccccccagcccccagaaaagatatgtttaagtcctaatctctggacctgtgaacgtgaccttattgcgaaaagggactttgcaaatgtaattagattaaggatctcaagatgagattgtcctggactagggtgggccataaatctaacgacacatgtccttagaagagaccgaagaggagacacacagacgtagggaagaaggccaagcaaagatgcaagcagaaacgggagtgacatctacaagtcaaggcatagcagggatggccagaagccacccaaagcgaggagggagatgtgggagggattcttccgtagactctgctgaagaaaccaaccctgctgaccccttgatttcagacttctggcctgaaaagcagtgagagactaaatttctgttgtttgaagccacctagtttatggcagtttgtgaaggtagccctatgaaacagacacagccatacagccaatcagcagcagagccaagatgtcccagttgggacctggctcctgggcctggtcacttgccctcatcagactggatggttagcctcctcttcagggtcacgcacagcactaatgctggggatgaccttcgaggctgatgagtgaccttcgaggtccaggttagccaacccttccttcaggatccccagcatctagggcccttctgcggaattcctcgtgtggttttgtgcaacctgcttcctgtcactaacaacattttattaaattgatatctggctccctttacacacccagggaatagtttccttattttcgttgttttttttagaaccagcattgcagtttgcacgtgaccagtaggtgagtaagtgatcactaaatatttgcaggactattgaacaagcataagactgaactagaggctttgacaagtaagccatggagagccaaggtgggctggagtgcaatgggttggcaggatttatgacatgatctagtagtgtttttaaaacatgaccttctagaatgtgcaacatggcaatgaaaggaggggtggagacagaagcacagtgggggaggcaattttcaaatctaagaggggggttgaacaaggatggtgatagaagagagggatgaaggagacgctataggggagagcgtgcagggcctgggtggatacaataggttacagaaatctccctggggtcaggcttatagactcgaggtgttgtggaccttctggacaagaggtcaggtggagagccagtctggagacctacccagaggagtttagattgagacatcctgagttttgagtgacagtggggcctggggagagctgagagacttgaccttggatctccttcagagcagatgccacctggcaaaaccaccgtggctggtggccagtggatccctgtggcatgcacgtcaaagcttcttgctgactcgtgcacatgtccaacaatatctgcaaacagctgaggtgggcccccagggatggctctcacaggagtttacccggatgtccaaagatctccatgggaggaagcagaagggagaagggaagcagtgtggaaacctggctagagacacctggccagaggttggaggagagccaggtgggctagtcagacaggtgctgatggagcgagcaccacaagtgcaaaggtgaaggtcaaagtggctttaccgccattccatgccaatttcctccttcatatgttctactgcactttaaatagtttttaaaaagtggattggccaaaattaaggtttatgaactgcctgacctttgggagggcacatctattcctgcactacttactgagtacttgtaacatgccagggtctaggacacagccgtgttggggcacccagtccctgccttcctggaactcccagtgtagcagacaggaaggtgaaggcaaggccacctccatgcacctgaccttctgggtgttagacctatacgttgcaggcacctcgtagaatgaggtatggcagttaccaaggcatgggcaaggaaggataggggccttaagacagggacgtaaacacatatttacaaagcacctgctatgctaccagaactacaatgtatgaggaaatgcatgacagcacatggctgagccagatggtgaggagatggggacaccaggagaggcttcttggaggaggaagcagtgtttgacttgggccttgagggaagagtggatcttccaaagtcaaaagggagggcagggagtagtgtgtcccaggcagaggggcagcaccacgcatgtggcggcatgctctggaaacagccaaaaaaacagcatggcgggaatagggtggtttcctcaggaaggggatggtgggactgaaaaagaagattggatccaaattatgcaagaggtttaccagaaaaaaaattgaacgggggtcagccaggcttgggtttaagatctagttttgcccattatcactgagaggccatgaggaagtcacttttgtggtctctgctttttacctgtaaaccaaggagcatgagacctgctcgtggcttgtgtgagcttcccatgaggacaaggaaaggtgaggtgccaattcaggagaggccccggtctgcagctgggatgaggaagggaagtgagctgggtcagtacctggtgatatggggatggggcaaagggctttgagagggtggcgatttcaaggtgcaaactgcatgacagcaatgctgggggttgggaaacgaactccaggcccctgaggatgccatgccttagttggctgctcaggtgacaataacatctgccccattctcatgaaaacaggaatcataacaatgaagaaaaataaagtatgacctactgcaactatcatcagcaccccacagagtgggtacgcatgtgagtgtgtggtgtacatgtgggaatgtgtgcaagtgggcgcctgtgcatgtcagtgtgtggtgcgcgtgtgggaatgtgtgcaagtgggggcctgtgcatgtgagtgtgtggtgtgcatgtgggaatgtgtgcaagtgggcgcctgtgcgagtgtgtggtgtgtgtgtgggaatgtgtgcaagtgggcgcctgtgcgagtgtgtggtgcgtgtgtgggaatgtgtgcaagtgggcgcctgcccatgtgagtgtgtggtgcgcgtgtcggaatgtgtgcaagtggacgcctgcgcatgtgagtgtgtggtgcgtgtgggaatgtgtgcaagtgggcgcctgtgcgagtgtgtggtgcgcgtgtgggaatgtgtgcaagtgggcacctgcccatgggagtgtgtggtgcgcgtgtgggaatgtgtgcaagtgggagcctgcgcatgtgagtgtgaggacacctcgtgctcaggtgtcaccaaccccatttaaaaaggaaataactatgatgacaaccagtctctagtgtacgatctgatcgagataccacttcctcatctagcaagtgagcttggctcaggtcttttaaagcacaggtaggccctgaagaaattcagcttcagtcgaacctctgtgcctgcaggtgatgaagacttggggctcattccaatgccaagagcccatgagactcctcctgccagatacctgagtcagagctgagagagcggggcaagagaaccagaaaaattagagagagacaaccttttccctccaggagctcatgctccagccaggagctgaagcagtgggaacgtggcatttaggaacaaactcagaagacgggtgcatggctgttttgatgccccagcaggagcatgacagggctggacgtctatcccattacaaagtacagtgggtcggttcctctgggccaggagctggattctcttcccatctcagtgacagtttgatgtctgtgccctgcagagttgcagattatctgaagctcatggctgtgcctccaggctccctggctggcaggaatgagagcaccaagccaccagagcaaattgggaaccagaatgtaaaaagggggaggagaatcacaagcacttcaccgaaaccgtattaactgggagttgcgcatcgatgggagacatacgatacgggacaaaattaacgtatggcctcaacttcacattcgacttggagtcatttcaaagtaagaataaactccatggctgaactcctttttacgacccattttccatgttgtacttcattccctccattcaagagccatctcctctttcatgtccctttctactgagatctttgtgctgtttttgtctccgtgtgctttccgcttcaagcttcaaatgatgaaaaacaacttgttaattccctccttcttctatgttctagaacagagtttttttcttcctgctgatttgtgatcctgtgtttttgaagcaatgtgggatgttctttcgctgcaaaactggaatctgttgggctgtaattaatgtgtcttctaggacaccccagcttccctccaggttcctagatcttaatatgtttctggagcacaccacatttaacacaatttttaatccccattttctttcttaacagctagcaggctggggctactctagttgcatttttttttttccttttacttccagtctcaatcaattcttctgtcagtgagcagttgatcagatacagcttcccctcaccctggtctgattcttgacttgaaagatcataaagttgactgtacagctgcggaatttctctgttgatgcacggtctgctgcttttgtaacaacagcacaaagatctgggaagtcaaaattctcagaagcgcccacagtgaggagttcattagacccacacagcgttcctcatcaccattcccattccctcttggtggctgacaccagacaatgcagcacttactcttctgacttttcctgaaatcccagctgcaaggatttcacaatattcttttctgccaaatttatgagtctgtgcctgctcctggggatgcggggtggatgtggagactcagacactgcagagtctggccagcgaggtcgtcaccaccatgcggaaggaactggcaaccctgacagttgccctgcacctttgtgggaggctgaaagagctaaggcagcgtgcctggcacacggtgactacagggctggcctgggaagagggatggagggttgtgactgagtggcaaggccaagccctatgggaggatttgtcttgcttggatattactctaggaataccttccccagttgtcactctaatgagttaatgtcactagtttataagttgttttattaaggtaaataggagctattaggaactccttgtagagaatccttttctctttgcccatcaagaatctgatagccctataaagataacctgaaaattatccagccaatcctggatgtttccattgatggctgatctcagttttgataattgggaatttcttcataattgttgctggaagaggcctatttgtttctgagtgtccctggctctcagctgtcttctttttttttttttttttttttttttttttggcaaaagctcattgcatttctttggtacattcaccccttccctgctccctgcctcggggaccctgggtgcagttttccctcaacctggtccaggatatagggccataacctgtttgatcagactactaagctccccactgacaactctgattgtttcacagatgagccagtggcctagtcagagccactgggatgtgtttagatgacctccactgagcttgggagagaggcccttattcttcttcttgctttttgagcatggaagcctcatgctgccaacaaaacaaaacaacaactgcctattatggactgagtgtttatataccctgcaaattcatatgttagagccatggcccccatgtgatggtatcgggagatggggcctttgggagctgatcaggcttagatgagatcatgagggaagccccatgatgggattcgtgcccttataagggacaccagagcttcctccctctgtacacgcacaaagagaggtcacgtgagcacacagcaagctaatgactgcctggaagccaagagaaaaggcctcaggaggaaaaatcaatcttgtcagctcattgatcttggactttccaggctcaagaactgtgagaaataaaattctatggtttaagccaaccagtctatggtattttgctatggcagcccatgctaagatagtgcctgagaatgaaagtaacacagaagaaggtagaggcttgagatagaaaatagaccgtgataatattagctaggaccctgtatccagccatgcctagatttttcagtagcataagcctatctccacattattttgtttttctttaagtcagtttgaattcgtgttttttttttttttttagttggagtcttactctgtcaccaggttggagtgcagtggtacaatctcggctcactgcaacccccgcctcccgggttcaagcagttttctgcctcagcctcccaagtagctgggactacaggagcatgccaccacgcccagctaattttcgtatttttagtagagatgggttttcaccatgttggccagaatggtctcgatctcttgaccttgtgatccacccgcctcggcctcccaaagtgctaggattacaggcgtgagccaccgcgcccccgggcagcttttctcttctttacacacaatgaccttaatgccaaattgaaggctgaaaatatccagccttcaacacatgacctttgaagaaagaggtccacctttcaggccccagagaggcacaatagtaaagtgtggatttccctttccaagtgtgtgtggtccttactaccatggccttgtgtatctctgccctggtctctacaggagctgcaaagctttgcaaggaattatcccaggagtgctgcatgaacaccccccccccctcaactagtccagtcccagaatcaaagaacaaagactgtctcatgatgctcactagaggtgggcacagggcttggctttcctagaggtcactgcatttgtttactgtttctcccctggcacccatcacaggggagaaacaaactcaaactttgtttgaacatgcaaacttcccaccatgcaaactggggctcagagaggcccagtgacctgtccatcgtcacacagctaattcaccaccctgactatcatgttctagggtgagaacatctacctggggtcccagagtatccattttgaattggtcactcaccttcacctcagatgccaccaggtctgatcccatttcaccccctcatctctgtctcctccaggaattcaagcactggttttccatgaaaactggccccttatcccccacaagtctttaatcctctactgaccctatccccactcccttttccctaaccctttccactgtgctcttggggctcatggtccatcctcaaatcctatcctgatccaaatctcttccagaatattcctcttacctccttcccctagctgaatcctggctgattccactgatatcacctcccctgcagcctctcaggatgatacttcattacttaaaatttctccctcatgtacctcagctccttggtggtgaacagttgtcatctttgctctaaattgtcacttccaaactctccttcttcaccttctcctgagcgcccactctgcatgctgggcgtgtacgcgtattggagtccctgcctggtagtggattttgctgcatcttcagtaggtcctttcatgtgctcacaccccacgcttcctcaggaaagtgactttaagacacagatcactaacaaaatttagagtcgccagcctctctaatacccgtggaaaggtctctcgactctcacaaaagttgccacctttgaccaggcctgccccaccacctcttaccagagttactctgaagacacctacccaagcctccgcttctgtgcacattccctacagtctatttccagcctggcagctggagtgcccctgtaaaaatgtgaagtcagaccacatcacttcagctccaagctccctggcacccatcactgggggggaggccaaaggacatctgatcaccttcgtgacccctggtgatcctacctttccacttcccttctgacctcatttctctctactgcctccctgtccctgtccactctagttatgctggccacctcgctgctctgggaatatcccaggcatctttctgcttcaggagctttgcacatgctcttctctctgatatgctacctacctcatctaaagggctcacctcacctccttccgaacctccctgactacctgttgcctttcctgtcctccatctcagctttgtctttctccatgatccttgacatcatgtatcttactctatgtccattgtctgttccttccactaggaagtgctccaggaagaatgcattttgttcagtgccgtgcccccagaacctagaacagaactggcaatgaggaagcactcaaggaatgttttctgaacgaatgaataactgaagagaagcaaattcaaaccacaaggcacctccttcacttttcagagtagcagacatcttaaagttcaattgtgttgcataaataggacataaaaatgcttttaaaaaaatgcaggtatgcagaaatgtgtgtgtgcatgcaaatgtgtgtgttcactcaatgatttgggtctgtgtctgctaacttggagagacagacagggttgggtgacaaaagaaagccgtagaatgatgtatatgatgtgactctatgtttgtaaaaataaacaaatacacaccccaatctctgactatgtgtttacatgcacaagggatgagaaagctgggaggggaattcccagcttgcatttttatctgagtgggactggaacgggatgaacgaggaagaggaatagctttgtgtacttatttttagttacatgaaaggaccaacgctggtaaatacttagagataaatcagatgtattgagcaatggggaacatgtgagcaaatagaactctcattctctgctggctggagtagaagtgagggcagcaaagaataaactggtaggtgtgtggttgttgtgtgtgtcacatgcatattctcatcctccatgatcccacacagaacctgcaaagacgtcacaggaactgctgatgcgcagaatgtgattctgctttttaactcaagcaggtatatccttccagggccttctctctcttccctcccatggaatcatgctttggtgccttgggccaaagttacccaggactctgaggttacaaacatttagttcacaaattcgataagcaaatccagtaaaaaggctgaaacagctggaaatttatcaaacaaaatgattttcctggggagcacataagggccacctgatggccaataactgtgatgtggaaggaagcgggctgtgagtaacacctggggttgacttgtctagcatgggaaggtaattgtttcctgcatcatgcccgtagcatagtagcaaaccccctaccaatccatgcctctattcaactcaccttggttgttgctaaattagtttccttactttgtttcctaatgagaggaggccctttaagatttacattaagccagcagcttcaacattggtatgtaatgttctatcttttagcactgggaattataaagcatcagagccacataaatggaaaataattcacaaaatgcttggatgtagaaactcaaccagttcagtcgcttttaccccaccaggcctgaggatggcactgtaagagggggcatgaacatgaggctaagatcctgggtggccatgctcttgtaagcagtggagagagggcctccgtgttctcttgcctaggtggaggtgtagctgagctgggagcccccatcactcactctcagtgctttagcacgagcaggaaaagacagaggttgcctgcagtagatggctgaagactagagccgccatggtcatggccacttacctgagaccagaacacgtgctgagactgactgctgaatcagaatatccccgtacatgtccatggtagtaacagtgaccctaaaggggaggaggagagaatcccatttcagttataacacatttttgcccacttataataaatcaactgcctcttgtttttaactatagaattttccattgcataaaatattgttctacagtcttaatatttaatgcaaagcccaacatgacccagccagggtctatgtcgggaatatctgatttacttacagattaccaacagcggtttttaaatgaaccctagtttcactcttgtctctctggcaccctacaggaaagccctgatacagaacgttttacaaaatccagcagcaaaacaaatcacattgacatcgccattttaccctcatgtaaattgtcttttgtaatgagatgaagaactgtagggggtatttaagcacactgtgaaatgtaataaaacaaggcctaaatctgtggcttatgaaaacgggaaagcagatgagaggaagtgggggtgaagaaggaaggaggggacctcactgaattacccaattgagagctgaaagtctatctcggcaggaaagaaaaataggaaggtcttctaagtctaagacaaaagttcccgtgtgtcatgcctgcaatattctattctttgataatgtcacagcttacaaaaagaaaccacagcacagacacttccttagtgaagacagatatcagtccggaatcaaggttaattttatcatcgagcaaaggttatgctgcagccccaattaagtggcagactggcaagaagtggctgagtatactcagtactcctcactcagatcctctggacgccagctgggtgcaggtctctgcagagaaaggtacatgcatcttctcagggtttcctctgagaagctcctcttttgagcagctcaggtgttagtctgtctccactgcaccctccttagcacacagctccttcacacacgacaacagtcatgcactttgtccagcgcagagcttggtgtccagtcattctgcccaacaaaacccaccttgactttgctaagaaaaagcaccagatgcaattgagtcatgaagaaaaccagacaccaccatgggaaaggggctaagatgatctcttggtctcaacgtagatgacaaaattctcagatcatctaaaaggcgatgaaaggagggtgatagggttaaggggttgcagggacatttattattctgttgagctttttcatattaattttagaagttctttatatactcaggatattaatactctgcctgttattacatgggaaatgtcttttaactttgcttatggtattttttgttcagagtttccagtgtatatcaatctaaatgcatttgtcgctctcttcatgcattttttgcatagctcaaggtggctgttttcagggtcacaaatatgttcttctttattttcttctatctttatagtctgacaattagctctttaatccatctggaattaatttttgtgggactgtgaggttcaatgctaactttcccctaaaaatgagagccagctgtgctttgctgccatttttccttttctcactgatgtgacatgctaccttggcatatatcaaaggcccacagtatgtttgtggtgccacttttgtactctctgtgctagcccactgagacagacatccatttgtctgtttctgtgccaattccacactgttccaatgactattgctctatactctattttgatatcaggtagagttaagttgtcctttaaaattaagattaaattcacttgccataaaactcaccttttaaaagcatatataatcagtgggttttgttgtatattcacaatattatatactcatcaccactaattgattctaaaacatttctgtcacctcagaaagaaatctcatattcattagcagtcactttccattccctgctcctccatctctggcaaccattaacctgctttctatctctatggatttgcccgttctgttattttatagaaatggaatcatacaataagtgccttttgtgactggcttctttcacttaagcatggtgttctcaagttcattcatactgaggcatgcattagaatgtcattccttttctacagctgaatcaccttctgccttgtggatgaaaacatattttgcttatccaagtgttgagcacatgagttgtttctactttttgactattatgagtaacgttactatgaacacatgtgtacacatttttgtaaggatgtgtttccagttctcttggatatgcactatgagtagacacgtgggtctaaaagtaaggttgctggttatatggaaactcaatgtttaactttttaaagtactgccaaactgttttgccaagcagctgaaccattttacattcctgtgagcattacacgagggctctaatttccccacatattcaccaacacttgttattgtttatcttttcaattatagccatcctagtggatataaagtggtatttcaatgtggttttggttttaattttcttaatcactaatgatgttggggatcttttcatgtgtttattgtccatttttatgtcttctttgaagaaatgtctactcaaatccttgcttatttgtaaattggattttggtgtttttattgttgagttagaagagttcttcacatattttcagcactagacccttattagatatatgatttacagatttttttcccattttatgggttgtccttttactttcttaatttttattttatttatttattttttttgagacagagcctcgctctgtcacctaggctggagtgcagtggcacgatctcggctcattgcaacctctgcttcccgggttcaagtgattctcctgcctcagccactggagtaactgggattacaggcacatgccatcacacccagctaatttttgtatttttttgtagtgatggaatttcaccatattggccaggctggtcttgaactactgacctcaagcaatctgcctgccttggcctcccaaagtgctgggattacaggcgtgagccatcagaactggccccttttactttcttgattgtatcttttgaagctcaaaattttgatgaggtcttgtctatttttttctttggctacttacacttctggtaccatgtctaagaaaccattacctaacctaaggtcataaagatctacacatatctttttctttttaagagttgtatgggtttagctattatatttacatctttagccatcttgaattaatttttgtatgtagcttgaagtacaagtccaacttcattcttcggcatgtggacagctagttgttccagaaccatttgttgaaacacctactcttttttctattgaattgtcttggtgactttctccaaatcattttcttttggtaccattcttttctcaaaggtttctaggttatcattccctattttctcttcagatgaattacagaatccaattttaagctacacaataacccattgagatctcagtttgtattacactgaagtacaggtcagtttgggaagaacttatattttcataataaaccgcttgcctattcatgtacatggcaggcctcttcttttaatacggtcatttttatgtcctttagtctagttttagatttttttttccacgtggctgttggaaaatttttgttaagcttatgtataggtattgtgtagatttgttgatatcataaataagatctcttttttcctattttgtcttacatatatttatttttaatgtaaagggaagcttttgattttgtaagttggtcttatattgggcacttttgccacaccatcttatcagtttatcagtttgtagcgtatcttttttctatgttgctgattatatcaattgcaaacaatgaaagtgccgtgtgctcctttttggatccttcatacaacactgaagagtgaaatggctaggtatgcaggggccatggcaggagaggacttacctacagagggaaagcatgtgcaaagatagtgggcgctgggggtggggagtggcatccaggggtggggttagttctgctgggctggaaggttcagatgcaggagtgtagctctcacagtgccctgttcctcccccagagaagctgccatcttcaataagcacgtggcttaggaaaggatgcatcaggcttccatccaggccatctgggagggcaaacctcgctgccaggtcacctccttagcttttgtgtgacatatattttgaatggcttcagtgtcctctcactctagattaactcttagttgggtatgtaggggaagcatgataattctctgactatgagggggttatataattggatcataatgctctggggcatcagggggatcctagtaccttcccaggccgggcttccctggtagggattttagccctgggcacacggcaggcatcaaagcggaagacaatgcagagagtgaaaggttggcagctgctgttaggattttggctgcttaaggtaaccagaatcactgggttttgactgtcacagatctttggggtcacatatggttacagaatttcccccattttagaggaatgtgaaatgctgctctaagtagctaaatactgtttaaaaaactgaaaaccaaatggtgacaataattttaattactgacctctgaaatttcaagctcatttatactcaatctcaatttgtttttaatagattatttattaaatgtactttcaaattaaatacacagaaatataagctcgttagagcatgagcttagaacaaactagtatcaaattaatttccagttcaacaactcacttgaagtattgcttatgagggaggaggggggtggatttcagctctcataaactgttgcttaaagtaaacaatctcacttctctcagtcattagtagagttaacaactgatttccagctttaacaccacttttgtatcaccttcagacagttgactaacaagtccgttgttcattcctgacagtgattaacttcttagattactgaccataattatgagaactccaaattctagattttccaaggcaatgacaatttcgtgaaatttaatttttttcaatatgtctcattaagtgtttaaacaaatgtgattgagtttttataacataagtcaaaacacagataatttcgcaactcagcaagacatggttgtcacaccatgcatcacgtggttggttgggaaatttgattatggggagtggaggagatgcagtcttcaacccctgggggtggggggtgaccctcttagccagtgacaaaggcagagagagaggagcacaggctacatcaccgctagtggccagcagtggccagtcaagacaatctccaggtgagcctgtgccctgcccaagggtgcacctctgcacgcactgatgctaagaggcaggcaccaactaggccttgtgggttcacaaacacttggtttttgggtctgaatatccacaccagaaagagacccagcagggagccatcatgcctaagaggggcttgcaccccagggccccctgacctgttgatcactgcatggcccttaccagccagccagctgtggccacaaccctctgcagaccttccaacactgcattcctgttcctctctctgattgcctcaagggcgctaaactgtatagcctctttcttttcctcacccttatgtctctaaagacattgccgaacaagacatggtcccactaggccaggccgtctttgcctagttctgctgatccaagacattctatttctaccaacaaaacacaacacagaaaaagagccccaaacatgcataaccagaaaattacatcttttccttttcaaaaacctctaaccatgtattttatatacttattacttaacctaatgcattttcccactccagtagaacaacttttccttctgtttaatactatcaatcaaatataatggtgggtaagaggaagatggaataagaactcttgaacttgaaaattggtagccctcaactctacgccatgtgggaagtaaaatcaaacgtctgttacccaactctcagtggactagaaggaaaggcattttatatgcttaagtggtaacaaagatggcttgaccttgtgattagaaaggaatgctaccaaagtctgttagggagtataccaaatgaaaattattctgaatgccttctttaggggaaatttgtagggtcttcccagactccttgccctatgcaatgagccaaactatcttgattaagtgcttgaatcacacaatattctagccagaaggaagctttgggccatctaaggccaacctttttcttttagccagccccttccctgaatagatggggaaaccaagacctaaataaccatcaaaggtcacagagctggttaacggtagggcaggaactaaaatccaggcctctcaactctaggccagacacttccctccatacctggctgtcagaaacatgcatttctctcagaaacatgagtttctctctcttttagaaaagaaaagctgccgagaccagctcggtcagggagaccctaatccagcggcactagaggaattaaagacacacacacagaaatacagaggagtggagtgggaaatcaggggtctcacagccttcagagctgagagccctgaacagagatttacccacgtatttactgacagcaagccagtgataagcattgtttctatagattgtagattaactaaaagtattccttatgggaaatgaatggatgggttgaaataaagggatgggttgggctacttatctgcagcaggagcatgtccttaaggcacagatcatgcatgctattgtttgtggtttaagaacacctttaagcagttttccgccctgggtgggccaggtgttccttgctccattctggtaaacccacaaccttccagcgtgggtgtcatggccatcacgaacatgtcacagtgctgcagagattttgtttatggccagttttggggccagtttatggccagatttggcggggggcctgttcccaacaaaaagctatcacctaaaatccatacatgggcggaatgcttttcctgggtaccgcagagcctcattacagtgtcactcatggcatcataagaaggtgaagtcatttccaaactcagagaaaagcccataaataggaggggtccaaaggtgggtgagcgtacatgtgtatgggtgtatgtgtgtctataggtgtgtatgtgtgtgtatgtgggcacgtgcgtatatttgtgtgtgtgcatgtgcatgggtatgtatatggggtgcatgggtgtgcatgtgtatatatgcatgtgtgtatatcagtgtgcatgtgtatatatgcatgtgtgtatattggtgtgcatgtgtatatatgcatttgtatatatatgtatgtgtgtatatggtgtgcacatgtgcatatgtgtgcatgtgtgtatatgtacgtgtgtatatggtgtgcatgtgtgcatatgcatgtgtatatcagtgtgcatgtgtatatatgcacgtgtatatatatgtatgtgtgtatatggtatctgtgtatatgtatgtgtgtatatggtgtgcatgtgtgtgtctgtgtggatgtgggtgtgcatgtgtgtatatgtatgtgtgtatatgggtatgcatgtgtgtgtgtgcatgtgggtgtgcatgtgtgtatatggtgtgcacatgtgtatatgtgtgcatgtgtgtatatatacatgtgtatatgctgtgcgtgtgtgtatatgtttgtatatggtgtgcagatgtgtgaatgtgtgtatatgtatgtgtgtatatggtgtgcatgtgtgtgtatatgtatgtgtgtatatggtgtgcatatatgtatatgtgtggatgtgggtgtgcatgtgtgtatatgtacatgtgtatgggtatgcacgcatgtatatgtgggcacatgtgtatatttgtgtgtgtatatgcatgtatctgtatgtatatgggggtgcgtgggtgtgtgtatacacgtatgtgtgtatatggtgtgcatatgtgtatatgtatgtgcatatatgggtgtgcatgtgtgtatatgtgtgtgtgtgggtatgcatgtgtatatgcattgtgtgtatatgggtgtgtatgtgtctgtgtttctgggtgtgtgtatgtacatgcatgtctgttgccagcctgcatttcagcatgactgcagtcaggtccttgttcccttgcacgcaagccccaacatactacatgtttgcttgagactaaaacaaggtgacaatgcatctgagcaaagaaaaagtgactttgcagctctgtgtgtttctataactgggctacattacacttagtcctgagagtgtgcagggcaggattgtgaagaaataagtcaccacacccatcctccgagcatctctgctcccatgtccataacaagaaccatgtctggttaaaagactataaagaactaacctcagggaccactgaaatcattttgctgtgctagaattctgcagagagaacaaacgcttacaaaatcatgttcatagtctttgagacctccaggcaaactgggcctgggaacagcacgtctgcaatagtgagatcactagatccatccagaattggaaatcttcgggttgagtctctcagtttttaatctgtataatgggacgggcacttagttgtccagagttttgtggatcaaataaacatgacatggggacgcaattcataaaatgtaaggcattgttacaaatctggaatacgaacataaatattttaaacccactctgctgtaagctctattttccacttgctattttcttccacactgacccattgctcagtgtatttttgttgaacgaatgaatgaatggatgtgcatgagagaaattgacccattagagagaagggagggttatttgcttataccctgtcacttggctctaactcctaactgcaaattttcttggatattgtgtgaaaatgcacacgggggggttagcaggggcaggggtcagaagacctatagggccatttgcaatttgatggagacacacaggcctgaacaactcagttatcagccgcatcccagcttctcatctgttctcagaatctacaagggatttcagaaggaacatatggtacagcgtggggaagaactgctgtgaaatgatcactggcacagcagtggccatggctggctcacttccccaaagccccgactgagtgccaggctcggtgtctgtttcatcgtcacatcccacagctggttaagtgctcgagctgggattcgaacctgggtagctggactctggcttgtgatcctaaccttgacgtatcctgtctccagacagaaggtctatcttacagcctgccctttcctgacaattttatggaagaaaagtcaccaaaacagtgagttcctctgggaacgtgggtttgccccttgcattgtttggctcccaaagcatctctgttatgggcacattatgtcatatgttgttagaatgtatgttccctgaggacaggggctgcatcctcccttctgcagacttgccacagagtatgggatgtttactggtctgagttcagttgggccttggagtgatgcacttagtgaatccccagaggcctgttctggcctctcctctcctcatattccaggactttggttcagctgctctcccccaagagcattctctaggtgtctcccattgtaaatgaatgctacccgcttccccaatccactccatttatagactaattccattacaacaaacaccatagccagaaacgtataaccaagactcagtgttttgttccaagtgaactggaggcagtgtagcacagcatataggagctgagactctcctgtccaagagctagccaggcctgatcctgcttagcttccaagatcagatgagatcaggctcattctgggtagtgtagccttagactaggagctcagattctagagtcagactatctgggtttgaatccttattaactgtgggtgtggccgagttatttagcccctcaatgtctcagtattctcatctgggtataaagatagcaagaactgatttttggtgaagatcaaacaacagaatatatgaaaagttctgtgcacagtgtcttgcctgttgttgatatttactcaatgttagctaccacattggacactatcagtaaacatttgttgaattagtgcatgaatgaatgactgaataaacataggcatgtgtgaaaaggtagggccgtcaccactgtggagggtgatactggtctaagaaatttgaatttgactgaggaggcattgggggaagctgctgatgatttgggaggatcaaaatgtaaatgcaatcttgtgatacaaatagaaagatgttttagaaggatcattcaggccggtgcggggtctggattaaagctaggttatactggtagttgggagaaaaagacaggtggctaaaacatcttccagctgtgaggaagggagggcctgagctggtgcagccatgtgatggtggacaggaaagggtgtggaatgtgctgtggaggtaggagtcaccacgggacttgggtgaagacccaagggagagaaggcactggtgttgagtgcctcggccagtgggacagcaaagcagcctgtgagggagaggcaggcagggagagccggtgagttaggtatgtgtggagtacagcaacagcagggaaattcaatccattctcaatgatgttttaagaagaatatgatgatgagcctggcttgtggagtcctagttagggaggaggagtcaggctagcaggattgggggaaagcaaaatgaagaagcagataagctacaagtctgcctttttcatggtccaggacacatatccctcccgtgcacatgactcacaatcttcctgtgcccagctatcaccagacccccagctgacagaaaattgcaatttagttcactgcaaccttggcattatcaatattgcacaaagctttcttcagcacaccggtggcacaagcaccatcctataacatctccagcaagcctttgtctccttgcagtcagctcctctcttgctggcctgcccattgctcctttgtaatgtattttcctatgatctctagtaaatctccctttctttacctacaactgtcttggtaaattcttcttacccccacgcctctggcccagatagtcactgcgcacctgcaacactgcttacacttgatacacttatgagatgtgcgtgatctctgactttccccttccttccagaattatcttttcatctcgattagatgctttctaactgtaatgaactgtggttaactcctgatagtcatccgccctgacgtgtttagtccaagctggttgtagaagatactatccctttctgacaatcagtagttgccatggaaatgaatgggatgtcacccaaacaacacttttggccaaaatattagattctatccttacctgatggtccagcctcagttcatctcagctggtctcctttgaaactatcaaagcaaatgctctctattttttccagtgagaaacatataccacgaatgaaacatttttgggtcctgatcatgtctaaggggagacatgtttccttcctttcattccgtgcacctggcctctgctgctatctcctctcacctgggcttcaggctgttccacaagaggcccctgcctgaccctgacagagcaggggaccctccctctcccctcctgttccctctgactacgacttcatgctggagccagcgggtgcttttcaaagcccaaacatagtcatgacacgccttgaggaaggcctttattgacctcctaatgttcccctatcacaaccaaggctatcaacatggtcctcaggtcctatacgctatgactttcatcagctcctaaacacttccttcctctcccccgccaccccaagtaaaactcagcatcagcctggaacgtttctcctcctgtcccctggttcatgcctcctcagcctccagctgttggttcaaatgttcctttccccataaagccttccatgatccctcagaccagattagggccccgtggcctttcctttggtgcacttagcccagatgttaattatgtttgtgcttaccaggataagggcagtcttcttcctctagcctcccctcacccatgggctcccttgtctgtttttaatccctgctgtattctcagcataagggggcatgtgaacaggtcatggtacctgcgtagtgcaggttcttggttgacaagatgcatgtaacagacgaatgtattccctccaaagcactgacagcatctagcctttttggggacctctgccagcctttcagagctgtcttttggcatgtaaacagcagaaatgtcacacggatagtctcccgcaggccttattaaaagtaacaatataaaacataatctccccttagatgtgggcagcaaaggataaagccacaaatatttcatcctgtcaggacagtcgagagaaaagatgtgattaactccaaaattaaaatcagccactcttctgagtcaaccagcttataccaattgttgagatatttaaagaaaaaaatagcactatacactatagccaacaaaaagtggttcttattttatacataactttaaatttaggaaaattccctgtgtgctgacttgagcagaagaggagatgagtcagcaaatttctttttgttttccagcctgattcaataaaaacaaaaccctaaaagctgcatctgggtcctcaccacgaaaaacaatgcaaagcctcggactctccttaaggggctcctgctggaaggaccagctgttctgggctgtgggttttaattagtgaacaacattgttcactccctgtctttactgtaacaaggctgactgcttggaaaggcattcaaaggaatgggggaagggaactgctgggttaaaagaaaagtcaccatttttctaattataaaagcaacatgtgcttgatgcttctggagatttgggggtgccaattaatctagctttcagttgcttccccagtggagatgatccacagagtcagatgaagatcaaaatacagcatcagcttaatgactgccaaaaaagaggcttctggtatattctggagaggatactagtttaggcctagacagtagagaggcttcctgcaatttccaacttccatcctccccatgccccgacctctttccccttcttcccagccaaaagcctcaggacccattgtggggaaggtagaaatgaggaacactgctgcctagaggactccatggagggagggaggggcaagtctcacccactactgacctcaagggctgcccaacacaggggctgcagccactccccagttagcagggaccagggattttcagggcctgtctcctcccaccctcttccctgtaaagagacagttccatggggaggaccgggggaagacgaggggaatggagcagacattcaccctttcacacagtaaccacatggaaaaggaggagaggaaaaatgtgagctcctgctcctgtgcacatgtgaatcagagaacccagaaaagcacagagtcccgcaccacatggagacaaacactatcaacgccctggagcccttccatccgggctgtttactaagatgcctggatatgtagacttcagcttttgcaatccaagtcccaaacagacctggcagttgttgaacccctgtttctctagtcctctatttcttcgtcttcttgcttattgcatttttcctcccaagtgagaaagaaggggaaaaagtactgtgatagtaaatattgagtgtcaacttgattggattgaaggatgcaaagtattattcctgggtgtgtctgtgagggtgttgccaaaggagattaacatttgagtcagtggactgggagaggcccacccgtcctcaatctgggtgggcaccatctaatcagctgccagcgcggctagaataaagtaggcagaggaatgtggaaagactagactggctgagttttctggcctttacctttctcccgtgctgaatgtttcctgcccttgaacatcggacttcaagttcttcagcttttggactcttggacctacaccaatggtttgccaggggttctcgggccttcagccacagactgaaggctgcaccatcggcttccctacttttgaggttttgggacttggattggcttccttgctcctcaacttgcagatggcctattgtgaggccttaccttgtgatcgtgtgagtctgtactccttaacaaactccccttcatatatacatctgtcctattagttctgtccttcaagagaaccctgactaatactaatacagatgcctaagaaaaagaaaactagtaagggagattgtaacagaatgcacaaaactattcaaataactttgaatgcatattttacacattctagagatgtctgtattagacaagcactgttcaccatcatagatcgtggacatttggaagaccggagcctattgttgtggtatttctaagatctctcttttctgtttctttctgaaataactatttacactgtggagatagcctcagtgctgagtctgaaaacatattttaaatgagatcttagggaggtaaaagaggacataaacgtcaaatgtgaactcatggccctgcccatcacttatttatgacgttgatccacagatctttactttaggactccatctttctctgtactctaggttcttatatatccatctgcctacagaagacctttacttggctgtcctatgacaaactcaacacagacaaaccaagactcatctcctctgccttccaaccaacaactgctccttaatggtaccactgagaaacaaattgcccatccaatggcctaagtggaagggaaagtcccactgatgacacctcccccaccctctatcccctgatcctgtctcctttgacttcccaaggactcttgactctggccaattgctgaccattccaaggcccagttctgtaggcaaaattttcactaactacaatgggcccataagaaatcttcctgtcttctgtctaccaatattcctaccaatctttcttccattctgtcatcagagaccctttctaaatcacagaactgaacaggccattctgctgcatgagaacttcctatgactcccaaatttcaataggtaaagttgaaactctttagtatggaaaggtttcatccccatcttggtcttcttctttgcccacttttaaagacccagattaatgttacttccttagtgaaatggcgtccaaagaattaaaatcagccacaattaaaataccacagtggtattttgtacacatctcctattatagtaattacattaaaacatgttttttaaatgtctttaaaatgctctgtgcctcttaagcaggatttatatgctgaggaatatattttagtcagcctatctccccatagcctaacagtgtctgcaaacaggaggtgctaaataaatgtttgctgagtgaatagatgaagaaatgaattttacatggcatcacctaagacaatgcaatgctagatggataattttattaaaaatctattatatgcaagatgctatgtgaggctctatggggttaggaaagggatagatagcattctccactcacaaaagctattaaaatcactataagaaacagtataggttatcacagaagaaatactatcagttataatacttttaatctgaagatattaatggattaaattaccttagtagatatactaatgttgaactatccttgcattcctcagttgagtataatttggtcagaagtatttttaaaatatgtactggatagggtttgtaaaatttacttaggatttttgcaactacgtccataattgaaactagtctgtaggattcattttgtgcatgctctttttcttgttttagaagctccttccacaccctcctttaaaaaaattattctttttttctcaggaactatttgtttcttatatgttagttaaaactcaccagctaaatcatttgagtctgagcttatttttgtcagtaaatattaaaagtactattacaaatttaatatctttatatagttatatttaaattttcctctttcaccttgatccagtgttaataattttacatttctaagaaataattagtattgttcacaacattcttgtgatttaaaaaatctctgaataaaaatatttatatccctctttgcattcttaatattatttacttgggaattctttctttcttaattttataaatgtcttgtccattttatgaatattttcaaagcaccagcttttggtttaattcatcttccctcttgagttttttttttttttttttggtcttccttttcattaatttctgctcatttaaaaaatcttcatttctgagagaggtatatttaaatctcccactctgtgaatgtgtccagacattttcagtgacttgctttatgaattaagcttatcaattttacatctagagacttttcttttgaggaaaaattgtaaaatgctgtcagtattgaaagcttttttggtaaccttctaggaaccaaacaagttttagcccataatgtctaatctttaatgcttttttgttttgtttcggattttcagaaatcctttaattaggagctgggctaaagcttagttctagatgaatctataattagatttaaaagttacatctggattctgccatttatcactttatatattttgagacaattttgctagcatatacagtttcaaaattcttttactacctttctaagttgctccttttatcattacagaattactccctttatgcctattaatgtcatttttgccttaaggtctagcttctctgatgttaccactacagcagctttttttttgttttgttttgctttttttttaattaagatttgtctacaatatcttttcccattccttttcttagttctcacaaccattttatattttgggtgtgaatcctgtaaaaatgatgtagctggattttattttaaattctaagcagatcatgttttcatttttacaaagagattccatctatttacatataatgagattaatatgttgactcatttttatcttgctattttatgtttttctactctttaaatagttatacttaaaattgcaggacacactcttatcaaaatctaaagttaatcagcgtgtctattattctccagtacaatacaaattcttaaaccattttaaatctattagctcatctggttttaaaccatccaaatttggtcactgttgcaacagtcattttaagaagcttatttaaatttattcacatgcattattttgtttactagtgcctctgacttcctgtccttgctgctggtgatcagtttccttcctactgagctattctttgttagttaccctttggtagataccttcgttggaatctgagggtagtaatttctctcatctttgtatgaaaatgtctatttcatttttattcttacaaaataattaatgaatataggattgagactgacaataattttcccttagctctcaagttttaattgcatagttactaatgaaaagtttattgttggtttagttgtcattattttgtacaaatctctcttttgcctcaagtggttttaagagttcatccttggtgttctgcattttcatcagcagctgtcctggagtatgtttagtttagttattccaagttatccacctccttggtggattttcctcaagactcatgtctttcctcaattcagggacaggctcgtcacactctgattaaacacggcttgtttcctgtgtgtgtttttaaattttatgtattttcattgtggaatttctattagacccattctgttctctttaattttttttctctgatttttccattatctcttatgttctcagaagtcctaattcttgtttctcttgtctgctgatgcttgcgtacaacggctttttgcattgtgtggcttgtaattttgatttggggctcatctttaatatttttattactttttcttccatgagggcatctcatgttatctgggttatagaaatattcctacagaactattttgggttggcttatgtctgggcccatgggagtttcactgatgtgggaccagttttgaggtcaatatcttgactgggaattccattcctacgctggtattaaaaatttggacacaggcccagactattcccaacatccacacatgagactaactggggtttcaatgtcttcattttttatgaagtcttttttcaatccaagacacctggcaaacaattcttcctcccagcccccatccctggattggaagagttctttttgtctctttttcacagaggaaagcagctctcctggggatctggcttttgtgggattctcagttgcaggcggttacttctctttttccaaacccaagcaccaggccctctttctgggtcttgaatagccctttgggtctttgaatagtcctttggggagccccaactcaccagccagtgctcaggaataacatcccctctttgtttctgcctcttggggattttgctgactctcttttgagcttgaccaggcattagcaaaaattcttaaatgtttatattttatcctggatttccatgtgttttctttgggctgggagagctacagcagctcattccaccaagttcctggaaggctgcaggtatcagcttgcaagtgccaagtgtcaaacaagtgataaagaaaagtgttggtgtcatgcagagaagggaggaatcactgcagacagtaatggctacttgacaaccttcagtgataagggagaagcataaagcctgcctcaagctcatcctttttaaaatacccacagctctttaaaacaagtaaccttcctccttcccagagggcagtgactctgtcctattctctctgaatccccatattcacatgtgggacagatcatggagagtacacagtaaacatttgttaaagcaacaaatgaagtgagcattttgtccaggacacagctaaaagttcaaataccagaaacactgcctgagaggggataaatgtcatgttacagtaacacccacgatatagaatcgtatccacattgtggatacattcagaataggttaagcagaatcagttttcttttaaagttctttaaggcacctcagagtttaatgtagccaagttcagttcaggcaaggctgccttccaagccatctctaactggctaggttttctaaaaaggatttgcccaaatgaggatccatagtccttggaaggtggtttcaaggttcagctctgccataaagccattccctcaggggctgtctgtgcacatacctggccaaggctgctgttttggatttataatagaacgcctaccactaagggacacaccagcgcttcttgggggggcctaagttaagaatctgggcatgtgattttgctccgaataaaatggctacaaaggttaagcacagatccagtggtgtaagattatggtgatcccaacgtgccagaattaccgtgtaatttcgagcgagggagacatcagtaccgtcttgcagatagtgggtttccgtgaaactgctggcaatgagacctctgcggaaaaacaaaaacaccataaaaagatgagtgcagaattgcattgatacattgttgtgaatgtctaggctatagggtagcaagattgtgacctcctttttttttttttaacagataatccaaggaagctcccattagggccttcccagtttaggttctccggggagaattcagaggagactcagacaacagagtcagatatgcatcctcggaacaatagcccacacactcaatgtggaaccctccctctctcccttcctcccacctcattccttcatgcgcacactgggtgcacacacttgcaaaggcacacatttgtcacacacatatactcttccatgaatagtacaggcagatttccaatttgggaaaatctcctgcttggaagtcacagtctccaccaactggaatcaatggttgaaccacctgctgggaaaatcattctgatccacagcagtgcccctgctggctcccccgcaggtgagagaaccggctgaaaatattgaaatgtcacagaagagaatagaacagcaatgaaatgctaaaagcagcaatgtatgtatgaggtgaggaaaaatgattttgcacatcctgaaatattgaatttctaagataaattgaaagggggaggaaaccccgtttatgctattaataaaactgtatgcagtctaccagaacttcattaaagattgcaaagcatgggttacttagattttaaattattttccaatgtcttacataacatgcactattttatcctgttcaacacaaccacaggaagtatttcctgtgtaactaccgctgccaggtgctagctgctgggatacaaagacaaataggaacagcccccatcttgatgacaccacgagctggtagggtgatggttgacacagaatccagtgtgaagggagcgatcacagagtagaaacagagtccttctgaggcaggagagtaaggtctggaggcagggaacaaaggtcgattcatgctgactttctagaactaagtcaaacggaaacacttcagctatgacaggaaatatcctctccatttacatagggcgtacagcgattaaatgactttgtaactttacctcatccccttcatttacatagggcgcacacgaagtaaccaatggaaacctctagagggtatttaaatcccagaaaattctgtaacggggatcttgagcacctatgcttgggccccctcacaccctgaggagcgtaatttcattttcaataaatctctgcttctgttgcttcattctttccttgttttgtttgtgcattttgtccaattctttgttcaaaacaccaagaacctggacatcctccagcagtaacacttctgggtgcgtggatgtgctttgggtggagcatcctgcaagggaaaggctttgcgtagggatccgacaactactgggccctaacgatggagcaggagtcggccaggcccaggacagggtggaaggagaggggaaatcctggcagataatgtcaaggtcagggcctgaaaggcctggagtctggggagctgggctggtggaagacagagaaaggctctaaacagaacctgggttttctgtgtctggacaacagggagtcaagagttgctttaaatactgaactttgtggatggtgaaggtgctgcctgccctttcctgtcttcagaggaagacactctccactcttcacaccgtttggttttgtgtgtgtgtgtgtgggggggtgctcctccactcttgatccagagatgaacatgtgacccaagctaagcccatcacaaatcttccctacagcatgttgagctgggatgtctggggatgacgtctttcttctctgttctcaaggctctgagaatgtggccaccacctccatcctggtcccttacttcaggagaaagctagtcagagagaacaaagctgtcaccctcaggcagggacaaaaggcagggagagggagatggacctgttgcccatggggcctgctccgcctctcctcctcctcataagtccctctcttctgcctacgctggctggagctgggttttgcaaccagagtcctgatcagtatggcagggaaggaaaagcagcgggaatatgcaaatgtcagagatgagaagcacttccttacacagtcagagttcttagacctgctcccagccaagttcagaactgagagtcagctccttgttttacatggattgcaatatgttgaggatatgcctggcttaaatcagttagaccccgatggcaggtctccgctgcagtctacttaacagcgagtgtttgagagagtgtgcggaaaacataaaacacagacgggccctcacactcactggcaaaggcacgtgggcctcccaagtgctgcccctcactctcctcagcagtgcacatgtcgtgccagagaaagttgccctccttggcagcgttgagctctgaaacccctgtcttctaagctcacctcctctgagctgccagaggggctgcctgggcaggctcattcacagggcaccctggccctgtcacgcagtcatgagcaaaggagaggaagaggggaaggagagcaggcaaggcagtgggaaggtgacagggccctgaagagaagagtgtgaagaaggggtagtccttagtcataggtagagagctccaggatggtggaggagtctggtgaccttgacaatggagatgcagcaggtgagcccaggtcaaggtgacaggcgaggtgaacgaatgttccacagcacagttccaaagggaagcagagaggcgggatgtgaaaaccagagacggggacttgaggggaataactggagggatggggctgagaggggacatgggtgaagctgcagaggaacaggcagaaggatgcagagcacagagggatacacacaacacaggacatatctgcagagcacggggtaatgcacacagcacgggagaaagcacagagcacagggagagaatgcacagagcaccgggagaggaggcacagagcacagggggaggcacagagcatggaggggaggatgcacagagcatgagggatgcacagagcatgggaagatgcacagagcatggggagaggatgcacagagcacggagagaggatgcacagagcacggggaggatgcacagagcacggggagagaatgcacagagcatggggagaggatgcacagagcacggagagaggatgcacagagcacggggaggatgcacagagcacggggaggatgcacagagcatggggcagggatgcacagagccgggggtggggatgcagagagcagaggcggggaggatgcagagagcatggggcggggatgcacagagcatgggttgggggatgcacagagcacggggagaggatgcacagagcacagggagaggatgcacagagcatggtggggaggattcggagagcatgggggtggggatgcacagagcacgggtgggaggatgagcagagcatggagtggggatgcacacagcacggtggggaggatgcgcagagcacggggagtagatgcacagagcacggtggggagggtgcgcagagcatggggagaggatgcacagagcatggtggggaggatgcacagagcatggaggggggatgcacagagcatggaagatgcagctaaggatgcacacagcctattctctactgagccagaacccatagtggcctcaatagtcttaaaaaagagcacacggctgggcacagtggctcacgcctgtaatcccagcactttgggaggccaaggcgggcagatcacgaggtcaggagatcgagaccattctggctaatacggtgaaaccccgtctctactaaaaatacaaaaaaattagccgggcacggtggtgggtgcctgtggtcccaactactcaggaggctgaggcaggagaatggcgtgaacctgggaggcagagcttgcagtgagccgagatcatgccactgcactccagcctgggcaacagagcgagactccatcaaaaaaaaaaaaaaaaaaaaaaaaggagcacacttgaccagcttaaatattacagagaaaggaaaggaagaatttaatgtagattaagttatattaattattacatatattatttactatgtacttgtacttctatcacatcctttattaatattttagcaattcaggtcttaacaatgttgaaatcttatttgaatgaacaaggtatatagatacctaatattaaggggagtgatgggtgcagacatttgtagaacaaagatacatcattcgaaggcttctgaccaggcttaactgaaagctggtttggacagatggccaaggagaaaagtcattttacgtatgagggagagaaaagtccatcaggaaagctggggattagagaaaacgagcttttgatagacaactgtcagcaaactggaggacagagtaattttagggttaaacagcagtaaaattaattagaaggttttgaaatgtgactcagaacagcaatacaaagccctaaaactacccactgctcctcatcatcatccaagtgtcattggagctaagcagaaatacaaccacagtcatgcttggagctctggagagttcttaagcactgtgttatgtcttctcttgtctaaggagagtggaacaggggcttgtgcttacagccctgaccatgtcccactgctgctgaggcactaaatgatatgttccttttcgagtttttcttatgcagtctggaaaagaaatgttgatttacagataagatgcagtcataccacttgtgtacattgtatcttctcaagatattttgaagacaagagaggggaaggggaaggggaagacaggaacaggaggaaagccagcaaaaattcatgctcagcatacaacagagtcttgcaaaatgcaggcggtgaatgttacgtgcgctcaccacaaaaatggtaactgggaggtaatacatttgtttattagctagattcaactatctccttcaaaacaacatggtgtgcccaacaaaaacacgcaatgatatgtccatttaaatagctaaatacctaaataaataccaactcccccctctccaaaaaaaagccccaaactgaagatgggctttctgttgatcagccccagtgctatgagctggaaaaacaggcagcttccttggttttctttcaggggtttgaatgagagatggagagaagcaatatgacctgatatcggaactccttcccagctctcccttccaggaatctgtgcttctgcagccaagactccaggtgtcatgcgctccacacccttgggaatgaacccaccatgcagggctttgtgtgcccctgctccctgctctgacttcctcaggtcctgcttggagatcatgctgctgtccctgctaaaactctttagtgtcttcttgttggccctggggtgaaatcccaacgcctcccgatggcctccgaggtgcttgcaacctcatgctgcccaccctgccaccacactgtgctcacttttccctctagctcatgctactctagccaacactggcctctggttggttctagaacattccagatcctctccctctgagggccattgcacctgctgtgcccgtgtctggaacattctttacatggcttttcatgtagccagcaccttttcatccttctgctcttggtttcagtgttgtctctccagagggtcctttcctgatctcttatctaaagcagccccatcaccactattagcccccatcgcagtcctcctttggttttctgcctggtattcctattttgtttatgcgtctccttacttatttatctctaccttcaagaatgtgagccacaggagggctccttggtcatcgctgtattccctcacttccagccctgcagagagcctgcacctcctcctggctgtaagcattaatagctgctaaacacaccctggtccaggtactgtgctgagcccctgatatctcatttaatccatatattatctggcccatggatattatttttttaatccctatttaaaagaggaaaccaagacacagcagggtcaaatgacctgcccaaggtcatgccatccatgacagtgtccgggtggttttgctttagaatttgtgctcttaaccactgtgtggcgctaccagaccttacaggatggtcaagcaatattgacggagtgtttgctgcaggtgctgtgctaagtgctgaatacattacatgttgagcagatgaatacgtgaaagaataagtgaatttgaggagcatgcggcaggcactgccccttttgcttcgggctttctgctccttcctgggtgatacacgtcccacatctttctccagcaccatgacttgccagggagcatggatgaaactgagaaggcgctggatggaggttttctaagatgtgtgcctaatttaaaaggggccgggagtcaaagtcccctggagagaactaaggggggtggatggacaatggcagtattggaaatgtgacagcaatggccttggagcctgcagatttccccaaagagaaaatccaattagatggactatcttacgtcagcaaatgaaaacagaaggtgaatgcataatttcatgagaacattctttttctctgcttattagattaggcgatctaacaaggcactctgcttctctcaataccaggaagtaaaatgcattttaactgtgccaggagttgattttgctatttgccgtttgttgtgggatgacacgtgacacctaaatattctctcatttaaacaatatctagcatgctgcacaatgggaataagatgctccaggaggccccactgctgaaggacacagacccagagtggtcagggctccatgacagggacacgcccaaagcactgctggagccccaggaaaggcttccaacccagaagtcagcctggggagggggtgcccaagggagccgggaaagatggggaagaatgagctgcgctggtggggaaaaggtgaggagaggaatgggaaatggggaggagagcattccagcgagaggggactgcatcctcaaaggcatgggggtgcagaaacagcatgctagcgggcaacgcgcagaggggaggggaaatgacacggatgccaggtggtcagggcgcagggcctgaggcagggagacccgctgctgctgagacaggcaggctggggacagaacctacatgctgcccaatgctgctgactttatcctgtgccatgcagagccgccaaacacggaagggacctgagcagacacaagcttcagagccacaggtggttctgacagccacacagatgagacttggaggggaaagagaaaaatacaggctccaggaaggttagcaaggaggctggtgtgagcgtccatacagagcaccaggccaggacacaactggatgggaaattcaggggggcccagaatcaggaactgcgtaacagactgaggactcttgcgtgatgtcaacagagatgggtcactcataaaggagagaagagacatgagttcagtcttagccatggatgtagtttagatacttgtccccactcaaatctcacattgaattgtaatccccaaagctggaggtggggtctggtaggaggtgtttggattgtgggggcggatccttgatggcttggtgctgtcttcgtaagaatgagtttttgcaagatctggtcaattaaaagcatgtggcacctcctcctcccaccccttcctctcactttctcccgctttcatcatacgaggtacatgtttccactgcaccttccaccatgactgcaagctttctgaggcttccccagaagctgagcagatgccgatgctatgcttcctgtaaagcctgcagaaccgtgagccaatgaaaccttttttctttgtaaattaccaagtctcaggtatttcttcatagcaacgcaagaatgtcctaatccagccatgctcagtgctgagagctgttctctttcttggacacgtcatgggagcaggtgactcctacggtttggagacacatggtgtccaccctcatttagagaggacaagtagactcccatcctttttggccgagtactgtattttctgatttcaaaatctttggacatactggctgaaaacgagtatttagaatttgcatgaaaatattaccatgtaggtaaagttcttcctgataaaatgtcctgcatttctgaaatgatttgagtattgactcaaaacatgaatgacctccaaattgctttcagatcaatattgaaattatccaactttaactttacccttatataatttagttacacagtttgaatgagatggatttcattaagataacatatgttacactccaaagcatgggagagctgaaagaaaccccccggccccagaagtgaatcagcctttctcttgtgttctgccaggattctgtaacaagactttccctattcggccttatttcttgtttacttgtcttcctcccacactgggttgagctaaaaagcagaaacaacacctctaaacctagcacaatgcctagcatagaagaagtgcttcataaataaacgaatgagaaactgaatcattatcatagaaacgcaacccaatctggatagaatgtgtcagaactagttggatcaattaaaaataaaagaaatatgcttcaaattgcttacactgatcatacagggggtatggggtggggacaatctcattcattccttcattatttcaagaattctgaatgttctccggtcatccagttcaatgctgacaacatgttatcaatttcaaactgcttaaatgagggaaacagggaaagaaaagtaagagattggcatcaattacttagaatatgaaaaaactcattgatgacatgtcaactttttcctattatttctttgaagaccatacgtattgttggagggtttaattattctgtacagcatattcatgccatgccaaagtgtcacaagacagttcttgtttgtcaattaacaccagcaggcagtatagatactctttgcaattaaatcatgccaggcaatgtaggcttcagtgatttcttcttcctggtggatccatttggtattcgaacaaagcatccaaccgagttttttgctgaagatttactttatcatgtcatcattccacaaattacaaaatcattcatatgtaaatttgggtaatggatttcttttattagaatgtggaaatacagctacaaatactttcatatgtgggactaagggccaagagctttaacaaaacatagcaccgaataaagatcataattaaaaatcatgatcaggattttccaagttactaaaatgatatcctttaatgaaaactgtccattccacaatcacaggtaaataaatatagagaaaagatctggaaggcaaacggtatgcacccagaccggaccctgcatcctctgaaaacactcactctggttttcagcagaaactctagactagctggaatcatgaagatcttcatgctgctatcattggcttttctggactattttatgaaaagatcagacagttgaaagattctctgtaaaaccagtatactgaggtataaaataagaggagaaaaatgaaaaagaagtatcgaagacatctggtatttctcacatctcaactttgctcaaacttctttcagaaccttgtctttgcaaatatttatgcttcttttttatggcacaagttatcacagcctggtaaagaactcatggtctgggttctcatcttaaagaatgaaagcaaagcatcgcggccaccaccctcaatgccttgccctcatcatcttgccatcttcctcctgcccctgttcattgtttgctcacagggtgtcaggccttggggcattcacttttttttttgagactgagtctctctctgtcacccaggctggagtgcagtggtgcgatcccggctcactgcgacatctacctcccaagctcaggcaattctcctgcctcagcctcctgagtagctgggattacaggcacacaccattacgcctggttaattttccgtagttttagtacagatggggtttcgccatgttggccagactggtcttgaactcctgacacctatctcagcctcccaaagtgctgggattacaggcgtgagccacggtgcccagccgggggcattcgcttttgatacgcacttccttactttatcttgaaagagactctgcagggtaaggactgtaattgcctgcttgataaggaagaggaagcactcagagaggttaagtgacttgtccaaagccacacagctgagccctggagactaaacttgactctatttagctccaaagaccacctgttcctaaccactggtggacactgccttcccaggaagcagcatcagcatatggttctgacggtctgaaaaataagcagcaacaaaccaaattccgtatttttctgaaatattttttcctccatgttggaagagacacttgaaaacggtgctacgctatttctcttcacacgcaattcaattttgttacaaaatccaaattatttttggatataatttcagtattttgggatcctaactatttaaactgtacatctgtaagaacaatggagcacgtacattccatttttcttttgttattctccatttactaaaagattcaaaatgatcaaaacaacttttgttttcccctggaataaaaaaagcttcctttgcccagctctttctcatttagtttcacaaactatattaaataaaactgctgatacagcattttggaagctgtaggggacaacaaagtttcctgcaaaataacttcttaatatactgcttcactataagtcacaaatacacagaattttgggtccaatcatgtgacacactgagacatgctgttatgattgtcttttgggactgttcagatgagcctatctgttcatgagcgaagagttcacagacagccttttggactgctgcagactcagtggaggtctctataagaacaggagggctgacttgtccactggctgaaatgtatgagcaggtggaaactgatgggtttccacctttgcagctctccagctggcatgagactcagtcttaaggctttgggctgttttctcccctttcaaatgactagatacagtttgcaagtcttggatgaggacttacataccatttcaggcaggtttctttttttttgttttttgttttttttgagacggagtctcgttttatcaccaggctggagtgcagtggcgcgagatctcggctcactgcaacctccacctcccggtttaagtgattctcctgccccagcctcccgcgtagctgagactacaggcatgtgccaccacacccaggtaatttttgtatttttagtagagatggggtttcaccatattggccaggatggtctccatctcttgaccttgtgatccgcccgcctcgacctcccaaaggcatgagccatcatgcccggcctcaggctgtttttaatgtgtcatgattgccttcctagtataagatctatcaagtttcagtagcacaattttaagaacaaaaaaatagggcctcagatacaggggaaaagttgtaaacctgataaacgattacttccactgacagtaaagccccacgcccacttctctcagaatgaatcgcaagggtagatttagtaggtcagcttacgttgcattcttcaaacgtttctaccaacacaggtaaaacagtcatttctcttaaacttcaaaattttccttcttcctttcagaaaacaagagttggctgtaacagtagcaacagcatcagtcactaagtagcatcagtcactaacgttcatttgagctcctcctaagcaaaggcactttacgtgtatttttaaatttaacttttacaacaattttggcaggtaggtacttatttgtatatgagacactggaggcaaagagaggttaggcaactttgccggggtcacacagctggcactgtgtaggcattttgacttcagagctcttattgctatacttatacaacttctatttccccttaatctgacttttgccttttctgcccatattcctttaaagggacaactatacttaatgtagcaatctctgtctttgaaagaaattataaagaatttggagtgagttgggtgaatctatttcccacttattgccatgggtcaaaactgaaaggaacaacgaggaactgcataaatcaggattctgtttgcctctagtgtggagaataatcaccttagtcattttatgtgtatcagttcatactattccatgcgtaaaggtgcatgaaatattcaataatgcgagtgaacgatcaaactcatttatatttattcattagtgccacataccacccgcaaatagtctatagactagaagcaaagtgaacctcgaattcattttctaattgcccttcttgccctggactgcaagtggtatttattagccactgctcattaagcatccacatggtctatgatgtgggaggacacgtgacaactggtgagtctttaaatctttataatgacactatgagttggtatatggccattttatagatataggaattgaggctcagaagtgttaagaaatgtgttcaaggccacacactcttacagcggcaatgggcttgggttgtcacatgctaacatatcttacacccagcccttggtcacatgcatgttggataggaaagcatacctttctcccttcctgtcccagaaaattcttggttgattattttaaggaatgtatttacctaactgattaactgaacctcatgtacaaaaatattcaagtggagagaggtgccttttcagctgggctaactgatggggtctttcttactcacttctgaggccagttcctggatccgaaagactttcagtcagtatctgcagaatgtttgggctgatacatttctcagtaataaaatgtggacaagaagaccaaactaccttcaaaatatatctctagcagtagtatagcaacagtggaagaacaaatctcattctgccattttcttcttttatgactttgaatatgaaatccgacctcatgctggagtttcctcatataaaatgagaatgatagtgcctgcctcacagggacactatatgggaagttaatatatgctatagatgataaacatgccgaacccatattatgtactcagcaaatggaagcaattattattattaataagtccgctggcttccattcgtctcacctaccatttctccggtcccagccaccatttcccctcacctaaccttccataatagattagccagactcctgttttcactcttgaaacatttaggtctgtttttcatacaccagccagtgtgaagtttttaaaacgaaaacggatcatgtcacttctccacttaaaacactgcactgctccttacagaacccagagcagaattctaattccttagcgcacggccaggcgcggtggctcacacgggaatcctagcactttgggaggctgaggcgggcggatcacttgaggtcaggagttcgagaccagcctggccaacatggtgaaactccatctctactaacaatacaaaaattagccgggtatggtggcacgtgcctgtaatcccagctactcaggaagctgaggcaggagatttgtgtgaatccgagaggcagagattgtagtgagccgagatcgcaccagtgcactccagcctgggccacagagtgggactccgtctcgaaaaaaaacccaaaaagcaaaaaacacattccttagtgtggaccaggcccaccccctctacctgctcaattcatcccacttaggctctgtggcctccctttggtttcccaagtccaccacccttcttatcttggtctggaacattcttcccactttctctgcctcgccaactcttagtaacccccatccaaaatgacagtatctgcagcaatcttccctgcctgccccttcctaaatgcggttctccttgttcgctgctctcgcaaggttctgccctgttccttgagcacatagtgccatttctcatttatttgctctgtcatttgaggtatgtttcccccattagggcagagtctgtctgggtccctccccagcccttacattaatgtctggaacttagtagatgctcaataaacacttgtagaatgaatggaataactgagaatgagaaaaatatggcaaaagcactcatacataatagaatcattattgacttgctgctattttaggatatgaggacttctttctactctaaaaaaaataaaataaaataaaaccaccaacaccacccaatcccacaaaacactgactggtaaaagacacgttgatccttagaagttctaccacctaaaatatatctgttttttagttcataaggtagaatagaaaatatactttacaagatacatcttcaaatggcatttccttaacttccagaattaaaaaaaagttcagccgacttatttggaaccattgaaccaaatacctttgactccttggacacacagctttacactttaaaaataaaatgacctggtgtatgcgtgtcccctcctcacaccagctggtatctcagagtcttctgatgtagattggcatcttccgcctagcccaaagcagggggtcctgcaagatatcggggctgatgaccttgtaagtggtttcacagaaagctggatgcatttcagcctgtttcctttacccacccagctcggtgaagaacttgtattaattggtgctttgaggcagaaggggattttcttggccgtggcggaagccagccagccagccagctccctggcagacttgcagactggccagctgagctctcttaaaaattgacctacattgaaccaaacccgtagaatgtgtgttagatcaaatttgctcctctctgcttgctcagagagggtcatgctctgcaaatttccataccatcgtggccaggagacagacaccagcagggatccggggcggcgaagaggaccttcactttctgaagtgttctaaattggcccacggagcagttcaattcctcttgctgaggctaccatgaaatgtgcctggattttgaaatggatgtgtttttcctttaaaaaaaaaaagagggcggggggggagtccctgtgtgtgaacccaggtgtacagaggcataatcagttaaagcacaccctcttttctgcgaaggcccactgagtttgcctgctccaatcccctaggctgagtcaggaggatccaaaaaaagccatgggttgtgccagccccatgcagacaccactgcctgcaacagagctgttagaaaagcaccgtgtctgggacaaggaaggattgtaaaatataaaattgtaaaataaaaccattaatcccatctgaattctcgctgttgggttctttatatgaagtagtcttctgttttctttgttttaaagaaactacaacaagaagtacttgtaatacccatgctgaatatttctgtttcccagtaacgattctccaagtgcttagttgatttactatctgatcagcaactgggcttcaaaaaacaaaacaaaacaatacaaaactgggagcattttacattaagatctaatgctgtcgagaaccctagagaagaaccaaaggacagatgtcagtgacagtgggccattcattgatggatttctctccaggataaaggccacaccaatcaatattcttacagctgggcctttgaactatttgcttcctccatatggactctccaagggtaaattgacattttccccagtgccttaatttcttattcaattccagcctcctaggttacaaaagagtttggctaattctaacagctaattttccataagcgcttaaatagtttagtcagaatgatggttgggaatattttaggcggctttcattatgcttcggctaggcagggtaattcttatgaattaccttgttgatttaattaagtaatgcaatacacgacaaaatattaccctgggtcatgaaaaatagagatctttaataagcatcatggtctcaaattgtaaaattacttaaaaaaccgtggcaggggtggttagttggttcatatttgattgaagcagtaattcattacatttatgaaatctttagagttcatttgctgtccaggcattctaacgtattacttacttggattgcatttttaaaaagctgctggcattaggcaacaagcaatcttacagcactaggctagagttagcaccttttccttgtggcttgttcaccgctaagtctccacggtgtcttgcgtatgggacaaaaccagatacctactcaatgcacccatcccaaaacatgacttcacttctctggatgggctttggccagaaaaagatgaacatgcttccagtatttctggcttcccagtcgtggatctgttactcagatgacactgttgtggtttctttagaaaaggaaaacagaagaatacttcctgtaaaaggacccagcaagtagaattcagatgggatttatggtttcattttcacacaacaatcttgcacgcaaagttgggaattaggatgacatcatgtgtgctgctaaactcatattctagaaacatgctccagaaaggagttcttcattagaagctgaaagctttccatgtgtctggggaaaaaaatagctaatacgttgaggaggagggaggcccaatttaatgactaaaagatgtaatttataatgatcagcctcagtaatccctcctaaaagtttcattttaaaaaatactattatgatctccaaacttactgaattaatcaacacttcttggggtcagaaaacaattatgtattaagtgcactcctgtacactcaaagactgaggcaatggatccaaccagaaagtagataaaatgtggagttactgttctttatctttcccataaaggctgagatttccaaaattaaacaatcacatttcagttctcaatgggtcagagcattgtttgacctggaacttcagactctggttattagagggtcctgaggaatcattactaattttcttgggtgtaacaatggcacggtgtgttattttaaaatttacaagaaaaaaacaaccccatcaaaaagtgggcgaaggatatgaacagatatttctcaaaagaagacatttatgttgccaacaaacatacaaaaaaaagctcatcatcactgatcattagagaaatgcaaatcaaaaccatgatgagataccatctcatgccagttagaatggcaatcattaaaaagtcaggaaacaacagatgctggagaggatgtggagaaataggaatgcttttacactgttggtgggagtgtaaattagttcaaccattgtagaagaaaagtgtggcgattcctcaaggatctagaaccagaaatgccatttgacccagcaatcccattactgggtatatacccaaaggattataaatcattctactataaagacacatgcacacgtatgtttactgcagcattgttcacaatagcaaagacttggaaccaacccaaatgcccatcaatgatagactggataaagaaaatgtggcacatatacaccatggaatactatgcagccataaaaaaggttgagctcatgtcctttgtggggacatggatgaagctagaaaccatcattcttagcaaactaacacaagaacagaaaacccacaccacatgttctcactcataagtgggagttgaacaatgagaacacatggacatagggaggtgaacatcacacactggggcctgtcacagggtgggaggctaggggagggatagcattaggataaatacctaatgtagatgatgagttgatgggtgcagcaaaccaccatggcacgtgtatacctatgtaacgaacctgcacgttctgcacatgtaccccagaacttaaagtataataataataaaaacacaaattgaagtgttaagaggagcaatggcatgaagtctgtttgaggtgacctcagaaaggggagaaccacagaaacagcaaacgcggcgaatcttaacaccggctgaatctgggcttctcaacctcagctcagctgacaatcggtgcagatgattctgtgctggggggctgtcctgtgtaatggagggtgtttagcaatatccctggcctccacccccaagatgccggtaactctctcccaaccaaaactgtccccagacacagccaactgtcctctgtggggcaaaatcaccctcagttgagaactgctggtatgtaggagggattaatatactatttcctcttcttttgaatatagattttttttttaagtttcagagcgcaagttttaaagtcaatggaggaacaaaagtgtgaaaaatcacaatgctaattcagtctcttttgtggtttggaaaatcttcctgaggagtatagcagagtctgcctggggccccgagaccagaggccccaactccagagaatttctcaggccggtctgggaccttggtgtcagaaaccacctcaggccaagggagtcagcatcgcaggggtctgggggctaggaatgggcatttttttttaaagagcattaatatttggaaataatttcaaacttacagaaaaattgcaaaaataaaaatcatacaaacaacatatatatgcctatacaccttttatccagattcatctgttgttgattttttttttttttttttttttttttttgagatagagtctcactctgtcaccaggctggagtgatcttggctcactgcaacctcccgcctcccggtttcaagccattctcctgcctcagcctcctgagtagctgggacgatattttattccatttgctttatacgttgttcccctcctcccccttccccccactgcccacctcccaatctttacaaacacacagagtgtttttgctaaaccatctgaggataagtgatatacaccatggccctttcccaccaaatacttcattgcatatttcctataagcagatattctcctacgcatcatggcccggctatccaagtcggcaaatgtcacatccaggcagttcctcgcttctcagccacactcaaggctgtccctgacccagctgtgagctttgcggcatgtctttcctcctcccaggccgagttcagggccggggcttgcattagggtgtcgtgtccattttccctatatttttattaacaactttaagacactattcccgtaccagacaactggcacactgaagatgtacaattgcatgttttttaccctattcagggtggtgccaccatctaccacaagatgattttaggatattccatctccccgtgccctttaccctatactcactacccttagtctcttggaatgagacatttccactgcttttatctcctatgataatgacatatttgaggaccacagtcctcaccccccctttttttttttttgagactgagtctcactctgtcacccaggctggagtgcagtggcttgatctcggctcactgcaagctccgccttccgggttcacgccattctcctgcctcagcctcccgagtagctgggactacaggcacctgccaccacgcccggctaattttttgtttgcatttttagtagggacggggtttcactgtgttagccaggatggtctcgatctcctgacctcgtgatccgtccacctcggcctcccaaagtgctgggattacaggcatgagccaccgcgcccggccacccatttttattaaaacaattttgagtttgtctgctatttccttgggaccaccttcagagccagaatcctgcgagaagagccagaaacaatggcttcacaaggacctgcagccaagctgaacagcacagcacacacgaggaggtggtgtatttacaaataagcgaagaacgctgccgagagaaacacacagcaccggaagaccagtgtgcgtggaggccactgggccacacagccaggtgccaggagttgcaactcacctccacaatggcctgcctgctggcggggcaaccttacaaaatattattattatttactcataacaataacaattgctcggaaaataaaactcaaaacaggcaaaaccattggaacaccaagacgagacttctacaggttttattttaaacatatgtttctaaaacagtcagtggtgagtgccaaaaaacacagcatcaagtcgattttcctttttctgtgtacatgacttgctttggaaactgcctatacatgccctacatttttttctctcatcaaaaacaatcgaggaatggtacaaggagttctgaagcataacctagtcgtttcattcgagtggcgagagagggacgtgatgtgatgtgggtgccacgtaagtgtcgtgctgggggcagttgggaaagagtctgctcgttccatcggaatgcccagaagagcaggggcttccactgcactttgcaaaacaagcccagccggtggctgccctgcaagctgctcttggaaggaggggaaaggctctcccttaccactctggacttccctgggggttcaagcctcatgcaagagagcccagtcagcatttaagccccagaggcaggtgtgatctgctgttcccctcttttggaaatatgggtctcgtaaggtctctccctgaagctgtgtgatggaaatcaacattgtgtgtgtgctagctcagcataaagaaaggctgcctcgccctcaccctgcacaccacagagaaagatctgttccaagagagtcaggtcactgcgatcctcagggggtcagagaaccaggaggctaataaaacaaaagagatcaggcactgagttccgggaagttactgagcacacataacaactgcagaacgatcccaagtaaagaatattctcagggactctgatggaaaacataccatgaattaacatgcgttcaaggccttctctggtcctgcggcctttggctcaaagagctcacagctcaccaagagggtaaacactgctctcggccaaggccatgattcaaaatgctggctttgggatccttcagggtgggatgcgttatcatgaggcctcctagggtattcatttataggtgatatgaaatagagtttaccgtcattttaaataaagacactaggtgaaatttaagacacatttcgaggagaggaaatataaaaccagaaatggcaagacattgccattgcaagaactctgaatcactcatctagggcatagtctatcttgtgctcagaatacgtaaatagttaaatcaagtacatcccatattatttgtatttcacagagtaatacaattcttttgtttcagtggcataggaagcaacagtgtaactaaaatatgatactcttttagcctaaaaataatgaccttaaaaaataaattcaaataaaaacttaattcctaacggctctgaacaaaatctctcattgtctcccaaagcgtggagacgtgtgtggttaaatgtcaggtgactcttccacgtgatgtctggggactgcaggagcttccctctaagggtttactgccgaagcctgagagagagaaaaagcatggagagaaattggcaactgggactcctgaactttcagaaaagggctcccttcatttgaaaaagagctgccctgtttgtatacagccatagtgaatctgtcattgggtcacctttttaagcaggagtgtgccaaagtgtatgtgtgtgtgcacatgtgcacacacacacacacgcacacacacacggtttcctggtcataatacacttggtattattcatttatggctgtacatggctgcaggtgtgctataggaaatgcttattagagccttttatgaaaggagaggccaggttgtcaagaaaagactaagaaaaatggacaattactttaccaggaggaaaatagaagataacattagattgtaaatggaaaaaaaaaaagcaatgagatgagaaacaggagatttgatgccagtgagatgtgaaacactgataattacagaataatgatgacggccaccgtttatggaacccctatgtgtcatgctaatatttaataagcactctctcatttagtacttaaaaagacttagaaggtctcatgaatctgaccattttgtggaacagacaactaagacacaaagagattacatagcttaagaccacacagctaataaattagagataccagactgggacctaaatcagtctgactccagaatcagtttcaaggtttcctactgaagatttgtgacgatgataggaatagattttgttttgcttggttttggttatttaaaagacaaaagtaaacaacattttggtttaagaatgtgggaagaaagcccagggaagaatgcggatacaaatcggcaaatgaacaacaacaaaaaaatgaatccaatgcagtgaattcaagataaagttaaataatacaatcaagagttgcccctgctttcttacattgcaacaaagaatgggaattaactgcggctgaagtccttcttcactatcaggcttttggccaaaaagaaaggaaggctttgcatttgaatggaggtagctggagcgagcaacgtgtcactcaagcctctggcatctttgttcagcttcattagggaagaatctccatgcgctcatttaacttagtttattaacctcaattctgaataaaatgttagtctctaactcaattttggaattttttaaaacagtaaccgggaaagttttgtgttttatttatgtgattgttgatgtgaaaatggctgtgtcaatatcttagcatctacattagacaaagtcaatcatcacagtcatttaaaaactcccttctatataaatgggaactattctcttatgtagagaataaacatggtctcaaacagtcaaaaaaaaaaatccccatattgtagttacaaagcttcttaccagaggaatttggtttgtgacacatgtgttcttcaagtcacattttttataaagagaattttgcaccttaaactcaaattaataaaacaggtaggaaaatcgagaaatacttatatttcctttttggcttaccttagtcctcattggaggacatcttttttttttttttttttttttttggataaacatctttcagatagttttataagtagcaattgaaacattacacaaattgtcaaactctctttcatataaaagagcaatatatttctttgtatgcttgtaaaaataattgtttatttcttactctttctttaatgagattgaaagtactagaacacaacagaaacaggcttcagagagaaaaaaaatcaaaggagacaaaaagatgaaaccaaaactcttcacaaaatgctcttggaggtactttgtagaaaagtaaacgagcaaatgtctccattgcatgtgaatgggaaaacataacacacagctgtcaaaatccactcaagcaggccgggcgcagtggctcacgcctgtaatcccagcactttaggaggccgaggtgggtggttcacctgaggtcaggagttcaagaccagcctggccaacgtggtgaaaccccatctctattaaaaatacaaaaattagccaggtgtggtggtgcatgcctataaccccagctactcgagaggctgaggcaggagaattgcttgaacccaggaggcggaggctgcggtgagccaagattgtgccactgcactccagcttgggcaacacagtgagactcttatcttaaaaaaagaaagaaaaaaaaaagaagaaaaagaaaatatccactcaagcactcaagcagtccctatcaacgtgactgtagtttatttcatgaacaaaagcggagtgtgtgggaatctcccatcagctgtgcccaaagttttcgtaaatattggttaagtgaagcgggttagctgctcctcttccccctctgctgtttgctctggcacctctgtagttagcattagagccgctgcaggtaactgtgctttcagtctgtttcaattctggcttcttgtgtttgcaatcaagtcatcccacaggatacaatcaatcggcaccactttctttacacattgggctcaaaatgagctggtctgattggtcagaaccaaatttctatttcttccaccaagagtggtaatggccactctgataaaacaaagtcaattctagagagaaagttcatgcaatttagaactgttttgcccttgtgaagaaaaatgggtcataccttttggatgctaaaaaatgttactcagccacaggtactacctgcctgtcttttgactatgttcaacattatgtaggtgatcttggattaatttgttaattaattcaataaacactgagtgccgataaatgccaggctgggtactggggaaaccaacatgggttagaccatggttcacatactccatggtccttctggtctcgtgtgggtgatcaagaggtaagaaagtataaataaatagttattgatgctggggtagcagttcatgcatggcatgcaaggttgaaagaggaagtagtcggctgtcactaggcaggcagaatagagacgggagtgagagctaaggacggcttcctggatgtggtgaccgcacaccaatgcttctcctaagtcttcttgtttgccttcaaagaaggtctttcccaatttttacaataaaccaatgcaaaaaacccaacgtattcttcaaagaaaactattatttaggctacaaggtccatacaatacccatccatataatattgatacaatacagacaatatcatcagaaataacagtaattatttgggatgatggccatgtcccaggcactgtattaaggagtttttaatcttccaacaaccccaggtactattaatatccaaatttatacatgaagatgaacgcagatcaagaatgtccggaaggtcatccgcttagtaaccagccggattaaggtttgaatccgagctttctgactgcagaggtcaaggtctgagcaacagcaaggaagacctttccgagtattctgcattcaagagctcgagagccaggctctgtgattctggaggggccccccagcaaccgacctcaggagccatgaggttgattcggtactcacgtgtgttcatgtgatctctgtacgtgggtggcatgtaacgtttattgctatgctcatgaaaaagcattgaaatgttaaacgaagacagtacgagaaacctgactgtaaaaggtaagcttgataattccaaaagtatgcatcttttattttttctaaaaaaaagataagccccagtgtctgtctgtctagcacctgtttcacaaggatttaaaaccaagcagcagaagtgccctattttcctcagataaatatttatgaagttttaatttgcttttgcattggaagttatcgatccttttccctcttcaattacaaaaccttatcacgtacaaagaagcttcttagaaaggaagttaatgaacaccaaatttgttattttgttgattttcacttcccaccgtggcactgtgcttctggagagagggccatcgttactgcaattatactaatacactttcattatttaacaatcagccacacacattctagaggaggaagaagtacaagtctgaaggaggaaagttcagatattgcttttagcctgataatttcaacagtcaatgctatttcatggacaatgttatactagctgattaacataaataactaataaagaatctagcagatataaaagcagcttgtgctacatagggatttttttttttttttttgagacacagtctccctctgttgcccaggctggagtgcagtggcatgatcttggctcactgcaacctccgcctcctgggttcaagcaattctcttgcctcagcctcctgagtagctaggactacaggcacataccaccatgctcagctaatttttgtatttttagtagagatggggtttcaccatgttggcgaggctgacctccaactcctgacctcaagtgatccaacaccctcggttttccaaagtgctgggattataggcatgagccatcacgccaagcctacacagggattttgatcatagctttatgaatgcctcaaaataattacaataattatattgatagttttatagttatactgatatatattacatgataccatgtcctactcaatttgtgattattactatttcataagtatagtatctgtgtacatatctgtccacccacccagccatccacacattcagccacccagccactcaagaaacattaattacgagcctgctaagtgtcaggtgccgtcttgggcagtgaaagacaaatgaaacaagcgaatgaaagaacaaccttcagaggaaggagagaggcagaagagaggcatactgtgggattccacctccatttctcagttggttaaaattgcagctttgtgtttgccttcactggcattacaccacttcttctgcaagcaagccagctgttgacagtcagaagatcaggcctttggcagcagtccttctggaccgaccaatagccgcaggagcccctcctggtgtggagggagctgagatccaccgggagattacatgatttctggggtctttaattgcatggcccggtcagcatccattagtctgctgcctacacaatgcctttgtttctcagatggtagcagaggacatccttcagaagacacgtaaagcacatgattagggaaacaaataaaagatggaagttcaccctcacacagcaccggcaacgcagtgcatcccaggaagtaaccactgacgtatggcacgccaggtaacagcggccctgctgccaggtgcccctctgcctggtggctggtgagtttcctttgagatgccttgtcagaattatataccaaaaacatgaacatgtagagggagtatgtggtacaatcagaagtctgatgttgagggccagatatctatcacagcacagcatacttatttgcagtatctaagacataaagacatctaataaaaaacattaagggactaaaaacacatttatagtctcgtacaaatggaatttccttaaccagggaccaagatttgtccagcaaaacaaacaaacaaaaaaaacactcactataaatttttcttctggatgtgttcacttatttaatgaaagtttattaaattcttgatcttttcaaagtatcctttgtagacaaaagacgtaaaagcatgaaaatagcagattctgccttggggaagtttaaaatgtcactggaggtataggacttatcaggcacatgagagagagagagagcctgtgccaggatgtgaagagcccagatttcatgtaagttgctgcggggattcaaagcaaatattgatcatggtggggcagaaataaacatccgtgaggtcagtggaggtgggcttgaggagtgtagcagaaggttttgcgtccctagcgtctcttctacttggatgacccccagtctaattctcgggactatggggatttacataaacataagaagagttaattttcccgcctcctggcacgcaagcgtgcaatccactagaacaggggtcccaaacccccgggccacagaccgatacctgtccgtggcctgttaggaactgggccacacagcaggaggtgagtgaagcttcatctgtatttacagccactcctcattgcttacattactgccagagctccaactcctgtcagatcagaagaagcactagattctcacaagagtttgaaccctaatgtgaactgtgcatgcgagggatctaggttgcatgttccttacgagaacctaaggcctggtgatctgtcactgcttcccatcacccccagatgggaccgtctagttacaggaaaacaagctcagggctcccgctgattctacatattatgagttgtataattatttcattatatattacaacgtaataataatagaaataaagtgcataataaatgtaataagcttgaatcatccccaaaccaccccctcaaccccattccatggaaaaagtgtcttccacaaaactggtccctggtgctagaagggttggggaccactgcactagaacaccacccgtgtgcgagcagggcgtcacattgtaaaacacctcgccccagtcccaggatggctactgcagacaggtgagcttcacctcctgccatgccatttacacaccttcctggaaaagcagaacaggtgaaacagccatctggggcaagtggtgaagtgcaggctttttgaaggcatagctgataagtcaacatgtcgtccgcacttctaaaataaaattcttaattcatataaatgttttttggatgtctcctctgttcccacacattatcctaagtgctttgagtatgacagtaataaagagtcatggcttcatctttccccaaagtacaaccacaggagcctgtgacatcttttctcctagagccacaaaatgggcacccactgatatgtcatgaatggatggaaaagtgagtaaattatagaaggttttgaaatccaaacacggagatgtcaatggcgatttccgtgtaactgcagaagaatctattactgaattctgtgacgaacactaaaaactaagtccacacttaataaatgtttatgtaacacaatgaaatatctaataatcttttcttacattattatgatccttatattttacttgattttcttcaaaaaagtgtgaaatatctaataacgtcataactctgagccaaggaatctggacctagtcctaccaaatgtgtaccagaaccaagactgtgtcccattgaaagcagaaatatttcagccccttccaagaagcactcagcaccttcttctcccccagtaccttgggtcttcccagtgtcaatccagagcatatcagaattgaaataccagataaaagtgaaatgcaaagtgatatttcggtgccgttacattcggttttgtaatatcagcaacttttagataacattaatatgagcaaattaacctctcataggttttattatttttcataagtaataaaagaatgctcagcagaaagcccccagctcttgagtgttacataaaagtgacctcaaatttttaatatggcgcaaagcttgttaatcctgcttggatttcatgcttaaaccttcattagtacattagtcttccaaatataatttatttagacttaagtactccaattcttatgatgaagtggcaaaagctgtgccgtattttgcaaattgcagatggcattttctagactagaattaagggattcagtgctaaagttcaatttttcatggttttgtcaaaatttagtatttgggcaccttcacaacctgatgacctttccgacggctgccacgcttcagttctgtctcttgtgtttgtgcttggtctgttgacaaccatgttgcaggaaaaatgaaccccagcacacagcagcagaacatacacaagatccacctgagaggaccagagttcaaatcctgcctttccctctgcaagtgtacaacaagggtacgaggacgtcacgagccctgccttatttcttcgggactccatgaggactggaatcaaaactttagtgaccatcaccatcctgtgtggggaaaactgaggtggaaagggcacatcctgatggatttagagaccaagccaacatggcaccctgaccgtgatctcttattggattaaacctacccatctaatgaaagcacgggttggagtttcatcttttctctctttcggggccatatatcctttcaggaccgtcttgcacatggtctggattttgtagcacaaagctgagtcctggcttacctctgtgggtaacaaatgctgtggggttgttgcttcatctaagtcacagaattctttccttttgaggtccatgaagaaagaaagacgttgctattgcattgcatctttcaaacatattttcattttttaacaatggtgtaaaataaaaagggtctgaacttactcttcagctttcttttgtggaatttctctttgccacacagggctatgccctatagccttagtgaaatgactctgatcatcttagaggggcaaatgacagcaaccttttctgaacacaatgctcccactttgcaagagtcaagggttgctggaatatcttgatttctgttaacatctgtttttttttttggatagagggaaagtaatttttagaaagtacataatggggccaattgtggtctattatatgcttaatgggtgagattacaagtggaaactatagcaaaaaagcttcccaaaagatggagtttgacaagcaacagtgcatttgggggacaacatctaggatggcaagagagtaagacacaccacccatggggagcaattagagaaacagagatgatttgagtgagaaagagcagaccaatgcacagtggctggagctacaccggcctgggcagcccaatgcaagcaataattttaccatcatcatgactgtctcaggaaacagaccatctcaaacgagagcacattctcctggccccagttatgaatcaactcctgagggaatgttttcaaaaatatctgaagattagccagggaaatgaactagatgaccaaaaacgtcacttgtaattccaaagtttgatgatattttgtttaaatgttctgtctagacttgtgctgttgctagaagtcactgacctctatccggaatgacaaccactcaggccaatgagagctaaagcactaagagaggggactgtgcctgtcctgtgtccccaagggttgtggcaagggtgcccgttagcaggagccggtggggatgcttcagaaaacccatctctgtgtcttccttgactgctaccttctaactggacagtgtgcagtgttcagtcactaggcttaccatgttgtaatccccgcggggcagaaaaaccctatcgatcaatatacttagcaactgtgacctttgagaggaccatttagccaataaggaagaaaaagtgagagtctattgccggagaacagcaatgtggagcaatgtggtgcttggttgaaggaaaatttctgtctgggtctgcctggctgggcagtaatctgaatagaagagctttggcctcccttggagctatcactccaactcctcaaacaagggagcagcatctgagtcccagggaaaagttcagcccaacacactgtattcacttgaacaaaggtcatttatttctgcactcaattttgtagttctagggacatggggatgaatgggaagatggaaaaggccattctgtgtgacatttggctgagtgtgggggcagtgggccatagaggggggcaggaatcgcacagtgtctggaccagcagacaacaggaaggggctggagccttagggagggggcaagaggcaggtcatcaagagcagagaagaccaatgacagaggtggccggggctggaagaagcagaatgcatcgcggatggacagaagatgacttttaagtttcttgtgaaattgacatttctgcaggatggacagcgaacaacactttcatccatattatttttctttgatctctcaagcagctctgggaagcaggcactaccatctttgttttatagatggggaatctgagtcatcatgagcaaatatgctttcctgaggacacacagtcactaactagatcaatctccaactttggattccaaattgcatggtcttcccctgtgtctttcactgtcttgcagctcctctctgccccagttttaagctaattacatgaatgacagagtaactaatttcttctttcattccaacgtttaggtgctgtttatatataaaaatctctgtatcgtgggaattactacatcagtaaaactttcatacttcttcttaaaatacagatacaatacaggacaggcatcctctgaggacttgtccactctgatcgtctctgcatgatttttattgttcttattacctctgttttttaagttctccccaactgtgaaggaaatgaaataaaaaaaaaacaaatttaatgttgcaaataaaataccaagcggctttttgctgctgggggcatttcagtaaatgatttcaaccttccttctagcttcttcttaaagccaaggaaatcaaaatgctgacacacaggcgccggggtgcccagcaagtggctgtatttgatgtctgtaggcagaaggctcaggtctggagtcatcatgaggtgggagcccaggtcggtgttgtgggatgccctggctggaaactccacccctggggctacattgctcctgcccctagagggtggtgttaaggcaatccaaccctaggctacttcaaagtgacttcacagaggctgtctaaaggaagaggcggagctgcagggtgggcacagagagggcaccaggtgggaatatgcaaggcacagcacgctggccacagtgcacaggttttaatatcttgctggaattacttgatgagctaaaatgaaaggagttttgaagacctccttatgttccactaggtccagggtaaatgtgcacatggcatcacatgctactctgagtaccagatgacgctgtcccctgagcctgacattcctgcagatgactgggagtgtgagatgagcatccaagaaagaagcacatgtctgctttaggtcagagtgctggctaatcagacacctaagggatctgcaaagaggaagtgcaggttcccaggagaggccactggaaagccaggctgtgaaggggcaatgacagcccagtccaccctatgtgacaaagaacttctggacactgcagcttgttctcactgtttgctgtcctcttcctcccaactcaggttcccatgtcagcttctttcctctgacaagtctggctcataagggcaaaaatatgttgagagcagagtccaaagcctcaaagtggaatctaagcttttacaactcaaagcaaagcccctgagtttctgtggacctttgctagactccatgtgtaccactgggtgtgctctaattctttggccacatcactgttgaaaaagccttcaagactcagtgtggtctcattctgttgcccacacataaaacgtgcatcgaaattccttcttttccaacctcactgagtggggcacctgcagaatggtccatctgtttttttccttcagggttactttaaacctattatgcctcatgcatttggtgggcacaaggaagaaaacaaacaaaggccttgtctgtgtgtgaacttacagctcagtgttagatagcattcttatttcctaatttcagggaacttaatcagtcacaggcatcttctgtgagtggaatcatttttcttttatttgatcccatgacatatctttgtacgccctttaatcccctcatcttacctttgggaatctttttttcaattgcattttaactattacaattaatcattcattatttatccatttatccatccatctatccatcatcctttcatccatccatcccccatcaagccatttatcatccatccatcaatcatccatccataatccattcatctatttgtcgcccatccttcatcctttcattcatctatctgtccatcactcatccatgcatcatctatttattatccacccatccattcatcatccatctattcaccatccatctatccattcaccatccatccatccatgaacatgttctaagcatcaggtgcagtgtgagccctgttgcacaaacgtcccttttctcaagaagcccacatcctagagtagggagacaaatgcagatacaatgagagctttaggagcactgaagaaggagccctggacttaaggaatgaaggaaggtcccacagaccaagttgcatagagaaggatcatgatgaaggacaagggctcaccaggcatagaaaaccgagcaaggtgtttagacagtgggaacagcacgtggaaagaaaccaaagcaggaaagagcatggaacattccaggaatggggagaagttcagtggggatgaagaatggggtatacggtggggagtgtaggaaggactgaggcaaaaggaccagttggggccagaatgtgaagggcttcaaatgccagagtcagcttccaactcctcttcttccttgtcctttgttctatcctcatttatcatcaggacaacagcagccacaagtacggctgctctactctacggataccaccaactcttaggactgttttttgagtgctgactacgtgccaggcatgtgctaaacatgcattgccatgtttatgcctcaaaataagctatgggtagatactgttgtgattcccactttacagatgacaaagtgaggacagattgggctccctgtcctgggctacagagctggcactcaggggcaccggaatctacctgcaggcaggcttgctgtggagcccatgctttaagccccacaagctgtccctcgcctcagtggctcccttctctctgcttgatctttcatatgtccagcctctgctctgcaaggctgagcctcctgcagaaccttcctgaagacggcattgcggtaatccccaaccctcggactccctaggccgtgtgtgcagcagctcatttcactctgtatctcaggtgcacatcatcactcagttcttaatcctgtagacgtttgtctcttttcagaagatggtcactgaagacccagcattgtgaatgggatcctgagctcactcttccaaatggttgtgctgagtgcagcctcgatggcaggcagtcactaaggaccggggccaggcttccccacctgttgagacatcccatctgtctatccagccttctcaggttggggcagaggggactagcgtgtagcgtgcctgcttctacatctgcccaattcactctttttttttttcttttttttttagacggagtctcactctgttacccagcctggagtgcagtggcatgatctcagctcactgcaacctccacttctgggttcaagcaattctcccgcctctggctcctgagtagttgggattactcaactactcttgcaccaccacacctggctaacttttgtattcttagtagagatgggtttcaccatgttggccaggctggtctcaaactcctgacctcaagtagtccacctgcctctgcttcccaaagtggtgggattacaggcatgagacaccacacccggccccaattcattcatttagcaaaagcctccagccagctgtgctggaggctgggaatttcaccaaaattcatgtgtatgcttctgccctttgggaggttcaaagtctggtgggaagcagacaaaacgtgaagagtgtacattacagcctgtgctgttttgtctatgaaagcgacaaacacactaatgggagactgaaaatgagaaggtggtgaggaacagacctctttgaagtgatgctatggtggctgagagcaaagctggaaggtgctggccttgtggacaggtttggggaggaatgttcccacacagggcagaggcaggaaagagcagagcagcccaggaatagaaataagatagtggggttagagcacgcagcaggtgggaggcacaagataatgctggagaggttgacaggccaggcaaatgccagggtgaagagtctgggagagtttgggttttgtttgagttgccatgaggagttttgtcctttttttttttttttttttttttttttttcagacagagtcttgctctgtcacccaggctggagtgcagtagcacaatctctgctcactgcaacctccgcctcctgggtccaagtgattctcatgcctcagccttctgagtagctgggattacaggcgcctgccaccacgcccggctaatttttgtatttttagtagagatggagttttgccatgttagtcaggctggtattgaactcctgccctcaagtgatctgcctgcctcagcctctcaaagtgctgggattgagtcaccgggcccagtctatgaggagcctttatggggttataaaccaggattaccattgtttagtttatgcgttaatccttccagctgctgagtggaggatagatgggggtgagcagcaggaggggaagcctggaggaagtcagcaggtgaccgcatgagtccagatgaaaggtgatgatggtttggactggttcagcgcagggtcactgggaaggaggagctggatggattcaggattgatgtgtatagaaggagatggatcagagggggtgggtaaggaaagagaggattcctaatgttctggtttgagtgatggagaagactaaggtggggggaataggggacaggattaggacaaaatttaagacttccaaggttagttgacaaagataattcaacaatgttgaatgctgtggacaatagcttaacatagggtttgagaaagtagaactcgggagccagcaagctcgaatttaaatcttggctctactaataactagctctattagtccactctcacactgctataaagaaatgcctgagactggataatttataaagaaaataggtttaattggctcatggttctacaggctgtacaggaagcatggctgggaggcctcagaaaacttacaaccctggcagaaggtgagggggaagcaggcacgtcttacatggctggatgaggaagagagagaatggggagggctacacacttttaaacctgatctggtgagcacttattcactatcacaagaacagcaccaaggggaaagtctgcccccggccccatccaatcacctcccactagtctccacctccaagttggggattacaatttgacataagatttgggtggggacacagatccaaaccatatcactagctatgtgcctttgggaaagttgcttaacttctctgtgactgcttttttcattttaaaaatgaggacaatctttttgtggtccttatgagaactgcatgagttaatatacatacataaaatgtgtagaatagtgcctggtacatagtaaataatggccatcacccaataagttatagttattactaacaacaaacatacattgagcaccctgtctgctggaggcacccctgtcctgagtgcaaagggacacagggacatcagctttaccttccaaaggcttatgttcaatgggagtaataaacacagatttgttcataaaatatatctttagttactccttgtgtcagccaatgaccacattattacacagaaagaagaataacaggattccaagagaaatgtgacatgggaatcaaccacaaagatgtctatattcatccatcgcacatacttaacttacaattctaaatctctgtttgtacttcagtagatgggatccccctcgggaatattttgaaaatgtccttcactaccagttgattacaaaacttctgaagtggttaaagaatacttgaaaagatcaaattaaagcatggaggccagtgaaattttgaaagatatgccaaagacccatttcagcatgtgactatctggtcctcctcaaatggccttgactggtctagagctgcgggtttctaccatgtaattctgcaagaggcagaaacattcagcttactccaatgggagagagtcgccagcctttgccaaaggggcattgtaatggatttttaattttttaatctttttgaaaaggacagacctctgggcgcagtggctcatgcctgtaatcccagcactttggaagaccaaggtgggtggatcacaaggtcaggagatcaagaccatcctggctaacatggtgaaaccccgtctctactagaaatataaaaaattagccgggtgtgatggcctgtgcctgtggtcttggctattcaggaggctgaggcaagagaatcacttgaacccagaaggcagaggttgcagtgagccgagattgtgccactgaactccagcctaggcgacagagcgagactccatctcaaaaaaaaaaaaaaaaaaaaaaaaaaaaagacaaaccatatgcaatagacaagactaaataaacatttccagaagacaatgaactcaggtaaccagtatgacagttaaggttttgcttaatttgcaaagtcactgtaatctgatggcaatgatggacaaaatctatttgattcctgccactggtcaaatacattagagaaatgtgcttactggattaatttattgtgtggtttaaactgggcactttaaataaaactaagctatgaaacccagagaaggggtagattctttctttcaaaagataaagaaacaacaatggcattatcacaccttttaaacatatgagagagggccaggtgcggtggctcacgcctgtaatcccagaactttgggaagctgaagcgagtggatcacatgaggtcaggggttcgagaccagcctggccaacatggcaaaatcccacctctactaaaaatacaaaaattagctgcatgtggtggcgtgcgcctgtagtcccagctactcggtaggctgaggcaggagaatctcttgaattcgggaggcagaagttgtagtgagctcatgtcattgcactccagcctgggcaaccgagtgagactctgtctcatgaaataaaatgaaataaaataaaataaaataaaataaaataaaataaaataaacatgtgagagaggcctgatatgagaaaccaaagttgaggggttgatttggaaacagagagactgctgttgtacagcctgaaatgcgttggaagcagtgatgttcttcctggaaaagttacacttgtgaaatgaagagagcaccattcaagaaacgctccaggtgcttattaggagaagataatcaaaaatatacataagactttaaatacagcgtgttatgtaagtaaatgttaaatcaaactttggagtggctcagtttcaaacaactaaatatcctcggtgcttctgtcccttgccagcagtcacagacatcaaataagttcatatgctcaaaaaaaaaaaaaaaaaaaaaaagctttctggacactgtcagcccacctgtgtgcagactagagaagaatcctttaagctttctgagacaaataaaaggcaaggaatcaaagggaagtgtacacctcaccatttatcgggaagcagacttgggtaatctggctgagccagtgacaaataaaacgtgatttaatgtagcatttctcacacgtagagaaagtctccaattctcagagacccctggtgttgacttacaatatttttatcccaatagtatttaaatgtatgcaagaataaaatgaaatataaatgtatgtgtataacacaccaatcaaaacaaattcacaaatgaaatacagagtaaattaccaacccaagaccactcaattgaaggatattaattcagcctaatgggtaatgtggttttgtggaagcaaaattgctcattcagagcttcagggtagaaagttgcaaccctggttctgggtctgcagtgaatgtttctgtatttgcctgtaatcgtacccttgtataatgtctgttgacatacgtatgtaacacagaatgctaggaacatcttcaaaactttgtctcaacgggataatcagacctcatgtggcccccaaaattctgctggcaggcaacgcttgaatgcctatggcagtgaggtagaatttgatagtcttgttactttaagctaaggtcgcatgattgtagtattaaaaaatctgcactaattacgtatctgccttaaatattgttctcctttatatgtagaatcttaaaaagttaactcttaaaagcagagcttaccaggggtggagggcttgggggtggagagatgtgggtcaaaggacacaaaatttcggttaggaggaataagttcaagatctactgtgcaatatggtaactacagttaataccagtgtatcacattctggaaaattgctaaaagaatagattttaagtgttctcaccacatacacacaaaaatgtgtgaaataatacatatgttggtcaggtgtggtggctcatgtgtataatcccagcaccttgggaggcccaggtgggtggatcacctcagatcaggggttcgagattggcttggccaacatggtgaaaccccatctctactaaaaatagaaaaattagccaggtgtggtggtgtgtgcttgtaatcccagctactcgggaagttgagacaggagaatcgcttgaacccgggaggcagaggttgcagtgagccaaatcgcaccattgcactccagcctgggcaataagagcaaaactccatcccccacccaaaaaacaagaacaaaaacaaaaaccaacatacgttaattagaccagttaagcccttcaacaatatatacatatttcaaaacaacatgtatatgatatatatgattcttaaatttttcaataaaaaatacaattttaaaaatctgcattatgtatcaatcttaaatattgttgaattcttagacaccatttttaaatgtgactactctatttatatgatacaatttatatgataaacttgggaactgatatctaaaagacaggggtccatgaaactgttaagttacctaaaacttggaaataaggtgaaaagctcactatgtctgctttcaaagtaaaacccgatcaccgtctcacaagctggcctagaatgcatctaagtggggcaggggttagcggatggcctccaggggcctgtttcttataaagttttataggaatgcagctacttaacgtgttgcttatggcagcttttgtgttgtggcaaaaagagtggggtaactgcaacagagactgcatggtctgcaaagtctgagatgtttaataactggcccttcacagaaaacgtttgtagaccctcattctaggggatgctatttgggttgatttaccatttgctattgattagggacctgattctgtaaagttagatgttaacttgcagaagactgagaaatggcaagtgatatctgtcaggcagaaaagataaagcgctaaagtgatggtttcattgcctggaagaacatgagccggttctggatgtgagctagcaggcttctctcaaccttccttgttctccctgagcctgctttggcatcctgctggttccctcatcaatcagctgcataaacctttgacagatgctcactataggtttatgtgagagccatggctttaactttctgaagtttgtgctttgacataacttatttgtctacatttgattgaagacacatttactgagcaactctgattggctcaatgacctactgggccccttctatgtcgctgagtcatgttggatgctaggtgggatacaagagtgggtaagaactggggttgacagaaaataactcatccactcaaataactacaatacataatacacgtgctcagaaataaatttgtgtagtaaaagtcatagttcatggtaactgcctgattagttatagttagttgctggtgggtgagattatgaatacttaaagatttcctcctttcctttctgtaattttctgtaaggagcatctgttgcttcttgtaaaataaaaaaaaagtggggaatttgattttaacttttcaaaaatgtcagtcagggaaaatcagggaatgtcgtttggcttcagtgggagactaggggacaaaggaaaaattcagatagggcaggggatctagggtatagaggccttggaagccgggctgacaaatttgacccatcattttgggtaagagggagctgctgtggctttaagatgggaagaagagaaagaagtagaaatctgccgtgcaatccagacctgagataaagaagacacggtcccaggtggaggcaggggtggtgtggaagacatggctaggtgaggagctatttgtaaagacagacttagagatgacgaagcaaagatgagctggttggaaagggcactgactagggcccctacagggagtgacaaggcatcttttggacaaagtccattggtgaactctggaagaagccagctgcatctgatctgtcctcgaatccctgaggccgagcctggtgcccagaacatagaacaagctcgggatacatgtcccaggcttgagcggaagggaggcaagttgagggttttggtgatgcagcctggaggctgtgcaccacaggaggtccacagcaagactgtgagtgaccctgtgggagaggacagtcgtgtgcttccctcctggggttgcagaggaagcacaaccaagccaggagtccgaagaggagcagcacaaagatggaatggaagtcagggaatttctcattgctgggaactaaatgactgatttaaggaaggccggatggttgagcatctgaggacacagaggtaagcctgagaaacagacctgggtttggcatgcaggagcctgcctggctgcatttggtatttatatatcactggtgcccaacaaatagtcaatgaatttggaggctgaagtaaagatacttaggtggccatgtgacagagagaagtgatgctggtagggacatctttgggaagggagggaggttatgagtggagaagaagcaagaaaatgcttcacaggcctgaaagccccagacagcgggtggtacgtggaaggcctaagtctccaccacgcatggggtgacatcacctccgtgaactgcaggaatgggagagggaagggactggggcttcaatgtgaaattacagttcttcattccacacaaagacatgtgttccaaattaacatcactgtttcctaagaagcgtgaagatgcaaaccaggtatctcctcatgggttggggctggtgttcagtcaagatggacagccactacgggccttgctctcctcccttgagtccacggccctccctggaaagccccctgtgggaggtgcagatgcaggacaggagaggggtcagtcaccgttgcagacgcccatgctctccggcatcagtagacacatttcaaagactgaatctcaaccctgccatggcagaggggaggtcacgctatcaggaaggtctgtacctttttctggtctaatgaagtgtaagacgacagaatttacacaaccaggagagagaccagaagggcccggcaagtctcatcacccacatgctggatttgtctccagctcctggagccattgggaggggccatatgttctgcatttcaccggctcttgcagtgaaatatttgctatctggtttgtggacgcaaaatgtgcaaccagggccagtgtagcctttagctcgtgtgaatcctgcagcttctgtttctgggcctgaagacagagatccagcacctcccctgctgctcctacccagctgtgggtgccggggatctctgcctgcacctctggatgaggctgagtgcctggcacgcatccttgcaaagcaaatgaacaaccattacaaacagactcagttttcatctcaaggtaggtctgtgcttaaacctgacaatatgctctttccattttatttttctttaaaccccaccaaatttcatgtgtatttatgaatatactgttactgccaaattcctggcactttattcatattagaaactcccagctgtggtgagaaaagaggagaacatttttcaagaggggaagaaatgacttttcccagtatatcagaaatatgtcccattttattaccactatctgatatcaaagagtaaggaaggtaggcttgagcagaaggcctgtagattccagaaatttctttcagggcatctgtgtctttttatggtgagctttgtgcttttggggccctaggaataaggaatttaagttatgtagtcaagtcctcagtctcactttaaaactacctgcttaccaggttgaagaccccaataagtttagactaaccacctgaatgaaggtttcgtttggggcaattatctagatgattcagtaaagtgtaagaaaaagtgatttcaaagccttggacaatgacaggaggatgaggcaacccagccctgctgaaaacttatccacctaatcaccatcgagatcagcgggcctgaccatcccgctgaaatggccggtgttcatttcaagtcatgccaacaatcatatctgcttgcagtgcatgagtcattttaggcataacggccaccagccaatttcaacgactacccatgactcagccatattgtcaagttcgcagcccctcctggcctccagctaatgcgttgggattctaccgcagaaacgctcccataaacctctgctcatcaagtgtcatcagccccatgcatcatgtgaccctgtctgtgggaagctgctgctgcttcccagagtgtgtctcggaccgtcttacacatctaaacaaaaccaggttttcatttttagacttcagtgagttattttactaaatcagagaaaaataaacatttagaattacaaatggaatacatataaagtttctgtacatgtcagtaatattccctgataatgaaagaataaggatgcattcttttaaaataagtcatcctatccctgtctctctagctaattgagattgtgcatgaccttgagaaaggcattaaggtttgttctattaacaaacatagacagtgtgcacctgatcaaagcaatgctttttggtcaaatgattgactaacaaaaacaaaagcccactggcacaaaatacaggcactcaatggggtcttccacacgcaccatgacctatgtatatagtccatcaacagaaggaaggacagtgacttacacactagttaccagacaattaccacctacgagatgctctttaatattcactgttctattaattagaatattctatgaattggtatttccatgcagggtctgacctgggccacataatgaggtggaacaggtgcaagctgttaaggttggcaagaagtgcagctcacacggggactggatggtctgagggcactaggagggagcaggaaggactccagacttcctaggtcttcagttaactcaatggtttttgtctttgaaaatggagtaacagattaataaccatgacattgatccccaaacacgatcagatgccttcaagtatggtctcaaggctcaggaagtttatgctctaattatgaaaatgaaattgaacagtaaccaacaccaataaaagcaggagcatttggaggttaaaaaccagaattttggagtcagaaaaatcagcacgactcctgtctccatctcccactacttggtgagatcttgggcaagggatttgcctccctcagcctcagcatcttaatcgacaacaccacgatataatggttcccacactgtggagctgccgtggggtgccaataagataatgtgtgcaaagagctcagttacggtgcccagtgaactctccaggaacgttagctatttatggcaagagcaacatcagcagcaacaaagcaccagatgagaagctctaaatggttcagaatgttcaaaggagagaggattctcaataggttggagtctccaagactctagagaaagagcccaggatgtggtttgagatggacgttggagagttgttaggacttagattttgtgtacgtgatgggggcagggtggtggtggtggttaaatcaaagcaacagagatgctgtaagcaaaggcacagatattgtaaatggcacatggaatgttctagaaacagtagaccagtctgggcagggcataaatttctcatatgggaggtaataggacgtgatcctagaaaggtggggttgtccaggctggaaaagagtatgagcatcaggctaaagtagtcagaatttcttccacaggccaaatggttattgaacaacggagtgagaaaaagggatcatttgagaaaggataacatgatgtgtgccgtgggttgaaccgtccttccaaaaagatacgtttaactcctacttcccggcacctgtgatggtgactttatttaaaaataggttctttgcagacgtaaccaagctaagttgaggtcatactggagtagtgtgggccttacaaggagagggaaatttgaacacaggcacgcagagaggaggctgccatgagacgaaacagagatacagaagagaaacaggggaaaaggccaagtgacaagggaggcagagactggagtgttgttgccacgagccaaaaacgccagggaaccccaggcaagcaccagaagctggaagaggcgaggaagggttcctcccagagccttgggagggaacgtggccctgccagaagtcacaagtcctggatttaggatttctgccttccagagctgcgagagaccgagtttctgttgtttgaagccactcagtttgtggtgcttcattacagcagccctgggagatggggaactggcaatgtacagggaagacatgatgtagtcaccagatgagagagtggtggtgacaaggaacagagctgagaagccattcttagagtggatcaaagacctggagatacaacggtgaaatgaagaaagaaaaagggaagtggtaagaacccagagaaccgaggtgctcccattgatagaaagaaagaccaggcagaaacaaaaacagagaggtgttggctctgagcaagaccttctacctcgagcagagaggcctgccccagagagaggcagcaggctagttcagcaacgttgtcgttcacataaagaacgtccagggaaagaatgggcgggccttctttttgcaaggtcagagctcgtccagtggaaaggctctggggctgcaacgcacaggatgtacagcaccagtgccaggcctccttgtccacttccattcactcttgtcttaatgccttggcaattaaaacttccaaacatctcagtcgattcttcttccactgtggctggagatccaccccatgtggggaagttctactccgaaacttattcccatgggtttctagctattagtacctgtggaaaacttttgctttatttcaagatctttagaaaaataaacagggcataccataattgttggttaatttgttttcagttaattgattccagatttcagcctttctgactattaccacttttacctttttcagcctatccttaagttcactgaactgtaattttgtataaatttaatgactatccaatgacattacgaagtctgaaaatcttgcttttgtatcttgaggtgtcctaccctgtaatccgagggtttgaaaaaccccaaaatgctctactacttctctctctctctctctctctctttaaccagaagaagataaaggtcactctgcagtcagaataattgctgcagtggattgaagatatttttaaaaactttctctcaaaattacagatttaagatgacaacgaaagtaaaattgcagttgaactccaaagcaaaaccttcaactaaaaatacaaactactcacaacgtacaattttgccggggccaagaggcaaaagagcttcatatcaacagaattctcataatctctgagtgtctacagaactcaagtggcttcaagttgtataaagtccccaaatcactgcaggttcgcagacgtacgtgtctctgaaatgctctaacatttttccgaaggtcaaagtgagactcgatctttaaaccaccgaaagaaaaaaatgtctcctttcaagactttttatttcacattgaaattaaaaattaaaattaaaaagtttcacattgttgcagatagtagaatacaggggaaattgtgtacaaagttccatactggctccttttaactggacatcttttgtgaaagttcaggtgcccaactagttgtcatcagcgaaggagtaaggaaggaagaatgaattatggagacagcgatggtcaggtttttaattcagtaaaaaccacaaaaaacctttatttctaaactgaaagtttcttaccttaataactaatcagagtgtacattttatttaatctatagggattgtagtagtaatttcctataagaaactagaaagtattctttatttgacatgcatattaatatgtctatgccttcctaccaacacctattggaaagaattatagtctgaaggagaagaaatagcttggttcagttgttactaaaatcatatttaaggtaaatattgcaacagacgttttattttataaaaagcaagtatagtgaaattcctgtgtggaatggaggtgcttcagccaagaaaaattatgttttacacatttcagacgttctttttgaataaatatagaagcataaacacgcagaaatacagaagtcaggaagaaaaatgatttgggcataaactctatcaaagcatcaaataccattttactgaagagctgttcaatttttagataagaaatcatgtttcacaaacataccctaaataccctttgcttatctgacaggatctgatcaaatatcttttgaggtaaaattttccttcctactcccacaaattcttcagaaactgcttagcagaactatttaaaaaaataagtttcataactttgggcaatgtgagagtgtgacccacagagactgtgctatggcccagttctgtgttgggagtgtggctgcctgtgatggacttcaccctctgtggtggacttcactctctgtggtagatgtattcttggagaaatcaagcaaatcagagtgagtgcgcgcgcgcgcgtgtgtgtgtgtgtgtgtgtgtgaaccaaactaagtcatcttttcaatgtccccagaagttcacccaggagttgaaggaattctgcaacaaattattcacagtaggagctgccaatgcaaggctgccagtggcgaatgctttggctgctgaacccccagctcctatctccagcccctggttcctcatggagaagccacctcctacttcagaggctagaaatggaaatctccccacccctggcagccagctccagtcagtggatctgctgggaaactttctagaaacattttcttccctaacaagaagcgtaatacaagggaggaaacatggcttccctttcccctccattagacattgttgggtgaagatgtgatgcttggaactggagctttccatcacctgtgactaggagaaagcccagagaattgcagaaaggctggcccaggatgcaggtgctgtcagctgctaaattagcctcacctagcagtgccacctctgggtgactgtgtctgtgagacaataagctcctcattgctgagtcactctgggtcaggtattctgttactcacatggaacagaaagcagattcccgcttcatgccctttcttcagggcattttcctctgggaaatccctctcatccctcaacgtttagtctatgagtaactcaagagaccgcaaatgaaaatgtggcacctttgttcataaattgttaagaatttaaagacggtgatagcagagcattaaaccaaccatgggcccttctagctgtgaggccttgtgtgaccactcggactgcacattcatgaaggtggccctatttacgggcttatcttacctaccaaatgggtagcacattttttctgtaaaaggccagatcataaatattacaggctttccaggcctcacagtctttgtcacaactacccaactctgcgctattctaagtagattagataggttggaacccacccacagtcacaagaatgggcatgagaaccacgtttgccaagagtaaccccaggttcttggccagggtggattggctcggggctaggcacctgacggaagccaggccatttggacaccaccaagtctttccagaaggtacttgggaaagatggtacctttcccctggagttccatagctaatactgtgtgatctgtggatgccaatggcttttgtcatacagcatagcaggagagcctgaccaagagacaaccagagagccaaagccatgatgacactctgagcccctggatcaggccacacctgaagcaagttgtaccttgcttcccagttatgtggcacaaaacctctttaccttttcttttagcagtttgagttggttttctgtcacttaaaaccaaaagaattctgaaagtatgtttaaaaaaaaaaaaacaaccaaccctgtgtactttaggccaacttcactcctcttaagttagaatagctgaatcactggaatacactttatataagatggcaaaagtcttaatttaatgtcagcaagagttgtaaaacctaaaatgaaaaatctcccaaatccactggcttgttaccatttcttgaagctcaactcagcccatgccagctcaggatctgtatatttcttaaacctgatctgtctgtcacatagaatatccttctgaaagggacaggcttccacaggacaagtgaatgcttagcatcaggtggctgaaatatgcactcattgcagtttccaaaagtaaagacaaaacccaggctaagatatagaatcttatctcaaattttgcagacttcttgtatctctgcccttccattactcatgactctttagttccagatgatgtataacatgttactgtctgtgaaagactgatcggtatatcctggagatttttctttttattgtttttcagttgatatctttttaaatttgagttagtctggtcatatgatttattttatagacaaaacatcactggtatctgaataaattctaataatgcacactagtacatacactcaaccacataaaaaataacacatcatagtctaaaaatcttggtgggaaggctattatctggcctgcttagctagactttatgtgtctggaaaaatgtccaattttttttctagcacctaaacaaattatcttgtgtatagcaaagctgggtctaacctgaactcaaataactagaccacaaaaccctctgatgttgttttgctgttaagctttctttattcaggagaaacacattgtaagaaaacaattgcaaggcaaagcaactagtctatagaactaccacatggacatgaatctttctgaccctttctaaaagtacttgccctacacaccagaaattctgactctgagaggcttcaagatcctaaatcccaaaacgatagacgattaaagtatactcaggtgggacactatcctgcttagtctagggagacagatgaatcaattttgaaaatattttcaaacacaagcgtcaaagtgaaagaggtgactcctcggcactcaagcagggaattaagttaatcataatatcccatgagcaaagagaaacccccagtctgctgcctctagaatgtgtgtattcatatccaacactgacaaacacaacacatctcactcaaaaagtacatcgttttctattacgggatgtttatctgtatctgctaagaccaaacaccaggcaattataagattacatggctggcaagtaccaacatttcaagaaagaaacatgcaagaatcatgctctgagttctaagtatgttgcagtaggagggtcttctttctcctgaaggctttgcagttctctgcaggcagggaggaaggaaagtgatacggtttggctgtgtccccacccaaatgtcatcttgagttgtagctccctgaattcccatgtgttgtgggggcgggggggagccagtgggaggtaattgaatcatgggggcagatctttccctttctgttctcctgatagtgaataagtctcacaagatctgatggttttataaaggggagtttccctgcacaagctctcttttctctcgtctgctgccatgtgagatgtgcctttcaccgtccgccatgattgtgtggcctccccagccatgtggaactgagtctattaaacctctttcttttgtaaattgtccagtcttgggtatgtctttattagcagcatgaaaacggactaacacagaaagcaaggataaagaacataaactagaagtcacctcagatgagcatcttgagatcacagatgagaaagcttgggggaaacaatggaatggggagacaggacacagaaaagggaaaggggtttactgtgcctcattggcagaatgcaatggctcccaacatattggtagagttgccacacttttgatttcatcactaagaaatgatcatgcattgggatcttttcttataatcttagctaagttatagtgcaaattacgcaagctattataattaaggtctgatattttatgtgaaagcacattaaaatgatttaagagaacattctcaaagagtgctcatgatacatctgtgcaattccaatgttattttctcagttttgaaatgctattggtattgaagactctgcccaggaccttgtctgttactaataagctcaatataaaatacgattgcttctgctccaattatactgactcatatagcaattggttactaagatataattgcttttgtggctaacatttttgtaaaactttcaaagtttatattatttgagattacttactgatactaagaagattacagctgctgttatttatttaaatggttgctcgaacaccaatattcttccagattcttgtttcactcatctctttatcatcatctctcaggaattagagattcaattccaggatatattgttgataagattacaaaaatatacagaaacccttacatgtttcaatatgaaaaacactaaaaggaaaaatagtagacagccagccttgcaaggaacaacatatttcaatgatttctgtaatttttttctgataatgtacattttaaataaagaaagttattattcacagaattagattttatgtaggggattatatccattttcaaactctgtttcttgatgtgggatttatgctgctctgataaaggaaatacttctatcagctgactgagataagggaaagaattccctgggagatttaaagaagccaccataaaaggttcttaattttaaatcagtggttcttaatggagcgtagggtgattttgtgccccaccccaggggacactggcaatatctgcagatacttttggttgtcacaatcaggggagcagactgtgggcagacgacagggatgctgccaaacatcctacaatgcccagtgcagcccccagcaacaaagaattatcccctcctctgcaagagtcaatagggctgagggtaagaaacctgttcaagcttcatcagacactggttcttggttggtcagatggctttcagagctcttaaaaattcatatgcaattgtacacaagcacaaataaatgtgggaggcacaggataagcacaccacacatagatttcttaatgaagtaaaggtaaagaaaaataaataaaagtaggatttatctttacttttcaacggcagctgactggccatcaggaaatctatttcatgtttattgggggataaaatctacactccaaaattcaggtagaagagaatggaaactcacaagacaggaagactgagcagaaacagaaccatctggtaacctgattaaaatgatcatttgacacttgcaggaaaatgctatgaagcccaatggagtaagcacacttctttaaatcatatccatcagaaactcttacactgcgggatagaaaggagaaaaaagaaagtttttttttttttttcctgttaccacccacatctttctggtgatcacatcccctagcctatacaaattgagctttttcctcagttacgtgccaacttcttatcgtaagaatgttctctgagaattgtcaaatgacaagacatctcttttcagaattaatgaaacttttctattactcattattctgctgtcaaaattgagaccagcaagagagcaatgaaaatcagaattccaaaggaaagaagaacgctgtcaattcactgttgggaatcttggcagcaagccaaaatcctatcaacataggagggatattttcatcttctaattgcttcttatggctacttccagaaaatgtagactgttcacatcttgatgaaaaggggtaaaaagctaatgctgcttctgaaaactttattattgtagcatccctgagtataaattttttagacacctctataaaattctgttagatatgtaaattgtttcaaactgataaaaatgcctaacaattacctgatccatagtgctgttcctttcttgtcttggcaggaaagacaaaactgtcttaagcagagattattctttagaatttataaggataattgatggtgagaaaaataaatcactggggtgtcctattgtcacacagaatttattagaatttgtcctaataaccataatatgatgatttgtcacagctttgctggcgacaaacacaggagtcagattttacaaactctgttgagtttagggcaatgatcacatgatgattgaaataatccaaatattttagctgcattctgtcagcagctatttttagatataaaaagttttcagaaagagggtgacaaaacaaggcctatattgttatattgaatgcaggtttcaaaccacagaggatccaagaaaaagattttgtaaaacaagaagttctttacttttcctttaccgtaactcccaagcctatgagcactaagttcgacagcagaacacgactcaatagatttagaggtctggacccatgaaaagctcaagatacagctgattatcctagctagcacacaacttcactgggaacaggcgactgctgatcactcctcatgtgtaacttattctccttaatcattttattaatgcagactcacataactacatctcgggatcctccgggtactacgttaactctcaggcttggtttttggactttccagatgcaacactcaactcgatgactgaatctcccatctttccccaactgccaggtacattcatgcctgctcccttcctcctgggctgaccctctatggggaaggtccttcctttcatctctgcgtggtgaactccatttcattcttccagaaatagcacgtgacaaagctggactagcagcagctcctgttgaccaatgctttcctctgtgtcaggcgccgtgctggtcattctataaatgttataaatgttattgcatctactcctccccaggtcctcagcctgagagagagacagcccctacagcaatttcttcctcactgctctggacatcagccccgtgtgagtcacctagcacccgaccctggcaggtcccaatccaggaggaggcaatgaccacacagcatgtcagatgctaggtggaaagagcaaggtggaacaagtggggtaggggcagggccacagagagaatgtcgtggatggcttcctggctgacaggacgtgagtgagtcctcctgactgttgaataaaagaagtccagtgaagaaggtggtggaggagatgaacatggatatggacgatgatgactgggccacgaggaaggtcaccagagagcccaggatgagattcagccatatgcctagggaaaggttccttccaccagtgaaacctgcactggaggagacagagcaggagagcagagggctgggttgacccagaagtggggcttttctggacattaagggaggctgatagggcaggagcaaggctgtgagaagtctggcagactaggaaatcatggaaaggttacgagggtcatttatgggtggcttccaggtaggtggcactttggtccctgttttctgccaatatcctccatattttcctctgagtaattgcctttttcctattttcaatctttgtcctttggtggagttgactccaccaagggtggggtcttggtgccactcaggcaccttacactgtggtgtaaggagctgcctctctcttcctctgtttggggctgtggcattagaatgtgagttatgggagctgctctcgccatttgcaaccacagggtgtgcacaggggtggctggaggtgatgccatagaaagaatgaaggtggagcttcccttcagggcactccctgtccaggtatacagaacccatcattgagatatcaaatagctgcatcaaaacttgcctgaagtgtgtttgttcccctgttcttttgccaaatggagctaggcaggcggcataccccaccctcccgggctcagcaattggtcctcaagagctgggtgcttcacttaagttcttctttcagtggttgccaaggacattggaaaagagagttcacatattctcaaaggagaaagaacttaagaaccatgggatcctggacctgccagtagccatctctgcctcctggaccacgtgatcctcgacctgccagtagccatctctgggtcctggaccatgtcatcctggacccgctagtagtcatctctgccttctggatcatgtgatcctggaccctccagtagtcatctctacctcttgaaccatgtgagtctgaacccactaatagccttctctgcttcctgaaccatgtgatcctggacctgccaatagttatctctgcctcctggaccatgtgatgctgaatccgcaaatagtcatctctgcctcctgaaccatgtgatgctggacctgccaatagtcatctctgcttcctgtggacagatccagatggataatgaaaactatgcagaggaaagttcagtagagtgagggagaccgcgtgagtcgataaacaccctctgtgcttcagttattttgagttgggttttctgttacttgaaacaaatctgtccaaataatatgcttagactggagcagttgtgaagtccagagtgggaggcagaatgtgggtgatggggagggaataaggacttacctggggtttcatcattgcctggaaaggttgtgaatttgggtcttgttcactcccaggcgtgactgctgcgcagctcaccagcctggctgtacattgccatgccaggtaccgcactggtgattaagattcaggggcagactcccactttccaaatgaggattttctcctcttttatgcatactcatccacaaactccaaaaaaagtttcatctatagatgtgaaaattcaatctgagtatggtgcccatattgaatcaacacagctggggttaattagaatttggaaacaagaatgatttgttctaataatgatcatgatgctgtcattttccaagtgaccaaaatctactaattttatcttgaaccaaggaataaaaggtatattctaaatgtatcctgcccctcagctttgtgaaaaaattaagatgtacttatcttgattaaacattggtttatcttttggtaactatcttgaaatgcaaataaaacttgatagagagttaagcagcagctcttcattcctctttattttattttattttattttatttgggtcaatcccttctattcctacatatatgaagaaaactgggctatcttggtttctcagtcttgccttgctaatctaattttatcatctttagccactgatacaggtatctcttaagcatgagcatttgaattcttctgaatttaattaaaagagcagctttgattatggagagatggattctcttcaattttgctatcacagtaagcaaaggcttttctcccttgttatgattaaatgcttaagaatgtgtctggactcctgagcttggtcctaccacctgccttttgtgtattctctctcatgcagtcagagtaactttttttttctaaataacagcattattgagatatgcttcacataccataaaacacagcctttgaatgcacataatttggtggtttttactacattcatagaattgtgggagggatctttagtaagtgcacccccacccttcgaagccttccaagagctctacaagactcacatttggttcacaatttctttcctgtcgtatccagcacagtgttgagcagataataagtgctcaataaatacctgtagaaggaatgtacccattcttttaggagagggcttagctccaagatctactaaatatagtaaccttatttgtgttctggcaaaagcatcataaaccagaattttataaacaataaaatgctataggttttcgttttcacttgacaacataaatttagatcatccatgaggggatgtgcatatggttcgttctttagatagaacacactcgttttatctaatttcagcctaagaaatttgagagatgatccccagattatatgccagaaggaatctgttgaacaatttttaattgagtgttttagcaagacaagcaggaaaacaagaagctaataattgatcaaacatttgtttcaaatggaactctttgaaattatatgctagaatttgccaacttgttgaaataactaagccacccactgaatatacccaaaccactttctctatgaggcttgcagaacaattttggggtataaaaatatgcacaggctaaattacccatcaacacaaaactgaatattcttatccttaaatctccatgtgactaaaactaattactgttataagtgaaaatacatatttcaaaaagctcccagtgatgccaaaagcattcagactgaagcaccaagcaggtgttttaacaatgtccttgaaaatttccctgccaaaatgctagaacgaactcttgtttggtttaccccttaaagcagggaccatctgctgacttgaccttccatagacatagcaaaagcaaattaaagcaagttccttctattagaaagcagctttccaaactgagatgaattccaggcttagcaaaggttttgctaccactctgtagaaaataacatactgattacaaaagtacaattttataacgtgacccaataaatcacttcaaaaatatggctaaaatcaggacactggaaaccactataatgcaacaagaagcatcaataagaagctggttagatgaatgagggttcattgaacatgtggcattctgtgtgagcattaaaacaagaaggaagaagcttacagctactaaggaatgattgttggccgtggtcgtatgcgcagaacaccagatgcagaatgacaaggattatgtggtcacatcctggctcgacccttcattagccacgtgagttagtcaagtccctcccctccctctgtttctctatctgtaacgtgggggagggtaagagtttctaccctgtagggttgctacaaggtgctcctctgagataacatttataaagcacttagaatggtgcctgacatatagtacctattatataaatatttgctactattctcatcaccatcattataagcagtagcagaacacagccgtgttaatatatgcatgggctgtctctggaaatgtatatgagagactggaagcagtggctgcctctaaaagaagattctggagggtgtgggagtagatggtcagaggaagattcactgattgacagtacccttttgcagtgattgagtttctgtgtgcatttgtttcatgggaaaaagcaccaaatttttagaaaatgaagaaattgggccactaatgagagcaaacgtttttgagaagagtatctatgatgttcattatgactcagcttggagtcctagttaatcacaggtggctatgcacagaccatttttgactctagaatagcagctttctggaatgggaccctcggcccagcccacctctcacgcccgctggctggattaggatgccactcggctgctcgcctcccaggcctccacgcctcatcccttaccctcaccttggtgactctcatccacctgggagagtcagcccctcgctgggccattttcctgtcccaaagccttctctgacacccattttcccatggcacctggtccaagcccctggggctggctttggaggtcctctagcttgtctgaccacacccatctgtccaggccagcctccccatacccacacttcctgctcacatctgtgacttctgtgaggggcactcagctgtggttctggtctacctgggtccaaaccagctctgctcctgaaggtactggctgtacggcctggatggcctttccctttctggcatgcagggataacactccccaccagcactactgacaggggtggtgggggaaggaggtacatcctcggcacagggacaatcccatggtgccttcctctttcctgtggcctctccctggctctggctgcccttccataactcagggtttcaatccatgttaaatatctgggggaggccacaggacagggccttccccttgaggaatttgtagttcagctcagggcccccccgaaatcacagcccttaatagagtaatcaagggcttaggttctgtgtgggaatctgtgagggaagtgtgctaaccaaggactaggccattaggaaaacctttatataaaaagtgatacatgataggtaaactgaggccaggaggaaactggaaaggtgcaggagaagagagcaggcacatccattggaaggtggagggcagaactcaatgaggaagacaaagactcagttcaaatgcaaaactgaagcctgcaatgaaaaataagccatttttcaaaagcagaatgtgtaccagtgacagtaaattgtgtatttgtcacccccggcacaacaacagctttaaggacttgtgtaaacagcacaaaaaaatcaggggtgttagccaaggttcatggtattcgcaaatggcatcaatattttgactagtgagagctcacgagttgcccttgttttctggctaaaggctttatgcttgcattccttgaagacatctgtattattgtcatagccatgaacccaccccagggaggcagcaatattccctttccccaagtcatatgactgtggccttttgttttcccctttcgagggtttgctttgccatttggtgttaaaaagcttttgctcacagcttgcttcttttaaaacagtctgagagattacagagaagatagtgaaactccctaaatcacacactgatgtgccctctgtagacatgtcttagttgttcctgctaagggtcccaatcctcactccatcccagcagtatttaagtgactactttgtgcaaaacactgtaatgaaattgggaagataaaacttcgccctagccaatgaggatgagctacagcctttcctacaacagcaaagcccacttcgaacttcaaagaattcccataaagattaaaaagcaaactccaggcaggcacaagtcagcctgctgaggcttggccatttgtttcccaactgttacagagctcgaaagctctcaatttcgcccctgccaagatgtattccatcagagccttctacataaatcacagcttgtgatagatctgttgtttcagcctcaagaaactgttaggtctgagtaactccaggaaaagggcttatcctccgggatcataaatcttctctcctgaccgtcatgtgaaacgcatcacactgcttcaaatgttccttccgacgcatcctttattaatgatgcctttggttttgaccatttggaatgttgaatgtatatcaaaagcccagggggcttcgtaggtcagggaggtggcctccctccctgcctggaacttagccaggccaccagggtgaccccggcagaaggccagaggacattgccttggggccaaacagaaaattccagattttgaaagatgatccatgaggtacccccaaagggcttctcatccacatgcacaccctgaatcttcagttcttgaggccttttccctataacttcccatgcactgtggttttgcctgaaatcccacatgacaattaaggagaatatttttctgtttctcctgttttcttggtgctcatctttccaactctgagctcaagaatcagggatgtcagcaaacaaatcctggtacattaataaaacaatgtttaattagtaaaaccatgagagtgagaatattttttataagaaaactgattaagatgaatgcacttttataataatcactataaaaggctaaccattagttacctaatgaatgtcctaaatacattgtgatctttgaaaagatgaactaaagtttacccagaagagagcaaaggttactgagaaaaaataatcagtcccatagctttctacaaggaagaaaaataaatacctcaaatttatgaagttatcataggaaaacagaaaagcctgtgcatttggaactttttttttttttttgaaacggagtttcgctcttgttgaccaggctggagtgcaatggcgcgatcttggctcaccacaacttctgcctccagggttcaagtgatcctcctgcctcagcctccttagtagctgggattacaggaatgcaccaccatgcccagctaattttgtatttttagtagagacagggtttctccatgttggtcaggctggtctcgaactcctgacctcagataatctgcctgccttggcctcccaaagtgctgggattacaggcgtgagccactgcacatttttgctccatgtaaattacaatattttggccaggcatggtggctcacgcctgtaatcccagcactttgggaggccaaggcaggtggatcacctgagtcaggagttcgagaccagcctggccaacatatagcgaaacctcatctctactaaaaaatatgaaaattagctgagcgtggtggcacaggcctgtagtcccagctacttgggaagctgaggcaggagaattgcttgaacccgggaggtagaggttgtagtgagccaagatcacgtcactgcactccagcctgggtaacagagcaagactctgtctctcaaaaaaaaaaaaaagattacactattttctaattggaaatacaagaagcttttaattacatggaagtataacgtaaataaggattttttggtactaggtacttcagtcacactgagctgctaggaataacagtgacatgattgtgattataatcattaatcattatcagcaacaaaagcaaaatacagttgttgagtgtgtgtgtgggggggcagggggtggtaactatcatccacactgagatacatttggagtgagaagggacactataatacacgtgccccgacaacaggcgtaacttgggccatcacaggtaaacatggacacgtattccttctaactatgttgttcacctaactccacatcaactcaccaaggtaggtattcttatgcccattttgcagagggggaaaccaaggcttgttcaaggtcacacagctggtgaacagaacagctgggcttggaactgactgctatgcattgacttttctgggcagactcagccaacaagagacatactgagggcatcttggtacttcctccctgcaggtgcttgggtctgtgaggtacccgaggcagaacagatggcaaaaccttcattctctgtgaaagggcctgagaacaggtactgtgggaaggggagcacaaaggtgctgggcaatgggtctgccttgccagggcctcacacacccatcccacaacactggcttcatatttgctttatccatgttcaaaggatatccaatgtctggacacaaaagtgaaccccagaaacaaaccctccagaggcagaatgtactgttctaccccagttctcatgtggcattaggataagaagggcagctgccaaattaggatctgtagagatgtccggggttatgataaaagtgagacatttagatatttgtgataaatattgatgccaatgcctccctcccatcaactgcacagctgcatcacgcctgacctcgtgcttgatgctttacagacatcacgttgaagcctcccaggcctgcaaggtaatgttaccctcaatttacaggtgaagcaaatgagacagagattgcaggcagtaactaacagggccagaatgtggtgccaggcctggagaacttcacaggtcccatgctttgctctgtagttgtacaactctcatggctcaggctatttggggtttgctcttggataaaaaataacaaaaacaaaaatccattgctacaacttccaaaggatttattaccccagatgtcatgcctgacgacgtgtgacctctgagatgagggcctgttgcagtcgtccttagcgcctcgaacagaggtcctggtgacctgcttcgggaggctctgctcagattgaaccattggtgtgacagccacatcacctcaggcccccatgccttttctccccgtgggccagcagggaacctttgctaatcaggacttacattaatctctttagctatgtgcgacacagacatcagtggtctttttcttttaagattggcagagctataaaatgtccacattttatagagaaaaggaatgtccataaatccaattgtaagtgttactacgctattatattttaacaactcagaggtttctggtgaaaatccttatagttgaacaaccttagttgaatataatagtttataattgacatagatatgttgcaattgtctagaagccaacttttctcacaaagtttaggttctgtgagacaatgagtaaatttagatgctgttagttaaaccatccatttaacgggtacattaattaatgccacctatttaaagaaacatttgtttttggatagactttcctcttattatcagacaattctgggcaagtaaaaaaaattattgtcagtttgtaggcaaaataggaaatgggctttcttcattgaactagacaatcaatgggaatctacctgaatcatatttgtccaaacaaggccactgggaattggaaatgagatggaaccaatggggagacaggagctggaaaattctggattttgcagtggtcataaagcagctcctcgccgtaccaagtaggacgtctctgaatctcagcagagactcagcccctgtaggaggaggctgagaggtctccttcaaggatgacacatgcccacagggccagccagccattcggaagcctccactcttcagagacatgtgtgtctgtgcgtggcaatgtgaaacgtgactagggcttagttaactctctgaagagctggattcttgattcacgataacaatagtgacggtaaatatttgttgagtactcacgaggtgccgagcaccacacagcactttctgaagtaggtgctgatactacagtcctgtgtatagctgggaaacagaggtcagggaatgcaaggaactggctcaaggcttattagccctcacccttaatgagggtgctgtgtcatgtttgttgtgcctggagaggagagctggataaaacacaggatgcctagttaaatttgaatttcaaatgaggaaatacaagtcaaaattcaccccaaaatcaattcattctaaaatgatttttgttgttgttgctgaagtatgtcttgtgtaccatttggaacatacttataaaaatgattttttaatctgaaattcaggtttcaatgggcatcccatatttgcatttgctagacatcgcaatccttagtgtcctcccttctctgtgatgctaatgatgggttccaaagttatgaatgctttgcttataaaataattggctttgaaagtcttacccaatgtgagcagttggaaagtctaggaataattgtcacctattaggagccgctcctcccagacacaaatctggcagcatctgtgtccctcttagcaacttcaggtcctttctctggggcacctgtgggttcctgggatcagtgccttggggcagggaaacccgcatctccagcaggccacatggaggcccagaggcttccagaacacattctgatcccaccccgttaggggacgaaacaaagcctctccacatcattggggcacttgatgggcagttctcagtcatggaagacttcagttttgaagatgatggaacaacacaggaaatgtatgaggtagatttagaagagaaggaggctgggtgcggtggctcacacttgtaatcccagcactttgggaagctgaggcaggcaggtcacttgaggtcaggagttcgagaccagcctggccaatatggtgaaaccccgtctctactaaaaatacaaaaattagtcaggtgtggtggcacatgcctgtaatcccagctacttggcagtctgaggcagcagaatcacttgaacctgagaggtggaggcggaggttgcagtgagctgagattgtgtcactggactccagcctgggcaacagagcaagactctgtctcaaaaaaaaaaaaaaaaaagaaagaaagaaagaaagagaagaaaaagaaaaagaggcaaagtactgttgacatttggatgtaacatgcatacaaaagataaactaacaattattattctcaggttattgacttgtgggtgattttaacatagcgagcttctactttttttatattataacatgtggacaaggttaaaatgcttaaaaatctcttcaccatctgtcttctctctcacttaaggaataggaatttggccagcaagttgctactcattcattgttcgcatccaacaccgaggagacagaggtgctgaaatctgtcacagggggcaagaagcaggtctgaaattcaaaggagctggaatcctccttctcccaggagattagatccttctcattctccccaaagaatgacagggctgaaccaggtgctacgaaactctactatgttaaaagagtaaccaaagctgtcactcattaaacgtgcccaatggtggcatcttgaggccaatgcttccctctaaaccaccaaactgtcatagaccctcagaaccagagtgccaggttaggtcacaagaagtcatcttgttctagaccacccactggctgtccatcagaagtccccctctccagatggctgtctcctgaggtcctcagcagctgagtttggcccactttgaactatgatgctacctacacgtcacacgtgaacataggcattacacggaaccatgggcaccgttcttctctggaaggtactcagttacagggactgctcataggtggctagcctttaggattactgatggcatattctgggtttctgcataaagcttttgtttgcagagaggacgctgggttagaacatttatttctataaaaaaaaagcacctcattcagggcaattcgcctttgaggtctcacgtgaaattgaattggcaggttcataaagcatggtgccattcctcactgtgtatctttgggaaaatctgttagcctctctgtgagtcagttttctcatctgaaaaacagggacaagtctcacttatcccacggggtggttggaggaagagcccggcacagtctctgactcccagtgagtgctcggcataccagatatcatctcttcttgcaaagtggcatccctggcttcctggtggccccagaaccgagcacgccagctggtatacaacagactcactgggggtcctttggtggctctgatcagcatgctgatccagagagttgcctaaagcttccatttggggctctcatcctgcgtttccggggtgttttctaaccgtaaagaagacaggcatcatggtactgatttcaattttcaggaatagttggtgatagcagaggctgctgagaatctgcaatttcacacttttatagatccagagtcagtagataaaaagcatctagtcttcctggctccatatactctctcatcccaagctgctttctgactctccttagagatctcagcctttatccaatgcgtagtccaatttcttgggaaattagacttgcaatagaaaattttccattgtttcacacagggccaagggaaaaaagcctatgtcagctgattcatcatacttactaattgttcctgcgttctttggagatttagaaagcacagctctgccaaatctactgaaaatgctttattcaaacatgaaaaatagtcttcattttgcctatcgtttttcctatcaatttatagcctgtaagttttcacaagtccttctacttaggatacaatttgggggaagacttttgcttataataagcacaattctaaataaacttgtgttattcaatctagttgtttttgcttccttaataagtctaaagtataatgctctgacatagattcgaagttgatttcaaagaagtatttctcatatttcagcttctgcctgtcacattcttctgctccctcaaatcagctgaggttctaagcaccaaggagatgaacactatttgtggatgggagccatttctccaaggaaatgattctgctgtctgcctttgccatacataacacacacaataaaatgaagaacaaccttctattttgaatgcccttgaatgcttgagctgagagcctaataggcatctatataaaatttttaaaaggccaccactcaaaattgagaaggaattataagcaagcaatgttaggagaacatcctcagcagcacctcccagcacatgcctctatagtacgagaagagcagcccgcgtggcccttcctcaccacttcatggtgtaggacgtgggccgatgccaggctcagggacagacacatgcaggacagaagcactgtggcatgaaagaaaattctccacggtctttggtcacaattactgagcctcagcagcaacactccagttgccagagggaggggaaagctgtgcattgggcatgagtgctttcatgcctggacctgtgctttatgtgaggccaatgctggtactacaccagctagagccatcccagcatccctgggggttcgtgcccagacttatagatgaggaaactgctacctaagagatgctggatgactgaccaggatagtacggcccataaaacgtgggacttggatttgaacccggcactgtcctctcagagtggaactcatgacccccaccagctaaggctgtggggctccagacatctggactcctggggagggggcctggggagagatgcgggaaaggcagcttccaggtgggtctctggtgtgatatggagctgactgccctcaggggagcccagagagggcctgacttggggcccctcctcctgtccttccctgtctccggggttagagccaccctcatgttcagctcctccattcttagacaggtcctgcaggctccaagctggggccatgctggtgaggggagtcccaggagaaagaagagctccagctggacacacctccagctctgggcatctccttccaccagggccctgtcttgccttcctggagctgggagcttgcagctgctggactctttccccagggcctttctggagaagaggtcccccaggcaggagagggagaaacaagcacaggaaggatggacagtggctcttctggctcttagaaggctctaggggatggactcttggggaggggcctggggaggtgcctgggtggcggtgggggcgttgcacggcccttgtcacgaagggaggttccaagggcatcttcccataatactgcagtctttagcccgtggcttcacctgaatcacaacataccagctccagagcccctctgcttcctgccttccctggctcaccttggccctggactgccaaagagccactgtcacgatgtcaggtcaaacgtctgttgccacctacaagtgagcaggaagggacacaggagaggggcgtgtctggaggcactctgcagccccagccagctgtttcatggaggatcccaggcaggtgctgcagcaggagacgagggagcaattactcgggaaaagtggacatcagggaagcatcagagccaagccagtcccgccaccctcctcctctacgtgaacggcttttgttgtcagtcacagatactgctcctgccgcctctgagtcaggtttgggagtgagaagcaactctttagaaagggggcacccccgaagagggcgggatcctctgagcccactgtttcgactgctttcagaggaggctgtgctggtggcagaagggcaagaaggcttttttcaaggatgaaaaacattcctgaccatttgtaccacatacacctctgcccgacccctggaaagggtggccaggagctggctgcctttgctaaagcaccatgtatatgttttctgttgtgtctcaagattcaaagcaaggaggtaaaagggaaataatgagaaaggagttattaaaaaatatgtcacacacttggggagtcagagtttgaaagctgaatgctctctgcaaagtttcctcgttaagtgttcccattttgccggtgaggaaacacgcccagagaagtaaagaaacctgcacgggatcgcacggcaattagtgtgggggcagagccagagcttccgtcatccatgcgtgatcctgcccgatcatttggaaaatcggtttttagccgtgagcccgactgcataactgggcggaggtgtgcgtgtgttcatgcttcacacgtgggagtggaaagtgagcatgtgttcaggctgcaaaatgagggcaagaggggcctggattccccttcacaaagcagactgacctggtcagccactccgataaccagctggaacttcagcacaaaccatgttcagcttttatcaccaaaataagcaaaagacttcagtctgaaccatagctcacagaactgtggctgggaacgttgctcctctctgaccttcctggaactgcaactgggaattcctgcagtcacaacgcaacccttacaacgatgttacgacaggatgtaagagcccagagcgtggtaactccagcctcccttccaaatggaacaaagtcgaagcctttcgcagctttaacagaaatgggagtgcggagcaaagtttatcaaacatgaaatgggcatctggggttcaacttgagtaccctcaaagggcagcagggacaggcatcttatgggggaacagctgcagacctaagatgtctggcacagaccacccgtgcaagccaggatggtgctctaggcacatggtacagatgggttaaaggtgacggcccagcaatgaaaccgggtgctctgcataatccctggggaaaggtggtggtggggggagggggcggggggagtggggtgggagtgctgttctttcagccactggatgtcagcctgagcaaatctctccaggacagaatcagaaccatgtggaaagaatgcacgagttcaggagcaggaataagaggagaagccgggtgggcatgggcgtggctggtgggcacatgccttgcctggtgaggagcttctgtgtggaggggatgcgtgtgcagccctgcgttggcaaggggtgtgaaggcaacatgggcacagctgacatgcatgcaatggtggcgctgctccagaatcacatgtcatcacaagaggactgggattgggctgtcgactctgacgggcctgagcctgaattctggctctgcctccggccagctgagggaccttaggcaagacttagtttttcatacctgcaaattaaggttaataattatacctcccattcaagtttgttgtgaaggctaaatgagaaaaatgcatgtagagagcttggcttgtagtaagtgttcagtaattgaggacagaaatagtaaatgttcagtaattgaggacaggagccaacatttactgagcgattactatgtgccaggcactttaccgggtgccaggacacaggacaatgatgactgactcagttatgccctcagagcttatggcctgaaggactaaggctgttttgcaaactgcactaaatttctgggtggaaatatgaacatatatactggccaagtgaaccaattcctgttttgctctctgttctccttgatgcttgttctctgaaaataactgcttatcgtacagcagattcaacaataacatttctatgaagataagtgtttcctgctaccaccagcattaccaccatcactatcatcaatacttgccctgtcaccaccaccatcactatcattatcaccaacatcaccaccaccattaccatcaccatcattatcaccattgtcactaccatcaccatgatcataatcaccatatcaccattatcactaacaccaccaccatcaccatcatgcccaccactattaccatgattaccacatcatcaccatcgccatcattaccatcatcatcgtcaccatcatcactattatcaccatcatcattgccatcaccacctgtcatcataaccacatcaccgctgttatcatcatcatcttcactattgccaccatcatcattttctcttcatcatcaacttcacgcacattgtgaggcacttagtatttgccaggccctttgttaagccccctacatagacgatctcattgatgttcaagtagcacacttttttcatgacagcatgggccagcagcaggtacgacacacaggagcttgttagaaacataaattctcagtccgcaccagacccaccgattcagaatctgcatgtcagcattatccccagtgctttgcaggcatgctcacgtttgagaagccctggcccagataagaagatggcattcaggaaggcaccgtgtctcagcagaaagtgactgctttggagagagtacccccatcacctttctctttcccctccttttccttcccagggaccccactgaacaatccttctgacaacctcactaggccaagaaaacaaagaggcagaaaaaaatggcaatatttttgtgaggcagagagagagctgggagtggagaggacagtgaggagggagctgagtcatgacagatggtgagctggcagcaccccccagagccatgcctttcataccattcatatcctggagtccctagggaggagacagtggggaccttcctgtgatgattcccctggatcagggtatgtctgggtggagacgagcttccagaagccaggggagggaaaaggggtcaaggacggccccagacactgccagtcctcacttgaaagcagataggacatctgatggggaagcctgcacccctaacaatgcttgggttctggaatgaaaatcaagtcccattgacaaaagcaaatcaacattttctgaaagttcacaaagtcgtaactgtaccccccaatatgccaacaaacgattggtattaacaaaggcttaacacttggaatgtaagagtttttgatccataaagtgcatcctaagatattttttccccattcaacttccattaaatgcatgattccaagagatcgtttcatataagaccaagaactgggtgctgaaagaacagaagtgaaacagattttcaaaaagtaacttcaaatgtacaatgttgggctcagatagaaggatttaatttttataaaaccctaagaaggtttagttgtatttttaaacatatgttttttgaaatacttaaatagaaaacatcctactcataagtctatttcataccagaatgaaatcagataattagaaatcatgtttctagtagggtatttttacactctggaaatataagacaatttcctactaaatgaaacactttgttgcacatttttgtccttcctcctggagcttttaagttctgattatcaggaggaaggggtggactttaaattcatccttctgcccccaaaccatgctctgcagtagacatgggccaggcctcccacccatgtagctgaagcttctgatatgttcaagcctcctcttttctttaaataaaagtggctgttttctttgcaagtataaaataaaccaaatgtaaatccagtgattaaatgcagtaagattttatagattaaggttaaaaaaaattcttactggcagtgtgtacagagggttgtcagacaatataaaatcaattggtatggaaagaaagaaaatccaatacctttttgtggttcccctgtttaccaggaaaagaacaaaacaaaagagaaaaacctgagatgaccacgctaatggaaacacttctgcagggagcctggggatttctttacccaagtgatcacatgtgcagatgccctcagagcctccccttcccaggaggcgggcaggggcttccggtggagggagaggaaccaggaggtgggcaggggcttccggtggagggaggggaatctaggaggggaaatattatcaattggcctgaaagttcttaatttgccttttgagaaaaagcctgtaggaaccaaattccaatcctgtttgactcctgtgacttctcagcctcaattctgggtttgtctgggcatggcagttctgaggataaattatgtttgatgcatttgaagactttcattcattttaatggctgcataattgtaagagccttttaaaattgtttgtagaataaaaaagttatatatattaacttgagaaaattataaagaataaatttcaagtctccaataaaacacattagaaaatattaattagcattgaatgtatctatttccttccattctttccctatacatgtgcattctctccctctccctccccctccctctccccctctcttcctcttcccccccactgtctccctccagtcctattctctttatctctcccgcctccttccctaccttccactcactctttctccttcctccagttgcaaacctcacttttcctttgggaacccccttcgtgctctgttcatgcctgctgttcagatggagctctgccccgtattccagtaaatgctcgaaggcatgattgttaatctcttactgatgtcatgcttctgcgctttctattgaagactctcaaggcccttgtgacctggccgctgccgcactctagtatcccacatgcaggtgctcaacgagttgtgcttctccagcagtgtttggcccttaaggtgtcagtccacatccttggcttggccaattcctacctgccctttatatgtggctaattcttactgatccttccattttggctgagctgcaacttcctccaggaagccttcttgtggtactctcctttcctgtcttaccaagcccagggaaggttccttttctgtgtgatcttccagcccccaaagcactcatggcattgggctcttatggccaaattacttatctgtacctcagatgcagggtacactcgtagaggggtcagggactggatctgtttctacccgcccctcacaccttatatttcctgcagctaacactgctcctggcatttatctgacgttcaatacaacatcttcaatgcctatcatgaccacactgcaatgaatatacttttgcatatgccttgggatacactatactttcctgaggataaatccctgatgtgaaactgctgagtcgaatgctgtatgtttaatattcttaatatgtatttctaaactgctctaccaaagggtgtatccatttccactcttccaaactgtgtaagaacccacccactctcctgaaactccatcaacaccgaattgtagtttttaaaagctttgccaatctgatagatgaaaaatatgacctcatttgaattttcatttaagtataaatcaattggaatgttttcccacatattcattagtcatttgtactttctttgtgattgtcttaagccctttttaaattcagtgtgaacgtcttttgcttcctgatttgtaaaagctcatgatatattcactatatttatgctgccaatattttttccattgtatcatgtgctccttgtccttgatttggatattttaataaaaacaaacatttttaacttacagattaactattaactattgcagtcttatcccttagagttttttccctttacctttacgttaagctaggacatgcattaaatctaagggaattgtgtcctatgtaaattataaaacttgtgctttagaaggttataagttcaattttagcaaccaaaaacattttattaagaacgtaagacatcaacttaaagggacttcttcattgcattgtcctgtaaatggaagcatcttctgaggcccctattgacttttgcctgccatatactgtaaatctatatattcttgtactttaatagctttagttttaaaaatgatttcttcaatctactagaggccgaggtttgccagaatagtacagcccattaagattatttaaagtttgcgagaaacttatttactatatttttttcttctctgtgttggaacatttggctttctttttccagggtttttataacaacgatgtcttcttaggaactttgaaatcttaggagggaggaaataaggcaacagaaatagaagattagtaggaaaaaaaaaaaagcaccagctattgggtcctttataccatacgaatgtcttaataatatctacccttaaagcaaaactgccaccctccctaattctagctactgcgccatctatagcaactccctcccatgagtggtcgtgatgtgctgcttttcttaccttccatcctctccttgccctggcgcaggactcctgtctctaatagggatgtcaccaaggtcacccattacctgctctggtcacatggaaagaccagttcttttcctgatcttattctccccacattagcacaaggccagcccaccactctctcctcctggcaatgccttaggtcctgaactgcctcctgcctcggggcggctgctctctgttggcgcctcctcctcttcccaacctcagtgtgttgggctgtggaggagatacaaagggatgaacgggattggtccttgacccacttgtcttccatgtcttctctctttaggtgactcggtctagcctcagtgtagattcttttgatccccaactgttctttctcagcctgaattctagacataaccaattgcctttctgacatttctacttgaatgtccagcagacactgcaaactttatataactgaaaggaattctggacatgagtgtccctcaccccattgtttcctgtaatgggctgaatactggcctccccaaagatgtacacattctaattcctggaacctgtgaatctgttacttcatttaccaaaaggactttgctgatgtgattacatgaaggagctggagatgaaggggatgatctgggtgggcccaacgtaaccacaaaggtccttataagagacaagcaggagggtcagagtcagagagagaaattagaagatgccacactgctggctttgaaaacggaggatgaggtcaagaaccagggtatgcaggcagcttctaaaagctaaaaaagtcaaagaaataggattttcctgagaggctccagaaggaacacagccccacccacaccttggttgtatcctagtgagacactaggattcttttggacttctgacctccagaatggtatgacaataagttgatgttgtttgaagccatgaagtttgtagtgatttttttagagcagcaaaataggaaaatgacacgttcaccagcaccaccagaaaaccccacatggagccaagcaatctgctctctctttgttctcctccttctcaactgacacctgcactgtcccctcatcttctcaggccagcatcttagatatcaacctttcatcagtctttttctcttagatatccaataaatacatgctcagctggcacatgtgcagcaaaacgagtgacttgtgaagatgacatattatatagttaggcagccatgactggagcccaggtgaaaatgatgagggttagaactagacaaatagtggtaggactagggaggaagataaggaatattaaaaatatttagaacagaaattccacaggatggggacaaagaggagtgagtaggtaggtggggtcactgatggaggcagaggaaggaaggacgggggcagtagggagagtcggtggggaaagatgtggcatctcgatatgtttctattgcatttggggtgtgcgtggaagacgtccaggcagaagagcatcccctaccacagtcaattcaaggggcctggggctgggctttggggacagatgtatgtgggagatgtacacttgggcttcatcagtgaagaggtgggagttcaaggatgggtccccatgatgcagggtgtgcgggagaagaacagccaagggcagaacccggagggcaccagcatttcagacctgagtggagaaggagcagtctggaagaggtgggagaggacccctgaggagtgacagagaggatgctagaagagcctcgtcacagaaccaggtaaggagagtgttaaagaaggagaacctgagggactgtgccggatacagtggagtccacatcaagtcagcctcagacaaggtcctgctgggggaggagggtgtgcaagtagcagtgatggggataagaaccagcggggaccaggagtggagaaagagagaaaagtagagaggcaccgcagggcccacatggtttgggtgggcggttggggaaaggaggcatagttttaaggctggtatatgttgtgggctgcatgggagctaggaaggagggagaggctggagacagacatgttctgcaggagataggaggattgagcctggctctccataagcctcaaccatctcgtgggagctttctgcactcgtgggagtgctctgcaattactggacacttgtgaaccaaatgtttctaataaggggactccctccactcgcatattttaaggtgagtcccacctgaattggaaatgcgcttctcttactgtagaagcagtctttgatctatgataacagatgaagtaagtggcaactgtgtttacattgcacttggtattttatgatcctttgtatgcataattttgtatcccctaaggttctataaaggaaaagagaagagattaaggaaccggcaatatatcattgttatctttgcgtgtgtatgatgggaaaataaacaggcacctattttacagtaaagatagcataagctggctgtagccgggcctcccgaggaaagtaatgaagaggctgaaaatacacagcaggcggagtacagaaattcccaagctcatggacaggcacaccactcctatacaaagaaaaccaccagggaggagttcgagcatgtcaaagaaaaaagatgggaaggaaggctatcaaaatggaatgagattctgcgtcatttcttctttttttttctcttggcttacttgtgcttaatttttatgtaattatcatgggctgcatttgtaataagaaaagcaataatagttacaattaaaactgcatatgttaataaaaactcataagtattctttaagcagacacaaagcagttcagtactgtttgtttgtttgaaagccagttagattcctgttgccaaatctcaaatatacaaatgcagattaacgctgcatctaatatccaaacacaggcttagaaaacagatcagttacaacgtttctagttcaacaagacgactcctttcttacttcccatgtgcctgctctgcccagtaatgagttgggtatggaggaggatatggagagaggtgcagtgtagtatcaaactcagaacttgcctggcgagaaacagaaacacacacgcatcctgacagtgtccacctatgtggatgctcagccttgaaaatgcagatctgtatttgcttccatctgtgtgaggagttggagaggcaagaatggtgctgagccagtgatccggaaaacaggaataactccaaatggagggaggatggatcaggccaacgctcacaccaggcaataaccaaggaaagcccaactgctaccagtgatggctgaggtgccaagcagttccccatctcagggtcaaaggggcacgtggagagacctacaaatcgtaaggtggcatgaacaaggcatcacactgcaggcagaaaccaaggcaggtctcccaggtctgatgctgcaggtggggagttgagacaggcctcctgggactaggactggatggacatgggaggagatggaagagttggggaagctggcagaggggtggaaagggtcgtctccacgtggcacacaaggccagactcctcacaggtcgatgagtccaggccaggccaccgcaggttggggccaccctggaagcccaggcacctgctgctctgtggcatctgcctcaggtgacccatcaggaagccaccccccagggagggacctggcctgactgaccggtgaccacggccttgagggagagtgggcttagtcaccggatgaacctcaggcctgggtgtgtcggaggaggctccattgcctccaggcagcaacacaacaaaagcacaaacctggctactccagagcaagagaggacacatctggaggacgacaggaagaggctctgggagagatgagaaccagggagcgcggaccgctgggctccaagtcgggcccctgggtgtgagtcctggctctgccctcactggccttctggccttcctcgagggacttgaacttgctgcaggagcgtgcctgcatctgtgaggcgggctcgagctatctcacggggctgttggaaaggcagcagcggcacaccgtccagcccagccacactcagaagatgccaccaggatgcgtgtctccttctccagcctcctcatccctttctgctctcctcccactttctgctccagatttcaagggaagaaagggctccattgtttacaaatctgcttacaaaccattggtttccaagaaaaataatggtcgtgttcgaggagagtggcagtgttaggaacaaaagggccaaatcgcagggcctggcaactggctgggtaagcaagaagcagggtgtggggtacacagggatctgggtcaaggggaacacacggaggagggggtggctgtaccatgggctgcgcaggacctggttggaccaaggggctgggggagcagaggcgagggcagcccagggcctggcagacagggagacagagctgggctggagagggcatcttgggcaggcgctgaggctctgccagggctttgggttccaacctgaaaaggacaggccaccagcgcggaaggaggaagaacacatttgcgagttagaagggaatgccctcacttgggagcaaagaagccaggggatgctggagctcagcccagagagtgtccgtggagacaagaaaaggaaggttatccaaggttatccagagctatgcccaggtggcatcaacaggcctggtgccctgggggaaggctggggcagaccctgcaactctcgagtgtctggctggggccactggtcagatggagatgccagggcctgcgatggggaagcccccgggataagtggggagcaggagagcaaacctgcgagctcaggctgggatttgctgagtctcagatgcctataggacagctgaatatggacagcctggtttctggaaattgtcagactcatctggaactccagataaatcacagcctgggccacagaggtggatactgcatgggagagtgtggaaaggaaagcaagcacggctctgcggggggagctgaatgagcactcacaggaaggagcactcacaggaaggagcacccacaggaaggagcactcacaggaaggaacacccataggaaggagcactcataggaaggagcacctgtaggaaagagcactcacaggaaggagcacctgcaggaaggagtactcacaggaaggagcacctacaggaaggagcatcacaggaaggagcacccgcaggaaggagcccatgaaggaaccaacagatctctgaggatggagaaacccctggggacagcacccccaaagccaaggggcagggccgcctcctggaggaaggggtgacaggagccatccaccctgggcatgggcaggcagcatgacattgcctgcagagaatgtaaaacaatacagagctgaccagaagcctcctgctttttattatcaccatgcattgcccattctaaacaacatcagtgataatgctctcctccctgcctgggccagcctcgcccacaacccctccccccatttccccagatgcgtctacgttaattaacatgttttctagcactcttcaaataaataccctcatgacacatctaattcagatattttctttaaaactgctgtgttcccttttctggactatgagatacgtaaccccttattttattctttgccttgcctgttagaactctatgggaatcttttgtgtgtttgttggcctggcaacttaaaattaatttgaaaattttcaaataatagggaaatagagaggacttctattattctattctattctattctattattctcagaaaaatagaggggactcccctatacccatcaccccaattcaactatcattaacttggggccgacctcatttcatctatggcagcacccgctcccccttcctctcactgaattattttgaagcaaatcccagatatcttcactggaaacacttcagcaaaagttctgctttcaaaacatttcttatctacaatatcttcatatatttttgtcctcctccttccctttttctttctacttggttttcatctttatactgggctgtgatccttattattttggctgtgccacttcaaataatatttggttataggtagagcctaaatgaaaatcatacgtttgtagcaaaacgttcccaatcacacgctgacaatcagcccattgcatatgatggcccaggttaagcactgcacagcttcagaggcccccactggaaagaactctaatgcaaatcctctctccagccctagagtgatggggtataaagagcttgggacaagctaggatgacataaagatcaaggtgtgtcattctgtgctctcaacagtgcccagcacagtgcactgaactcaggagtgacacaccgtttgttgaatttagggatgaatgataaaagaatgggtgaaagtgttggccctgcgatggtacggaagaaaacaaagcaacgacaattgttagctacgcaaaatattatccaaagcatttctttaaaaaaagatcattaaaatggttttatttgtaaaagtgcaactttcattctgttttaggagtacatacattgcgtaaaataaggtccttcaaaacgcttcctacaattgtattttaaattaaatcctggccgggcagggtggctcacgcctgtaatctcaccacattgtgaggccaaggcaggtggatcacctgaggtgaggagttcaagaccagcctggccaacatggggaaaccccatctctactaaaaatacaaaaattagccgggcgtggtgatgcacacctgttatcctagctagtgacaggctggggcaggagaatcgcttgaacccaggaggcggagattgcagtgagccgagattgtgccattgtactcagcctgggagataagagcaaaactccatctcaaacaaacaaacaaacaaaatttaattaattaattaattaaatcctgagagttcaagttctaaacctatgtgtaaccattttactatctatatgcatcccaaaactgcatgttgcgtactttcaatatacaaaataaaatttatttttaaaagttgtatgtcaaaaaacatatagaccattctagaaattaacacaagaacatggaatgtaatacccagaccaagaacacgtacaatattatgcttaaatattgatgtcattacttcttccaggcaacagctcataaaataaatccatagttctctgccagctaagaagtcacaggaaacagaaactccctcaaaatcttagcctgtttctgagggtaaacctgagatttcatgggcactcattctgctctgctacatttttccctgtctttcttttttataaagaggatttgcttcagaggcaatgcagacaaatgaattattcatagagaaagagataaaagagagaaggtttcagggactaaaatagttaggcctcaggttctatgagtttgatcacattgactactaagtaggcatcttgggagctgaaataaaccaaaattaagaagtaaaaatgatgtcaacaagttttttagcatgcagtaagggagaaccacttccagcaataatgccagtgttaaagattagcttttgattctgaactaattcaagtaacaccacatgtacatataactgaacaatgttttctagataacaggtgggatatgtaacctacagaaataaaaattatataggaaaaagaacctcattgtttccatgtatctataagaaccaatgtactactggatgaaaccatagcatagaatatcaagaaggcatgtgtggataaagcctttcctataggatatgacataacagtgaattttttgttgaaaatttcgtcagtcctacatttataaaatctgtcttggatttttaaccctcaactttctggagtacttgggggtgtctagaccaatgtacagctcaaagcttttgttgacaggggaacaaatccgacctttctaaaataaatgggtatggggtaacattttcctttcagaaattcaagcacatgacatttatttaggtcgttatttcctccaagagaaaaaaaaatcatcttaagatggagaattacaacagaatcctttattgtcggatctaaggaattatgacatagtgcacgtttgcaactttttgatcacaaatcctaatattagactctcaaaatcttgtgaggttgaaagagaaccattcacgtcattcagaactatctgattatgtattcttgattttctggtgggaattgaaatttggcccctttctaaaggaaggccagcatcttgccccatgatgggcaggtggaatccatatagtaggtcctaggtgagctctggttggtgtggcttccaaactggggtcttacacccaatcactgggtgtccactgccgtgccccctgccctcctcctccatccttccgtgccaagctcaggcagcacatctgtcctgctctgcccggagtcgactcagctccctcctggcttgctgtagcattgcgtctacactgcccattggtgcacgcagtgctcagcagtgaagtgctgtatccattgtgtgatgaccagcccgagggcagagacctggctgagcactgtccttgcctcccactcagtgtgtacatagctgaggactcttcaccagccgaaggggaactatacaaccaagacaggcacaccctttaaaatattcattccacagcactcattaagctctgggcattgtggcacaggcgatgctctggggggcatcagcccctaagagcgtgacagaagttgcacctgtgctaatctgtgcttcagctgggccttggagacaaagcaacaggagcagaatcagtccctgtcaatggcattaagcatagtggaggagacctacataaaacgagtaaacacacgacaagtgcagaatcataaatgaggagatgcagtttaaagggaaagaaagaaaatgctaggaaagactgagggttaggcaggcctatttcacacaggcagtcagctgtgctctgagtatctgggctgagacctgaaggctgagaaggagctaccaggcaggctggagctggaggcagagacttccaggcagagaacagaacacaagtgatcctgcggtgaaagagaccacgtgcttgagaattgaacaaacagcagctggaactcagtgaaagagtgatctgactgaggtcagagatgcaggccgatagcagggcacgccggcctggaaggtcacagtcaggagacgccgggtccttctgagaacaacacagagccccccgggagctccactttttgctgtatcactatcaggtatctaccctgcagcgaaagaccttccttctgtagcttgctatggcataggccaaactccttgaaataaaatctagagtgtcattgaaatgtcattcagtaacagatgaatggggcatgtccataatgtcttaatggaatgtgttccagccataaaaagcaaggaagttctggtacatgctacaaacaacatggatgaacctgaaaacctcatgctaagtgaaaggagctgacacaaggggacatgtactatataactgcacggacaccagatgtctaaaataggccaatccatagagacctaaaggtgagcatttgccagaagcttcagagagatgggcaaacggagaataggaagtgactttaacaggtttgggggttgtttttggagaggatggaaatgttctggaattagatagtggtgacagctgtacaacattgtgaatatagcagaacccactgaaactgtaccctttaaaatggtgaattttatgttatgtgaatcacatctcaattagaagaatcgtaaccagaaaaataaaattgacttctaaaaaaatatgtcattcagtaaattgtttccttcagtctcagaaatcctgacttgcgctcaaactggcagaatttctctctggatgaggtctctgccttccaacaagccttatgcctctattgggccaatgttcaattttctgtttataagacatgttgaggccatgacaaagcaggtgtgtttaaggccagggcaaactgagcctgaacgctgatttgccacttaatagctttgtggcctgcagcaagctgtgtgaatgctctgcacagtgtcctcacgtataaaacggggacaagaatgtttgcaaggacatcactgtaagtattagaaatgacatgtgcatgggataaatataagcagcagatgcttaataaatggtgttattaatagtgctatcaatactttacagggtcttgacagtatattttataaattagtacatttgtagttagtccattttataaatgctatttggaattctccatggcaaagaaagagctagtggggtacactttgtaaaacagagctttttttttttttttaacacatcaaataatcatctcctgacatacatgtttggaatcttagactgattttccccccattatatgaatcactctgcttgtttcaatttatgcttgcaaagctatgtttctgaaaaattgcatgcaaatcaaatttttacaattctgataatattttcccattgttccatattatatgttcaggggtgatttatcttcatttgtgattgattttcagttggcagcagatcctaacactttagttttaagactgttttctccccagactctgtcaagttgtaaaaacatactttaaaacccccttgacattttaaggaactcctaacttactattttgtaaaatcagacgtttattcctaaggcttttctaccagcagggaatagaattgtatttatggttcagcagtaaacactaaacaggcttgctcattttccattgaaattccccaaagactttcaaaatcaaggcaaaatgatggaaaattaagaacatgtaagcaattctggcccaagacaggagtagggaggtggtgtctgagggttacttcccttccatgagattgtgcgaaggcagcacttcacagagcgtgggcgtctcctggcccgtccacagtgggtcctccacaacgcccctgacacaggctgagcaaacccttttaatgaagaccaattgtgctttatttgagttggaataggtacggaagtgctctctctgagtttctgacacaaataacaaacaaagccatggccagggtcccaggctcctcaggatttcaagatgtccacatctggggagaaagaagtggacacaggtctgcctcccagctctgggttcacatggtgagacagagctcttgctggctctttccagtgtctggttttgacatcacaaagggctgtggacttttatgatctcgtataagagattcttccattctccgcattaaaactgtcccctgaaagggatatgatctagccaaggctgtgacacaagagacatgtgaatacaagcccaaggggtggccacccatccacccatatggaactagcaatgacttcatcctttttctttttccctctagacacattcaccctgtcagcgcgtgcagagcagctgtgatggctgcatcgtgttgctggaagcaggccagtgttaccatgttcctgggcgtgcagctgctgagcaggcagcatggaggccgccctggctgcaggggacccttagcctgaggatcctgccccaagttgctgatgccaacagccagcccttgccagatgtcttatgtctgactcttgggtgtttaggcagcataacagtgaaattgataataactatggatatcaattttgagtgtgtaattttaaccagagcaaacctttattgatctcttactctgttctcaggccttctcatgcatcttacttaattctctcagttccccaggaggcagggactaacattatcttctgtgtagaccagtggggagcaactctgtgtgtgtgagtgtatgtgtgtgtgtgtgtgtgtgtgtgtgtgtaggtcattcaggacaagttaaaacacttatgggtgtgtgtgtaggccattcaggacaagttaaaacacttatgggatgtgtttttcactttcagggtgaatacatttttattgacttcttttagggggataaaagtggtattcttgcagatagctgctttctgagtagaatactaatgagacagcataccctgctttgtaggtgtttatacgcaactatctagacattttagagaaccagccaaatggaagcagcttctgatgtctttcacaatggaactagaccatggctatttttcagaggtaggagggcttctgattgtcgtgggatggcacagacattgacaacggggaatgtgaggcttaacctcagtgactgtcctctatacgcttttaacaattctagaataaatcagttcggaaaagatttgcatctctatcaaaatccgggggatgacattgcaccaactggatcagactgggggagaaaggtttctgtttctcaaattctagtcatttccagactgcctactcatgttttggcaactctgtgattagagcacatggatttagccataaaactgtgggtttgatggtcttgaatacttggcaatgaaatctaagatatctaaacaactcatcaagtttctgatgtacaactatgggcaaagtatgaatccaacatgagttgtattcaaaggaagcgaatggccagcctctgccttcatctggctcatacagaactctgagagatcagacaatcggggaaaaccagccgagggttcatgcttgggtccgtgaccacacagtgcactgccggtatttgaaggcaaccacagcctgcatggaagagaggagaaggtacagatggtgagaaaggggagacagactctggagcagcagagaagggagggctcaggatgagaaatgtgagaatggggtttaggcatttccagaaaactctgactgactgactgactgttgggggatcatggtagacatggtgggaagtttagactagagatgccaattaacaagatcgtatcctcttccttcagcaggaaagtgtcacttaaaatctaattcaatcagtatatactgacagctattaattcacaggtgtggtgctggggagacagagagaggacactaaatgtcatatctcagggagctcatgcaccattagtataagcagacctattaatagatctaataaagtgtacatgctatgataaagagagatgtaaagttgtatggaatgaaagaggaaggaaaatgctacttgagtggggacaggaatgggggactagaaattgaacagcaaaagctttaagagaagatgatattggagttgtacattagcaaatgagtagacattcaccaagcaaaggagaaaatggcattccacacaagagaacaggagaagccaagacatagagatgtcaacatccagctatgtttgaagatggggagtagggtacatgatcaggggaggggcttgcaccaaggagaaggaagatggtaagcaggagcaaatgcaaacagcaaggctggggcatgacacagagatgttggagtcacctgaaggcaccaggacatcccctcgccagcctcggggaaccctcaagggagagtgagcatcacattggcatgctccagtctgtgctttggaaagggcacttgtctctgtaagacaaactggtggcagggtgtttctgaaaggtcattgaggagacaaataatccaggtgggacctgacgtgaacctgcagccaggcaaggaagaggaaggacacatcccccagagacgctgaagaacatggaacttagactaaacctagatggtgaaaggagagagtcctgccagcttgagaaaggaatgcgcacaattgggaactgcagcccactatggaggcatgggggacaccaggagctcccagttggagaggatggctttagaagatagggggaccatcctgaaggactgggcagtgggcaggaggtcggggctagaggcactgcctttggaatcaatgggagtgggagataggtcccagaggaagcctaaagaatccagaccccagggccaaggaccaggcaccctggcatccacccacacttaggaggaaggaaaggcagtgaaggggatttgccattggagaggttgggagcaccaggaaaaagttatcatgggagtcagggcagggggctcctcaaggggagcatgaacggcagcgtcagatgacaaggaggaagtagattgagaagaaagcattggatttggcaagaaagtggccctttctttgggttgtctgaaagcaaaggtcacggagaggatggggtgacaggagagaggaatggatgaagaagtgagagggtagcagagcctacaggtgtgtacggtttggctgcaagataaaggagaaaatttgactgggaatggatggatgaacagatagctagaaagacagagaaaatagttggattgaccttttaaaaaatggtggagacatcagagcatattgagaggtggaaaggaaggagtacacagggaagggcctaggaaaaatggtaaagacaaagaaaataatgagggacacaaaacccttgcattctggaggagaaaggcaggaataaatagggcctaagatacaggtgaacaaatggctttggggacaaaaagataaccctctttctcagaaactgggagaaggatgaaaagactgagatattgatctgtggatgtaaagttatgagtaattacttgactctccaatttattttgaacctgttgtaaaatgccccagattttatagttttatcctcaggaaaatagccatagacaacctaaggtaaactgcgaatatccagccatccacaaggtatataccaaaacctggcagagacacaacaaaaaaagaaaacttcaggccaatatccttgatgaacatcaatgcaaaaatcctcaagaaaatactggcaaacagaatccagcagcacattgaaaagcttatccaccacaatcaagtaggcttcatccctgggatgcaaagttggttcaacatatgcaaaacaatagatgtgattcatcacataaacagaactgaggacaaaaaccacatgatcatttcaaaagacgcagaaaaggcttttgataaaattcaacaccccctcatgttaaaaactttcaataaactaggtattgaaggaacacacctcaaaataataagagccatctatgacaaacccacagccaacataatgaatgggcaaaagctggaagcattccctttgaaaactagcacaagacaaggatgccctctctcaccactcctattcagcatagtattggaagttctgggcagggcaatcaggcaagagaaagtattaaagggcatccaaatacgaagagcagaaatcaaactattcccgttagcagacaacatgattctatatctatttctagcaaaccccatagtttcagcccaaaagttgcttaaacttttatttctctaaaagaagaaatgtaacttgttatttaaatacaaatggtttcaaaattgtataaaattacttcttgttggaaaataattccaattatcctgtaaagtatctgagagtggtttctaagaaaatcctttccatgtcaaccttagtgtatctatctcaaatcaactttgctaaaacatgaaggccattgctagaaaattgaaggagaatcaaatgcgtcctttacttaaacattgctgcctttagagagagtctgaaaatatcactgcataaaatgtttatgtataatattaactcttctcacccttttcctagacaaaatagtttcgattccactcaagtgcaatgtcaacaaaaccagcaacgaggcaaacttcccagcaacagagccactaaccaaatttcactcatgtatcacagtagtagcaggaacttggaaacccttgtccactcaacaattattgttagatatttaggagagagcctgccatctgtgacgtatgggcaatcccagcgcccggctcagtcctgagaaactcatgtgctttctggccctgagtcataaggacccgatggcattccacagccaaagaaaagagtgaatcatttaaaacagggcttggcgtcaatcttgagactaagtcaccaaccaggaattcttcgctgttatctagtttttggtaatagtaaaaatgtcagccatgaataatgaacgtatgactctaaaaatacctctcaaatcagcatggtggcaacaaacagataatacagtcagcacacagtggccataacttcacctcctcctctgtcaagccactcactaaaacgccaagaaataaaaacaaagcctgcctcctgggatcctgtggctccacgagccaatgacggagtaagatgctctttgaatttcgtaatttcttcaaaccaaagactggagaatcagaatggtgtctgtgggccgtgaaggcagtagtgctgttggaagattgctggagaaggtatcagatgtgggttcaagtctctggccctgcacctgctggtggcacagctcattgctgaaattactcgggtgacatgacttccttctctaggcctcagtgtcctcatctgcagattgagtgtggcagtcataccccctatgcatcactgggtagtgggaagaattaaaggccataattcacgtattctttccagggtgatgccgacttcacatgtcaggaatttgtctaggtactcggaatgaacaaatgaactcggaaatgagcaaaacttgcaaggcccccgcccctgatatgagagcacttagcacagagcctggcatataacaaacaaccatttttgtctctccttaggcttctgactctcaaccaggacacacaactgccactaagtcatggctgggccctcccaaacacaggccttgccacccctcgaggcaacgtgacttttgttttagagctgattgtgctgctttggcttctcactggtctgttctcgtccttggtggccaaacagatgtctctgccatgtgacaggttcatcaacaagcaaacacatttcagtactcttgacaattatcgaatgcataccatgagctaggtattgttttaggagcctcacaggtatgtatgtatgtatgtatgtatgtatgtatgtatgtatttatttatttatttatttatttatttatttatttattttgagacagagtctctgtcgcccaggctgaagtgcagtggtgcgaccttggctcactgtaacctccgcctcctgggttcaagtgattctcctgcctcagcctcccgagtagctgggactacagacaggcgccatcgtacctggctaatttttgtatttttagtagagatgggttttcatgatgttggtcaggctggtctcgaactcctgacctcaagtgatctgccccgttcggcctcctgaagtgctgggattacaggcatgagccaccatgtctggccttcgcaagtatttacctatttcatttccagaaccaactatagagtaaaattattatccttactttacagttggaggaaactgaggcacagagaaattaagtactctacctgaggccacacagcttatgtttctcctaagtcttgcctcctctaggctaaaatgttctcatcctctctttctaattaactctggaagatattttttattctgtaatcaatttcccctactaaaatgtagccacacagctaatggccaatagaatccaatgcaaacactctactctccactacctctagaccacaaagagggcagtctaggtgggggttggtggtgatggggagtgcatttatgtctgtgaggggaagcagacgccttacaaattagccaaagtgccttagaaaaccaacaccaggcggggcgccatggctcatgcctgtaatcccagcacttcgggaggccgaggcgggaggatcacgaggtcaggagatcaagaccatcctggctaacaccgtgaaacccgtctctagtaaaaatacaaaaaattagccgcgtgtggtggcgggcgcctgtgcctgtagtctcagctacttgggaggctgaggcaggagaatggcgtcaacccgggaggcggagcttgcagtgagccgagatcacgccactgcactccagtctgccagactccgtctcaaaaaaaagaaaaacaaaaagaaaactgacaccaacatgcagcccttgcctgcaatgtaatttaaattgcaggaattctgatttagaattcatggctgaatttgcttttcttcttttcttgagttcatctagcactttgttacatgcataagacatacagacccacttccctgactgctcattattggagcacacaccatggtcctctgtcaagctgcaaattccttaaagggagaactgggtcttagtatcctcactacttagcacagggactcatacacaataagtaggccactgataaacactggctagaagaaaaagaaaggggaaagaaaaggagtaagcaaaaatctggtgcatggctagattccccttccaccaaagcaagactccaacccatccgggactaccacagaaagctgcaagccagggcataccgaccgcaaggcccttcaaagtcctcgcatgaggtttcttcccccagcataatcccagagtatataaacagggactcaaggactcaataaacccaacaaatatccctccagagctgacactcactggggcccacctttacttaaataaactaacatttatagataagatttgagaacaaacagtgctctctaagataaaccactggggacaaaccaggctgacattttgttcacatgtttattgggagggaaggagtgtgtgagcgtgtgtgtgtgtagtcaagtttaccatatgcctaataatgaacatttttaggcagggaatattctgacctggccctgctcgtttatcgtatcttaagtttctctcaagcctttaaaaataatttttaatccatcaagactcttacatgtaaacaacatttttctgattatttttttgtggcttggggaattaaaacaaggaaccgcaatggggacaaaacacttcttgggattctgaagccatcattagctttacattgttaaccgaaatttttgttgagaccattgtagattcacatgtgtttattaagaaataatacagggaaaatctctgtccaccttgcccaatttcctccagtggaaagattttgcaagcctctagtgtaatttcacaaccaggatattgacactgatacagtccaacaatcttattcgtatttctaatttttattacactcatttatgtgtatgcatcattagctttttatttggaatagtttacattattgatctgctatcagccattccaatttataattgttaatatgcaacggctgatttttcagctcttatgatgtactaggcatggtgctaagaacttgacacacatgatgttaatcaatccccataagattcttgcttctttcttctgggaatagaaactctgcctctctcactggctcacatcaaagtggcttgttctcctctggccaaggggtaggaacatgaccagatgacacaaggacagtccttggcagaccctgctgagcgtgtccatcggttctttttccaagatccccaagtggtctggtcctcgacctttctgagacctggttcgttgtgctttcctccagttccttcctaaacatttcctctctgcttaagtcagcagtgtgcatttgtcttgcctgcaatcaaagaaacctgtccagagagtgggtagcatgttattattctttatttagatgaggaagcaggcttaaagaagttaaagaacttgcccaaggtcactgtcttggtcaaaattctccagagaaacagaaccaataggatagatggatggatggatgggatggatgggatggacagatggaatcgatgcgatggatgggatgaatggatgggatggacaggatggatagatggatggataggatagatgggtgggatggatgggatggatggatgaacggacaggatggataggatggatggatgcatggatagatgaatggatgggatgatgggatggatgggatggataggaaggatggatggatgggatggagaggatggatgggatggatggataggatggatggataggatgggatggatggatatgatggatagattggatggatggatgggatgatgggatgaatggattggatggatggatgggatggatacatgaattgatgggatggataggatagatggatgaatgggtgggatggataggacagatggatggatgggatggatgcaatggatggatgggatggataggatggatggatgggatggataggatggatggatgggatgatgggatggatagaatggatagatggttggatgaacaggattgatggatggatgggatggataaatggatggatggattgggtgggatggatagattggatggatggatgagatggatgatggatgggatgaatggattagatggatgggatggattggatggatggatgggatggatggatggatggacaggatggatgggtggatggatgggatggatggatgatggatggactcaatggatgggatggatgagatggatggattagatggatggatggattagatggatggattggactgatggatgggatggatgtattggagaatggattagatagatggatggaatggatgggatggatggatggatgggagaggattaattatgggaattggctcatgcagttatgaagaataagaaggcccatgatacgctgtctgcaagctggaaaactggggaagttggtggcatatctcagtccaagttcaaaggcccgaacaccaagggagctgatgatgtaactctgtctaaggccaaaggtctgaggacctgggaggccagagtctaaaggctggagacctggagttctgatgttcaaccaagggcaggagaagatgagtgtcccagctccagaagagaaagtgggcaaattcacttttcctctatttttgttctatccaggccctcaactgactggatggtgcccacccacattgggttacgggggatctttcttactcagttcaccaattcaaatgctgatctcttccagaaacaccctcctcatggatacatccatacataatgctttacccgctttctcggtgtctgttaacccagtcaagttgacacctaaattaaccaccacagtcacacagctatgaagtggtagaacagggacactgagcaggttgcctgggtgcagagctgatgccttagccctggcatactgcctcctgctccttgtagaaagggacaaaggtggcacttgcaacttcatggtcttctttggaatttctctggatgatttttcaaccatgctctgatatgtgctctcgaaaccctgaagtgacgttctattatagctactgtcacataacaggacatacctgtttaggactgtggttcacattcctgatgccattccagaaggactgtgccaaaatatgcttagcactcactgatttgaagtattcttccaaacccacccttccctgaacctctccctgcagggtccagcacaggaaatggtttctgaccactcttgacatttactgcaatttttttttttaagaccgaaagcgtgagcatgcatatattacactttcaagtcaccatgatgcatttctccagcattagcttgtgcttttacaactggtcttcatcaaaggtttttcatctgctcgccaatgtggcatgtgtcctaatgactcatgatgaggagtcgttccttttagcatgatttatgctcgcttatcattctcttgttctccagaggggaaagctgctctactgaatgagctcagcccacatagaaatagccactaagcagctgtctcttcatgttaagaaaactagctaatggcagtgtccacgaatcatcccacttgaagattagaacaagacatctgcttctcgtgtggcagagcttgggctaagagggggaacacccaccccccagagaaaaccctgctcctctgacagctcctggactcactttgcttgagcagatctttgtgggttgggtggggggagggcttctgctctcctcctcatactgtcccactcttcctcccagagggcttgtagggaccagggcagagcctgggataagcagggaatgagatgcggttcttgcctggcctgagctggcacaggctccatgagagaagcctcaaggatgagtgaggtgagccctaagccctccccgtttctcttcactggcaggcctgccatgccccatcctgtacctggagttgagcaattacagcacaggatgctgaaggccagacttccagggcgctatgtctctgccggctcacccagcccagtgctatcttcagtcagagccattcagtggccatcctccaaggtcctatggcccctctgctacccttccccagtcccctcctgggcagcactgtccatcttcccagctcatcccttcctttcccttgggaggctccggaggtgtgttcagctctcagccattagaacaggtttgtagcttggggtctgcaggcagcctccctgggtctgcagccagctctggcacctatcagctgcgtgacctggtgggagtcatttgatagggctgtgcctcagtttccttggctggaagacaaggacagtaatggcacataccttatagggttgatgtgaggaataaacaagataatgcaggtgaaaatgccaagcgcaagtcatgtgctccctctgtgtcagctgtcggcattgtcactggctccaggaagaacctgcggtctggtcagcttcaccccagcaagagcaactgacaacacttccttctcaggatgcagtcttggcctcttcccctgcggatgctctcctcatctcctcttgccttgctcacagagtccacctgcacaggtgtgttactcagcgtcaattccacacccggtccaggcgggaggccctttccttggccctcctgaactgctgttcttccttccttccttccctaggatccagagcatccatggagccaccaccgtagtgaggacaaaggccactgaccgctctgctcacatgctcccaggcctcctctgaactgtgcaacagtcgccatcgctggggaggcccctctgttttgcaggggtttcttcacctgttcagaaattgcttcaagacaataggacttaagagtgtactgacagcctggaactgtcattagaaccattaaaacgtcatctctcttgacataaaccataattaagacaattagggcaccatctctcttccctgacatcagtccccctttacaaaccacagaagtctcatgttctggccatagttcgccccggtcaccagcccccggtggcatttggacaggggccaccctcggagcacggctttcctgcacccgaagtggggtcagcttggacagctttggggcattcctgtcgtgagcccatctgctgacttgtcctgcaatgccaccctctgtgggttccacactagcagtcccagctcccagtggtgtcgccggccagctggcactcaggctgatgtcaggtggtgataagtacaggtttcttcctgtcttccttttgctacactcaatgaaagtttgtgaggcctgagaactgaacagactcaggttttgacttactttgggaagtaagaaactgctccttttgtacctcaaaaagaagcctcaggtgtgtggcaatctcagatggtgtcccgagtccagctctcgttcgcattcagtcccagcttcctccccacggctccacctcacacactcacccttagaacgcagccccttcatggcaggaggactaggagggtccaataaggcagtttaaacattgatgatgtcatcatggccatactattaaattttgtaaaaagcaaacagcaaaggtttccaggaaaactgatttttaaatcctagcattaaacaaaatagtacaacctcgctttatactaatatcaaaacacacttcctcctgcccacggagggtccctcctgatggggacttcgtcttacctttctttgaatccccaacaaagcacctggctccatgagggttgtctccaggacaactgaatgatactctgaaggggggatggcaaagctaactggccccattgcagctagtctcagagatgtctgcacagaggcagcagacagccgaggcacacgcctggtcattatggtgttatccttccctcgcctctaccggagccagatccagctagtgcaggctgtccaagggccttcggcatcaggaacggtgcagggaaggaggtgggtgcccatgggcatctcgtcagggcacttaccacccagccaaaggaatatcttcactcgcccaccacggctggtagttaggaccagccaagtctgccacggtggtgctcaaccctgttgcttctgcagatcacctgggacacttaagaaaaatacttatgtccaggtaaaagtaaatcaaatcacccccctacctggcaactttggtttttgctccaggtgattctaatgtccaagcagaacgaaagccattggtctaagatctaccaatcacattgtatgaatgaacgcttagtttgtgaatgaatgggtaaacatgaatgcagagtcctatggctctgtaacagtagaaggccaatgtattaggaaacaactctgggtttatgacctggaccctttgttttagtttctaactctaccaacaactacgggatcttgggcaagtgtctaaacctccctgctcttccagtctccatctgtaaaatgggtgacgtggccacagtgatctctgaggtcccttcattccctctgcattgatagaggttctactaccttgagccgtcgctgtgtgtcagactctggtctgggaggtggggattcagccctggggccttcaggagcttaccttccagcagacatcctcacttccatctacttccacttagaaagtctacaaatccaggagtctacttcatttatctggacaatagcccagtgcagagaagcagagactataccaactaaaaagcagaggaactggagaaaattttccctgaatcactctggagggcttcaaaagaatggagacagatgagataggagccctagaggatggggagatagtaggtttatccagaaatctcttttatattaacaccaacattgcaaaggctggttctttaagtactatattgcatatatattcctaagaaatactgttcctgcacctttggatgggaataataataataatgatgatgatgatgatgatgatggagggacttctgtggttttgcagcttttcatattttgcagagcatttgaccatccactcttagcagtagcccacccactggccacctgggggctccccagtccacttctgcatcctgcataaggcctgcagtgcccactctcagccccttcctccctgaacactgacaccacctgtatgtgtactgccagcctggattccctttcacttgacagcaaccacctaaccctacatgtgctctgcaaaacacaatgacacacacagttaccctccaaagacagtaccgggaaggaatgatgtcaggcagtgatgtcctaaagcccagacaccaggtatgcccaatcctcaccaaaacacctaagtagccctggaacgtgcacatggtcttctgttctgcgatcaaaatgttccatttgtattgagatggcctcttcgctgctgagagaatgcaggaattgcactgagtttagcaaaggaactcgatctgactcaatacaacttagaacaaagaggaacttctcaagcatgtgataatctattcttttcaccaactttctcaggtgcacgaaagtggtcatgcatttctacgctgtatttaaaagaaaaacattttattgactctttaaataaaactctatccacaactataaaggaaaatggggaaatatgacctgtcacacaatcgcataaaaatttacatcgcagataaaatactacaatcgcttcatgaaataacttgcatccatcaaccgtggagatgggcaaggaaatataaccatcctcattttatagaggtaagaacaaagataaagataagaatatataaaagcagaggttagaattataaaaccagtcagccttgccaagggctcaggaaaggctcagcagcgcaaatgactccaggcacttagaagcaggtgagttcctaaccagaggtcatggatttctggacaacggtggtgtctttacaggcaccatgcctggaaataactagtaagataggtgcctactctatttggcaacctcaaatagaattggcctctcaattttcacaatgagaagataccaaaaggatttttggccattttatatctgtgtccctatatttatattcaattttcacctcctgctatatatcaagcatagaataatatgctagggacacagtggggaacaatccactgtctactgacaatatttaattggccaattcaggcacacatttaaaataatgtaagcataagtttattcagattgctttctgcactctcatatcttacaaaaacacttttatttgcaatctgtctttgtcctcattagagtctgagtcatctcacagttttctagactatcactttcacctgcatctaaatgtctctggattcaggatttttccctaattatttcttaaattcctccacctcactcatccccactgcctccgtgccccacacgccccacccgtgccccacacgccccaccagtgtaatggtctcccagtggcctccgacctctgctcttgatactttttgtttcattcaggaagccattcttaaaacacccatttcaatccatccatgccctacttaccaaccttcagtggcttcccctggtgcagggtggcgtctgaaacctggccagatctagtctggtctttggtagccccttggtctcccttttttattactctctcagcccatgccctggcattcggccagagcctccatgccacaagctcctcacccacctgggcctttacttgcactgcttgcttggcctgaaactcttcctcctctctgcacctggctgactcccacaggtgacagtacttctagcctgtgggccttccctggctgccacaccaagacacctttctttccctcattgcccatgcccgtaagcacttccagtgcacgtaacagcataatccattatttgtaagatcatctctttggcatctcacagctccactagcctgcaagctctttgaggtcaagggctgtttcccccctgttccctaccgtgtccccagtgtgttgttcaatgcttgttatataccaggaggtcaaaaataatggttgaatttataacagcagcaccagctaacctttgtgggatatttcctatgccttagactctgtagtaaatggttttatggatttttgtatttaattcctaaaacaacagtaggatcttggtggtctgtatctaacagacgtcaaactgaggcttacacagctcagttcctaaattcacacggcagagtgcagctttcacctgggattatcagattcccagctcagtgctctcaatttacctagtgaaataaataaccttcttagatatccaagcaaatgtgatacagacgaaaaacccttcttaaaaaagcttcaaggagctttgagaggaaagtcaagctctgcaaagttataatacgtttacaatatgagctatagcccttgtggcttaaaaaagtctcttttcaatatttttgcaaagtttgtttactgaaaagagcgatcacatgctttcttactaacaaaaataaaggccactcatttctttgttcactcaaaaggtctcaggcacctgatctggtctgacacagcaaaatattttactatgggaaaatgcaattctaatatttgatacttaggtgggaatttgatgtcctgatttcctttgttctctactacaaacgctttgagctatcattcatcatccatgcatgggttagagagagaaagtacatcttctccacacatgagggaataaagtcactctctgagaactaaaccggggcaatcaacccaactgatgatcactcctaaaaaaagttccaaaacgctcagtaaggtttggtgggccaaacatctaacactgaaattctttctttaaagaaaactgagggaaatcgagtcagctcatggatggtgatagggaaatgatgcatatatgacagtgatgagtctggtttaggtgtctgtcacatgggagtttggtcattgtgagtcagacctcttgagttccgtcaagaatgatttgtggatgtgcaaagctgggatgatctcccagaggtgacagtactgcctgcaaggtcagccaccacctcaagtgacacctgggtcccacctgcctacaagggccccagcatttcttccatacacattaccatacacattaccatacacattacctacctacccatggctggtgccaagtagtcttcacttggttcttcagatctgtcctgggacaacaggacaaatgaccgggagccagcgcttcacgctgcctgctagactatccatactcacaggcaaacatggatacaaattagcaatttaaaagctgccctctgttcctggctgggattctcataaatcaaaagtggtcgatgtttacaacagggtccaaagggaaagctgttgagccagccccaaacacttaaaatttctatatgggaacccagaaaccttcatctgaggacaagagattggaggaaccaatgggctgctcttcatctgcttcttatttagaaaaattggactactggggaaaagagtaaaaacaaaaataggaagcaaaataaatgtttacaggcaagcaggtccctcattctgaacatacagaggttgaaactttccttaaggccagttaattgttcagataacttgtcaggctgtgaagaaggtaatgtgaaaagtggacagagggtgagtgatgacagccacggcacttaagagaaacattgccactgaaaaccagagaccatcaatcttaagacagaaggggtgtgccgtggcagtgccaccgtaatgacatgtgtgtctatcatgtccaccccaaagcactgtgacagaaacagaccacccatagattacaccaaaaaatatacttgtatgatgtgacatatatattgagctttatatttatgtccatacaattggccctccgcatcctggggttccctactctcagtttcaaccaattgcagattgaaaataattgggggagaaaacaaaaaataataatgcagcaataaaaatgatacaaatttaaaaatatacaggataacaactatttacatagcatttacattgtattaggtattataagcaatctagagatgatttaaagtatacaggaggatttaaagtatacagtaggttatatgcaaatactatgccattttatattagggacatgagcatatttgaattttggtacccatgaggggttctggagctaatctccttcagataccaaggcacgactgtgcacacacacacacactggtatgtttaaaaattctatatgggaaccaagaatgcttcatctgaggacaggagattgaaacaacgaacgggctgcatttcatctggttctcattttgaaaaattgagaaaacacttagcaattaagactatacttagaaaaaagcaaaaattactgaattttttgggagtaaagacatggcaaagattgggataggaagagcagtatattatctaattttcctattaattggcaatctagttcagtgataccctatagtgagtatttgttataaatcaattcagacaagcctatcctttgcgactgtgtaaaacggtggtggatttaggccttgtgaagggcaggaaccgtgtgttattcatctctgtgtctcaaaccccaatacactatctggaacacagtttgttaaatgaataagcaaatgaacaaacatgaatagatgaacagaatatgcagtatggcatcaagcacttcaatgtccaaatgtaaaaaacgaaaacggcaaaaacaccccacagattaaaaggccttttctctcttaataaggatggatggatagtatttttttttttttttttgagatggagtctcgctgtgtcacccaggctggagtgcagcggcgcgatctccgctcactgcaagctctgcctcccgggttcatgtcattctcctgcctcagcctcccaggatagtatttttaatacccaacatttaaatgttggaaggaattctacttctaaatcaaaacctatagattatttttagggcataagccatgtttgtactgcagtagaatctttgaaaagtcatcaatagtataggttgaactaacatatttttctaaacataatatatttgttattggctcaacctaataaaatgagtcattgcattctaagcataatgacctgtattttgtaatatcatataatatatagtatatgtagagtatgtacatatatttatgtatcttcatatcagtactgaaatttaattacaaatacattctgagaaatcctactttttatatagtatttgtgttggttttcactatttccacttataggaattccatgccaatgattataggaaaaaaagatgccgattcatcaaaatatttagccaagttttgtctttggcaacaaagagtggccactttccttaaactcattccaatgacaatgtcctctgcaaatctgcaaatcagtcaggattcctagccaagcaggtcagaggggaagaagaaaacaaatgtgttcaaaaagagcagtatgattacccctttttggacaaaaatatttgccaggttttgctaccaaaaaataatgttttatttttgtgacctacagtgaacacataaaagaatgtggaaaaatgaacactaaaataaacacccatgtcctcatcacttggcttaaaaaataggacataactagagtcccagaggcttcccagtgcctttcttctatcataactgctttaaaaattgttttaaaagcctttaaggaagtcaaggttgccattatatataagagtatcatgaaggcatctagcttttatcaaatgccacccactcctcaggccaagggcacttcccaccctgcctccaacccacaggtggggtactccatgctggcttcatcatgttggcgagggatgtccctagagcacacacttcccccagatgaggaatctcagacatttaaatctcccaacaaaatggactgctctgggcactgagatgcatcctgggattctcaggtttccaaggaacagcactcagcaccatgtggaaggagccactcgctcagggtttcctggttcactgaaatacaatgagataagaaaccttggctctcgtaggaattgtttaatttgttttgatgcttgaatgccacatgccctgcatgattcctcatctagtgttgtaagcatgatttctgccagtaggatcagtttaagcattcctctggttaaagtgagaacatacttgaatgcagaaaattactgaggccgaacatcttagagtggaaatggagccccagaaaaccatctgatccagtctccaagctgaggaggcttaacttcagattatagatgagagaactcaggaccagagaggttacttaatttgcctaaagtcacagagcttacaaataccagagatttcatgtttcctttcccttggctcagtgcttctcccctatatcacactagatcctctttgctgtttttttgtttgttttaagtaaagcagtaacaggcatgcatcatacttcctcaaatggtcttcatcatttttattcaatatgaactagaactgctgctctgaaaacagtaaaatgcagacatgttagtttgttggtgggcggggaggggggtgtattttacacatctggaaaaagtttactaattaatttatgtgtccttcagtaaccttgaatcttttctataatatgatagggtaaaaaccaattaactgattgaataacatatttccatctacatcagtgatttcagttcctacatgtaaaattactttggaaaaagcagctgtcttaaataattttctagataaaaagagatttatgtaatatctatacaggtaatttatggtccaatataaaaatacaaggcttttggatcaggaagtacttacagaatataagaagtgatgttatccagtcataatcattaccctatttggtaagataatgaatttgctccaaaatataaatgaattttaaacatatttattgaattgtagggctagtatttttagtaagtttttaatgtcacttcatattttttcatttaaccaacctaacattctatatattttgttgatatgaatgtacaataccatcaaaactttagtgaaaatattaatgaataattgttttcattttacgaaaaccacatgtaaaaaccatttcccacaactcccaaggaacttctgtgatgctgatatttgcttaatgggtgctggccggctgtggacacagcacgagaggcttctccactggagcctgtcagattttcaaagaaaaccacgaaactgaccaacaaaatcctctaggccagttgaagctgaagaagtggccttagaagggctgtgaaaataactctttctaaataaatcgtctccccagataaccctcctgtgggggcttggttttgtatcatcttctatctgaccacatgtttttcataaggaagaaaatcatagaagaaaataaagaaagccttgttctccacttatgttgaatctacctcatcccacagtgaaatccaccagcatactgagaagaaagaagtgagtatttcataacatttttagacaaacgccctcgttttgtttttctcgcgggtccctgaagaagtagggttagcctctgtgtcttctctggctttggtctttgccaattacggcgattttccttcagtgggactaagcctgcttgtgaatgaaacgttgtttttttgttttttgttttttttaacttgccattgccattggaatggaaacagtcctccaagggacaggctatgtctagacgcaatccagacccctgcttttcctactagcaacactggaaccagttcctgcttccctgttctcaccccagcatctacctccgtgccagatgtgaggatgcctttgtctttaaaaacagcaagaaaattaggtctctgtagagcagtttcaaagtcagccttttatccagcactctaaataaaaagatttgtgtaatatctatatgggtaatttatggttcaatgtgaaaatacaaggcttttggatcaagaagtgtttacagagtataagaagctactccaggacaggctgtggtgcacctcgttatccccacagaaccttttacaaatgtggaccctcagcagggggctgtgcagcatatcaccaaatgtgagatgctaaatttggggaatacagtggctacccactggcaaaggcagagtgataagtagaggtggtctctaagaaaaatttatcttgctttttatctcatatctcagggaaaccaataattgatgagggaaagttcttctctataggagcatttcagctaataaaagaagaaagaatgatagaacactgccattttgcaggacccaaggaaagaacagatctaggcactgattgttaatggccactgaacctggtgggtgaagtctcaggcagacttttctaatggaagcatcagagtgaccccaaactcagtggtcaacctgtcatcacaaaacaagacaatcagaggtcacagaactattgacatggcacaagagaagaacgaggaccacctgcaatgtcatcctgcctaaaaccagtacctcaatctgcacaagcctgtacactgaattacctaccagtaaacagaaaacacagggcccagaggaacaggctagacagcaccaagaggatgaaatcagcaaattgagagtgtggaaaattctactgagtataaaaatctggtttcatttgtaaggactgcaagattttaattgcaagaattaaaaggaaggatagggaacctatatattaaaagacacattaaaaatgtagcagacacatacaacgtggggactgtgtttataaccaagttcaagcaatccaactgccaagaaaaaaatggagagatataaaatctgggaaacatgaatactggctggacatttgatagtactataaaatttttatcttttaggtgtgataaaaataattctttttttagcaatacatatgtcagaatttgcaggtgaaatgacgtgatgtctgggggtgggggagtctgataattgcatggtaattgttgcacacaggcgatgggtacatagcaattaactgttgcatgcacctcacctaatctgtagccaggccagccaaacaggtggtccctgggctccacaggcctacagaattgcactgcacctcctggcccacctccacccacagcacacaggtgacttgggggccctcccattgctgatgctggggagaatggaaatgggggtatctaaaccttcaggtgacaagagcagcaggtgcagggtgggacgaggcagggtactgggattgacctggtctgaccatcaaaatgaaggaggaagagaaagatgggtgaggaaagcaggaataggggcagtcacaggaagctgcttgcaggaaggaagatgatgagacctgagcatgtgattccttttcctgcagacagaagcggccagggtgaggagggagataatgcaagagcaatggcagcagaacagcactcatgctgtgaatggcagtgcagtgtcaagcacactgaataccatatcccttatgtattagtccgttctcgcactgttacaaagaaatgcctgagtctgggtaatttaagaagaaaagaggtttaattggctcatggttctgcaagctgtacaagaagcatgacagcttctgctcggcttctgaggaggcctcagggagctttcaatcatggtggatggcagagtgggagcaagcatctcacatggtcagagcaggaggaagagagaaaggtgggaggttccacacacttctaaacaacccgatttcacgagaagtccaccacgagaacagcactagggggatgccgctaaaccacgcagaagaaacctcttccatgatccaatcacctcccaccaggctccacctccaacactggggattacaaccgaacaggagatttgatgggacacagatccaaaccatatcactgtgttgtcctaacaacctgggaggaaggtcttactctccattttagaatggaggagctgacgtggcttgtctccaagcagcctgatacccaaatccaaatccaaatcctaacactgtcaatcatctcctctgatagggatacggaagcagctctagaaagagtccagggaagtcagattgggttttgctgttgaatcacagttacacccttattcattagctcagaagagtcacctcaatcagtggtccccaaactttttggcacctgagaccggtttcatggaagacaatttttccatggaccaggggtgggggcaggggatgctttcaggatgattccagcacattgcatttattgtgtactttatttctattattacattgtaatatataatgaaataattatacaactcaccatcatgtagaatcagtgggaaccctgagctgctttttctgcaactagacgatcccatctgggggtgatgggagacagcgacagatcatcaggcattagattctcataaggagcaggcagcctagatccctcccatgcacagttcacaagagggttcattctcctatgagaatctaatgccgccactgatctgacagggggcggagctcaggcagtaatctgagtgatggggagcagccgtaaatacagatgaagcttcactcactcatcagatactcatcccctgctgtgtggcccagttcctaagggttggggagagcacgtcagagaaggtattggggacccctagcctaaatggagctggaggattgtgattttcttagagttacaaaaaagagaggtggggggcggtgggggtggatttagaagaaactatcaccgtcttcctctacactatgtaccttcatggaggaggacagggagggagaccttttgttagataataaaaacaaaccaggagcccagctttgttttttaactggggcaaaatacacataacataaaatttataattttaaccatttgcaattgcataattcagtggcgttaagcacattcacaattttgtacaaccatcactgacatccatctccataagtctttcatcatcccaaacagaaactttgcccaccaaacgcctcactccctaaccctccaggccccggtaaccaccattctactttctgtttctatgattttgcctattcgaattttgcctattcaaagtacacctcatgtaaatagaatcgcataatatttgtcctttagtgtctgagtcatttcacttagcataatgtcttcaaagttcatgtgatggcatgtgtcagaatgtcattccttttgaaggctgaataaaatttcattttacgtatgccacattttgtggactgattcatctgtcgatgaacacttgggttgttcccaccttttggccattgtgaatgccgctgccacgaatgtgggtgtacaaatctctctgtaagtccctgatgaagcccagctttgtaatgatgatgctacctatgatgaggaataaagatatgccacatactgtcagcatgcaacaaatgagctaatggtaaatacagttacgttgcagctctttgtcatcactaatgaactgtgaaaacaatagaagtaagaaaccagtaagaaggcctcaagaaaacagagctgtgactatcagttgcagttttcccatgcatgttatgaaacatggccaatcacagacagggctcaactccactcaagataacgagtttgaagtaaacacttctgaaaacagtaatctaggattttggcctcctggggcatgatactgtaagaatgtagcagaatctgtgtttatgaactcagcaaaattatgtcaaagagttacaggaaaggttcccgatccagaccccaaaagagggttcttggatcttacacaagaaagaattcagggtaagtccacagttcaaggcaaaagcaagtttattaagaaagtaaaggaataagaatggctactccatagacacagcagccccgagaaccgctggttatccatttttatggttatttcttgatgatatgctaaacaaggggtggattattcatgcctcccctttttagaccatatagggtaacttcctgacgttgccacggcatttgtaaactgtcatggtgctggtgggagggtagcagtgaggatgactaggggtcactctcgtgaccattttagttttggtgggttttagccagcttctttactgcaagctgttttaccagcaaggtctttatgacctgtattttgtgccaacatccttctcatcctgtgacttagaatgccttaactgtctaggaaggcagcccagtaggtttcagcctcattttacccagctcctattcaagatggagttgctctggttcaaacgcctctaacaaaactttcaagctttccagagagttagttttattgtcataagcaatcaatgaaagcatcatggtctttcttttgaggacacaacaactagaaaaaatccagaagagacaggccataacgaccccagcctgcacagtatctgcacgtaaccatcccggtcgcaccaggagagggaaggtgcaatgacagccactaagatggcatcagcctctccactgctagagacctcctgggaagagccaggacagccattactgtcctcttgggatacagagttggggaaaggagcttaaggctgcaggaggattttcgtcagaaaaccctgagtctgcagtgtcagaagggaaggagtgcaagggatgtaatgaaatgtggaactccatctccatctcaaatgccctctctcattcttccagcttcaaagagttcactcaaggacgccacactctcaaatcacaacccagaggggcctgttttaaaaaggttgatcttaaccagtttaggcactttcaagttaactcgggttgaggaacaaaaagctctaaaaatggtgttctgaccttcttcaacgtctatacaacttcaaagaatgaaatgaggggagaagctcaagggaatttagctcttactcaggaaacaaaatttagctcaattaaaaagatcttaaatgttaaggttgagagattttaacttaaatctgaaggagtttggtctagttagattgccgaagtgcatgtagcttgagttaattccctgagtctatagtcatgcttagagaatttttgactgcaccatcaccctttcatcaaagtgggcagagatgacccctctggtagcaccggattctccaaggcaggggatggggctttttacactgcaggcattaggcaagctgaagaggtgtggtcactccctgtaggaaagaacattcctgtgggcgatgcatcagctaagacagatatcccaaattctcacagaaggatccaatgggctggaatttccctgctagccccagtgctgtccaacagaaatttctatgatgatggaaatgtccgtctagccacacgtggctattgaatacttgaactgtggctagtttgagcaaggaactaaaatttcaattttatttaaattaaacttaatttaaatagccacatgtggctagtggctctctaagtaaagtgtgaatataactcctagcagaatgtgttaaaaatatagaccctcaggccctatggctggggattctggttaaatagcggtggcgccaggcattgccccttttaacaagcgctccaggtggtcctgatgctggtggtcttgaagcaatgctctagacttcaaggagggcaggagtccatgtgtgagctcctggtagtggggaacacccactgcatggagacagactataggaaggatatggaatagggcctgggagcgatcctagaggccagaggctcacccactaggctccagcttagaattcagtggagcactgacattgccttgggttgtgacagctatttagataccgtcagggccacagctgatgcctctccatgttctgcccactgccggctcctgatctccagctcatagctgccagccactggtcagcggcaaacatccatgaacacccccttcaaaaatgccatgcccagttctacaagggccctccacaggtcacctccagagtgaattctgtgaaacccaatattcagcccctcccagactctcaggaccatgcctaccatgacccacatctttgtgtctctggccactgctcaaaggacaagttcttggtccttttccagggttctctattctcatcgaaggcatcactgttctcctggcatctcaggtaagaattgtatgccttcctttccatgatcccacacattccatcattcatcatgttctgtccattctgcctacttaacatttcttaactacttactccttcccaccaatactctcttggctcaagccatcatcagctctccctggacagcagcaatatgcagtcccttgaccacacccgctctaccctcccagctagtcttcacaggcagccagatggactttaaaagactgaattttggtggagagcagtagctcatgcctttgggaggccgaggtaggcaaattgcttgaggccaggagctcaagactggtctgggcaacatggtgaaacccggtctctacaaaaaatagaaaaactagctggatattgcagcgcatgcctgtagtcccagctactagggaggctgaggtgggaggatcacctgagcccagagcagtcaaggctgcagtgagctgtgattccacaaatgcactccagcctaggcaacagagtgagaccctgtctcaaacaaatgaaaagcagaatcttatcatgtcattgttctgcctacaggccttttcttctatggcatgccactgtatttaggaataaagtcaagatccttatcaggacacacaacccctgtatggcctggcttcctctgtctctctccttcttggtcatcagtacaaagaccttctagaatctgagaagctggacatttacttctgctcttctttctctctctacctcctgccctccttgactgggctcttccctctgtgtgcacagcttaagagctgcttcattctacattttccctccccagaccaggcattggccccataccttcccctcctgagcactgagcaatgcagtcatccagttactgtttttgtaatgatctgcttagtgttgggctccttgactaaattctaagaggacaggaactttatcttattcactactctccctccagggtcaattatactgtctggtattaaacacatatttgtgaataaataaccaggtgaagaagtgaatgagcaagtgatttaacacatcaataaagattaattaataaagataattaatatgacagatgataatcattaaagatggcagattaggccaatgttttccaacatgacctctgacatcagaagagctgacaattgttgacatgacttttataacttttgatcttgggaggcatgagcaagcacattgtcttaattagctttattaattattaatgtttagtaaagataattattaataagatattaataaagattctgataaagatcagttaatagtagaagggaagctgagagctggaaacatgagactataatttctgagatatggttccatcgacatttgtttagtcactaattagaatcaccagccagtttagaactccccattcctaagggcaggcttcagggagggggtgtgatgtccacctggtgagtcactgttggtccgggtgctgctggtctgtgtgctctgagggagggtccaggccatgtgctgcctccaggggagcccctcaggctatggtcagcattaataatgtctttcatctgtgagtggatctacaatggcttctacagtgtgctccagtttctaggactctacaagaaatctagaaaacttgttctcttgggttgggacaatgtggatgaaaccattcttcctcatatgctcaaagatggtggattgggccaacaggctccaacacgacctctgccatcagcagagctgacaactgctagcctggcttttacgacttttgatcttctggggcataagcaaacacgttggttttggaacagtgatctcccagcaacaaatgggattgcctttctgggttactgtgcagattgtcctcagatcctggaatccaaagaggagctcaatgctttaatgactgatgaaagaatatcccatgtgccagtccttatcttgattagcaaacattggacagaacaggcacaatcagtgaagaaaaactctgtctgccatttggtctttatggacagaccacaggaaagggaacttgtgaccctgaaggagccaaatgccttttccaaggaatcgttcacgttcagtgtgtacaacaacagggctatggcaagggcttctgctggtttgcccagtatattgactgatggttgggcagtgaaaataaaagtttaacttcttaaaaaaaaaagatggtgggtggggagggggtaaacagtctaggcttcttctgcaagagaagaagtaaaagggaatagcactctacactcaaagattttaaaagtccaatccctgggcatgtcaagattgtaaaggtaagaaccctacagcagctggatcccgaaggaccagcctggcgtgtctgttccaggtcttgtgagcattgagatgtttggccatcaccaagaattagaggtaaagagtaggcataacctgatttccattaatttagaaacgctgaaacagaacataatataattcggtaaaataattaagattgctggatccacagagaaatgttattgagtcattcaaacctgatcatcaaaattaacatgagctataatcttcctgcattgactggacacagatgcttattccattttgcagacaaggaggccaaggtgggcagatcgctggaggccatgaaggaagtggagagaatatcagtaacttgctgttgggagcaatgctgctttcaaagcctgggctcctaactccaaatcctgtgttcctttctggaaggttttctccttgaattgtttctcaccccacccaagtgaccttcgacctcctgggaactcacttctggcttggtccaggttgtccagactccatcatccactcatttgaggagtgctcatcgatgcctatgatgagccacgctgtcctacccctgaccgtaaggatgtcatggttggcggaagaggaaaggaaagaagcatccaatggtggaaatgagaatgaagtggcaggtggctctctgatgtcaggcttgcaacggcgaaggatgcagggttttggctgtgccccaccctgtgtagcagaagaatgacctcccctgcctaggacccaccacatatacccccacacgctcaggtggcagtcacctttttagcagccacattgcctcaggggcttgagtatgcaggtctcattcacaagaactactaacaaatttccttctgaacttgcaacatttatttttttgttaacccaagcacaggattttacatttatccccattaaatctcaccttgttagttttggcccattgatccgaactgctgaaatcttcataatccagattttgccgtgccaagcacaattattccccctagctctgcattgccaggaaatgtgatgagagcactttttatatcttcatcgagatggtccatgaaactgtgggccaggacaaggccatgcacacagccctaaggccaccggcagcaacctcagtcgccctcttcaacatgggttgggtcaaggggaacaatggcttgatatcctctggatggtgattcagccaactaaaccatctaatgccatctccacactggttacatttctccattctgtaccatgatattctgagagatgatctaagataaatgcctttccaaatatttatacccatgtttagccattttaaaatgccctttctgttattgttctagagtgaatactaattaaagttgccctgtaagagatgtctggaatcgttctaggcaaaataagtcagtgctgaagttattctatcccagagataccccaaacataaattcaatgggctatggacttcccatggcaagtgccttcaatcagtgatgggaacagaacttgaaggcatgctgggattgagagatgtaaggaacgtgatctactgccatcactcttcattatcctaaactggaaaagctgatgccaaagctggccagcctgtccaataaaacattttgatcaaagatacaatttcacagaatacctatgtaagggatggcctgagagtccacagggatctagtagaagtatgaaagttatcaacctggtttctacaggtccataggcagacagcaatattgtgcaaaatgcttctcaggggctatacaaatacagattttaagtgaacagcatccaatcttttcataaattagggatgttagaaggtaaataaaagagattccctgaaaaactatttaataaaaattcagccctgtgccatgaagaatcggttcaccacagaagcattttgagtaggattaattagatgactctcagcattagctatagacttaagagactgggaccgctttaatttaggttgtggtttctaagcaggtttttcaattacagtaaacttctggatatttaaagacccaatattcaatgagtagatattttttgctctttaaaagtcaccagaggccttccagaggcctctcaaaataacttttatcattttctttttaggaataataaatacgttagcaatcttcttttcaaccattatcaagtttttacaatagtttttttccttcaaaagaaaatgttttttcctaattttaaaagtaatattttatttttgcgaaacattaatacaataaagaaagtaaatatcctctataatcttcctactcagagatacatgtcatgtgtataattttaaaataaaaattgaatactatgtaaactattttcattttttagaaaacaaacactagcaggaaacaactattttctaacatgctagttacattgattataccatgaattttttataataaaagtctcatcattttaaattgttgtatggtatcctgtttcatagctgattattgaatcagtctcctattgatgtacttttaggtaaaacatctttaagcacagggctgactctggggctgaaggtgttggagcggtatactaaccagcttgccttctgattggtcagctgttcatcctgattgatcaggccctttattgtactcattgttaaacatgtaaatggtctctgcttatatttttatctctgggttcttatagtttcacttgtaaaaactctcggacttgactctattgggccaatggctatgcaaatttaaaattctattatatactaaatgattgattgcctttggtgtctaacagcattacatgctagtagtgcacaagcatttcactctacttgattttttttgtttttagtattcattgcgtcaaaggtatagttaatttggaataggtatgtaaccttttgcaaaaaaattgttatactgaagtatttttggtaatgcatcattaaaatagtaatattggcatcctcttattatgaaaatgttacttttcatataatggaatttctaaaattggtacaagtaatacaattaaaattatagcatatcataggaacatatgaaacattttctatgtatttttgaaaatgcagtctgacagtgaggttgcaaagagagaaataaattaaaaagatagttttgttttcaacttttataattttgagattatctcatgaaagactcagaattgaaagggaacaaattaagtcaccttttaaaacgatatttatacaaattagctactctctagcagtcaacgtgtattatagtatctgcagtaatggaaggtacatcattttcagggggaaccatggacaaggctattaagtcacattacaaactcagacaaccagacgggctctaagaaattatttatctatggaaatgtgtgtccattatgaagctaaatgaagtagcagggtataaaattgcatacagactgtgatatcaactaagaagacaaaagaaacaaaggcttatttataagaaaaaaaatccatctatataattcaccagaatcttaaacaggattgtgtttggtggtaaaagtactttttaaaaaatgttagggttatttgttcccttcccccctataatgttcagttttcttcactgggtatgtatattgttttcatagtaaaaacaacttaaggtttttatgaggtcgatttttgcttctctacctgcagtcgtaatgctccataaaacattcaggattagcctcccctcatgctgtgcaccacgtttcttccaacagcctaacaatgggagcaggtgcaataaagaacactcctaaatccagctgcccaccacaacaaccccatcgagaaaatgcatcaccaccagcagccttagatgcttttgatctttcagggaatgcctagcttcttccattgagatattttcaaaaccatacctaaaaatgtacaaaaatgtgtgcccctcgatattcttatgtaaagaaatagagtatgaaaatatgtactttgctaagggagacggatcaaaagcaatatacagttttctcttcagattcctgattatataatacatgtgtctgaatctctattttaagagcaagtcacaagaaaagctaaaaacacctcatttcttgtttccaaagcttctgatctatttaatggtgagcagtaagaatgtaagaaaaaaaacacaaaagaggcaggttgcagatcccagggagcaggtagtgtgatttttgtatacatttttatatattgcagcattagataccgaactttcgggctggctgttgattgactgtctttcgtctgtcttgcttaaaatgctcaaatcaaagcaccaacacaagtaaatgatctgagttgtttacagggagatgttgagtcaggttctgggactccacatccctgacagaactcatcccagtgagggcctgcgacctctactcttgtttcagaaaaaatcaccatcctgctgatgggtgaggaacaggaaccagtacttttggaagagagaaactgctattttgaccaagcaggacttggaaaattgagttctatctttacatacagattgcttattagaagaactaataagctcttcttttatggtactaatgaaatagaatattaaggagtcctttagatctgaggaatctgtggggatagccagggtgcaaagaataagaaaacgagttgtttgtcttacggttggaggcagacaaagttttctgctagtaaggcacacaaaatgtataatagtatccaagcggcccagaaaaagccataatgccattttctggaaatttatataatttttccacaaaaggaccaatttttaaaaataagaagatgacagaaatagtccaaatcactggagataagctttgaaagataaaataaactcttggtatttctcagggagaagataatttctatcagtttgaagctgtttcccctaatataatccaggagttgtcaaaagtcaactaattatgaaactctgttatttgaacagtacagggatgcttaaatcaaatctttgaacaaccaggcactgaaaaaataaaacatcagaactatgaaaaaatagtgttgagttataaagttccttaatagagtgataaaattctttatttttccattagataattttttaaagttaattctcacctcaaatccaaatttggattacaaatccatgcatttcgttctttgtttctaaaccccaacataaatcacagagcacttttctgtccatggtgtcttaactttctcctatcatgcaataaacaagaattaacttactcatttctttccagatttatgatcagttctttgctttcccgttgtagtcgaatattcagcacttctggatgattctgaaagataaacaacaaaagtcagttgaaaaacgcttggctttgatttgcaaatagctgaataagacccacaggcgtagtcaaatgagggaataaacgatgcggtcaacctaagaaagagccaaatgccatcacaatgcagtgtataaatgaaggtttcttagcagcttaaaaagagcagtgaaggccaggcaccagaggattgcttgagtccaggagtttgagaccagcctaggtgggcaacacagtgagaccctatctctacaaaaagtaaaaataaaaaaaatcagaatattagccaggggtggtagtttgtgcctgtggtcctagctacttgggtggctgaggcgagagatcacttgagcctaggagttcgaggctgcagtgagctatggtcacgccactgcactccagcctgggtggcagagtgagactctgtctcaaaaaaaaaagaaaacaagcctgtaatcccagcactttgggaggccgaggggtgggggtggggtgggggtggatcacctgaggtcagaagttcaagaccagcctggccaatatggtgaaaccccatctctattaaaaatacaaaaaattagcctggtgtggtggcacacccctgtaatcccagctactcaggaggctgaagcaggagaatcgcttgaacccgggaggccgaggttgtagtgagccaagattgcaccattgcactccagcctgggcaacaagagcgaaacttcgtctcaaaaaaacaaaaaaagaagaagaagacaagagtggagggagagttgggtcatcccacagaacaggcaccacaaactcaaggagacctcattcttcctggtcagcattgcatgagtgcagaaagtggagactcagtcttgctgagacatgatcaccaccacactcaattagtgcttccttcagttacgctgacttcgtctgcctttgctttgtcagttatttcggtactaggcttgtatgaacgcatgagaatgagaagtttatacatacttttctaatatttcatatttgaaagtcagtcttataactccagagctcgaaagatcttttcacaatatatataatgtttcagctataccatgacttaactaaccacatgccactacactttaagatgaaatggattgtgggttccaaatgtccaacatgaaaataattagttaaagtaaaacagaatttaaagaaaacccataacaactgaaggtcacatgagttttgggaaaaaaaaatgagttaaggcaaaacatgacttaactaaggccatataactggggtagagtcacaaaggctgaaacattatttgctttatttttagggcagccctttgcatatcttcttctagtctttctgtgtctctcatggtagccattagccgcatatggctatttaagttaattaaaacgaaatgaaatttaaaaattagttcaccagtcatactggacacattgccagactcaataacttggtgtgacaggtggctaccactgtgggacagcacagatatagagcatttctatcatcatggaatgttctattggacagctctgagtcagtgataaagacctaaaacttacatcatccaattgccacctgagaattagattattttaaatatcagggccttcaggaggtaaaattaggtacaaactcaagggttttttccttatgagcttcaaggaggttctttctcagttttcactgatggatgatattactttaaatagttatttaaacttgagagttaaattggtgaatttccagatatatgaaattcttacgtatcttttctgggtttacacaggccttgtttttgatggatttactctagcaaaagagtacaaaaacataccaaatttatatattttgatactgtctggtgtttataagaactgtgtgcatttctgagtgttactcgactttgaaaattaatctattggatcctacatgccaagaaacatgcaccatttctttgtagtgtagtgtgtcaaagtgttcttatgcccttacaggtatttgctttcgagtccatcacagggactcctgcatatttgcctatacttgctgacacccgggttgaactacaaacacttccataatgttctcttcagggtttgtaatatgtacccattaattatatgtgtgaagaacaagattattaattatatttacaataaaatattagaacaaaatatgtctcaatattctgtcaaaatgtgcccaaacacaccatatgtatgtatacatgtgtgtataactacatgtttcatatgtatgtatatataagtaacttagttactttagttacaaatagtgtttgcctaagatatcaatgcacagatcacataccttaaatggaaatcctgacaattctatatgtgaataaaaatatattatttgcaatatcccttttcccccaaagaattgaggtagtttaagcattaacatttgtagtaattccacataaagtactagaagtgttaggagagtccaatgtcaacatcttgcagaagaacatattttccttcagggaagatctttatgtacattagttgaggtatgactagtaaaggagaaaccaatagagagggagaacagacagctactttaattgaagaccactaattgccttagacttcttaaaagcatgtattcattccattttcttttgattgttacccattggagatgatgaagtagtaccggtaaaatacggcattccttttcttaaaaatgatatattgattaccctaatggaactgtgtcttttattgaatgcttaaagaactgtacctgctgaataaatcaattaactgctaatcaatgggccagaaatgttttggcagtaattgctgctctattattttaattgggaaagtacatccaagagtatataaaatgtataagtacaatttgaaaaacaacgattaaaataaacaccagggcacctactacccagctgaaaaagcagactatttctataatcttagaagcccccgtattagtttggtggggctgtcataacacacaccagagactgtgtggcttaaacaacagaaatttatcttatagctttggagctagatgtccaagatgaaggcattggcaggtttggtttcttctgaggccgctttccttggctttgagacagttgccttcttactgtgtccacagatggccttttgtatgtctgtgtcctgatctcttcttataaggacaccagccatataagattaggggccacacatatgacctcatttcaccttaattgcctttttaaagggcctttctccaaatacagtcacattctaaggtaccggggttaggatgtcaatacaggaatttgctggggggaagggagaggaaattcatctcatacactttctcatgctaaattcattattacatttcccttattcccaaccagtggtaaccattatgctgaagtttctattaatcattatcttgatttcctctacagttttgtttctagtgtacatattcctaagcaatacactgtttagttttaccctgttttgaaccttacaaaaatggcctcatactttgtccattcttctatgactggtttcttttacttaatcttatatttgttagatttatacatatggttgtatacagctgtagtccatctattttcattgctatgtagtattctattgcacaaacaatgtgtaagtcctttctcctacaggtggactttggcattctttctctccaaccctttttgctcttaaaatgctgttatgcatgttcctgtgtacatgtctcctactacagcagtccccaacatttttgccaccagtggccggttttgtggaagacaatttttccatggaactggggctgggggtgggggatggtttcgggatgattcaagcacattattattacttactgtgtactttatttctatcgtcattacattgtaatacataatgaaatacaactcaccataatgtagcatcagtgggagccctgagattatttttctgcaactagatggtcccatatgggggtgatggaagacagtgacagatcatcaggcgttagattctcataaggagcccacaacctagatccctcacgtgcacagttcacaatagggtttgtgctcctatgagaacccagtgcctccgctaatctgacgggaggcggaactcaggcagtgatgtgagtggtggggagctgctctaaatacagatgtagcttctcagcctgcagctcacctcgcctgctgccgtgtgacctggttcctaggctacaggggttggggacccctgccttgctggacagatatgagtttccctggctaatctgggatggaaactctgggtggtgtagtttgcacatgtttgactctaccagggatctttaaattgttttccaaagtacaaatgggttataaatgtttctctcattccatagtctcatgaatatctggcaaaaatttaaaaaggcgggcagccccaatctgctgactgtgcaactgcggctcactggggttttcctttacgcctccctcctcagtagcaagacagagcacctttgcttatgtttatggaacatttgattttcttctcctgtgaaatacttgctcatgttttctgaccatttcctttcctgctttcttcctcctccctttctcttgtcattgtgaatttgtagttatttctacattctggaagctatgcttttctctgtttaatgtgtgacaaatatcttctcccagtttgggctttggcttttcatcctcttaagtgtgttctcatgaacagaatgccttaattttaataaaatccttcatggtttaaagtctttgtgccttatttgagaaatccttccctactccaagatcaaaaagcagactgtgttatcttctaaatgtttcataattttgcctttcacatttaagtcccatccagacttgatttttgtgtccagtaccaagtaggagtccaactctactttagagaaaatgtgattaaccaattgttccagcaccatttgttaaaagtctatccttcctggctgggcacagtgtctcattcctgtaatcccagcactttgggaggccaatgtgggtggatcatctgaggtcaggcctttgagaccagcctggccaatatggtgaaaccccgtctctactaaaaatacaaaaattagctgggtatggtgctgtgctcctgtaatcctagctactcgggaggctgaggcaggagaatcacttgaacccgggaggcagaggttgcagtgagctgagatcacgtcactgcactccagcctggatgacagagcaagactccatctcaaaaaaaaaaaaaaaaaaaaaaaaaagacctatccttccaccgtatctgtagcagccatgtggagatctgtttctgagctaataccatgtgtctcattgtctgtccatgcactaatgccaccctgtgttaattactacagctttactctgagtcctgatgtttggtgagtcttctcacctctactatctcagcaccctgggattgctccactgtcttctgtttctatttcttttttataaaaatgaggtctcaatatgttacccaggctggtctcaaactcctatcctcaagcaatcctcctgcctcagcctctcaagtagctgggactacaggctcgagcgatcacggatgacttggtttccattcttgttgctgagaagtcagtcctcagcctccttgggcaggtgacccatctcttctctgcagctgcttttgtgatcttttttcttccatgtttggcagtgtggccattgtatgtctgggtgtgaattttgttttatttgttcactttgatttgtcctccttggagaaaggatgctcccttactctcttcactggggctgttttatttcttattcacccatacacacttgtctgtcttttgcagcgttcagggctcaatggcaggttggaaaaggtaggtagggttaagggtgtgacccaagattggagactgtgcaggccaagagtggccgaaggccaggggagaatacaggctggaggtgagggagccagcaggtaagaggagccggtaggtgctggccaaaaaagggctacagactgagagactggacagaggtctgtggaatggacattctagagaggaaaggaccacttcctatgggatgctgggtaggagagaaggaaagggttctgctgcaagagaagcattataatttggaggcaagctctcctcaacaaaggtgacaaaaaaagtcatggcaaagttcaacagcttcctgtttcctccaaagtcataagaaaatatctttttaagtttgaaagttcaagtgaatcgatatatttttatctactacactgcctcttaggccataaggcactgacatttattgatatccctatttacctgtatgcatgcaggcatgtgcatgaacacttgcttttgtgtgtaagtgtattatgggacctgggctgatgtcccagtttattatagaatttttcatgaaatagctcttgctatttgtacttatacttcactctcagttccatctaggagtcagatctaagttccctctttagggcatgtaggcttggagataaaccccaagactgatactgcatttactccaaatccctctttcctcctaggagggaagctttgtcgttgggcaaaactcatcagacactctatcctcagtgcacatgtgctcacaggaggcaagtgccttcctcacagaaaggcttttttggcagactccccttgagatggcaagcccaggcaaatctgcaaagacgggtgcggccaggacccagctgcccacctctagggcccccaggtgcctgtgttctctcagaggtttcccacaatgcacttggctagggcatcccagtgaactggctgtacaaacagatgtgcaaaaagtgatgattgattgattggctgattagattgatttccctatttttttttttttttttttggtgctatccatgtcgtgctacccttctttaatgtgtgcgattggaggctgatccaaacttgactttaaatcatttcacccataatgaacacaaaatacctcgagtccataaatgtagctttgcatggttgtagggtgctcattattttccctgaaggacgggatgacacacagcatcaggtccttggtgtttttctctctttagagaacaagaaattttcaacagcttagaaacatctgccctgattctgagggtgaattaatgtggcagtggaacggcagcaggtctggcaggcaggagggaattaccatccaaaaagtaagatttggggtcaacagccaagtccactcccatcacaactctgagattatccttccaaagaccatggtcagccagagccaaagtcattcatctcaaccatcaatactggaagctcagagggatctaatttttcaagaagaacaacaaaattaaaatattgcattcaagggaactctaaaataactagatccctctccggcactaaataaatgcttcaggctgcagccttggcattcacggggcacgagggagtcatttattgctatgaatatttagaggcaatcttgattaccactttaatatcagtgtgctacttccacagcctggaagatatgcgcactgtggaatttagagaggacaaaattgaattaactgcagtataacacagtcaggaattaaggcacggcagcattataatggggtgtccctggattggggcctgtttgttattacataaataatgataatgtttattcttgagttactgacaatttttccgatggataattaactttagccaacaacctgttaaaatgctatgtacaggatggcatgtattatccttaggtttataatgcagttggaagtttgtgtgttcaaacgttggattattttaagcacaggatcttctcactgtgtttctgcagcatgatagagtcttggtttttcagcttgcttctccctccctgcaggaaaaggcaccatcacatcacctttggtcctcgtgatgctcttagctcaagttctttgtcccgtcgctaccggtgtgattgttaatcctcagatttgcagcaaacattttagattttcattttagattactttagctatagccagagcatcttaaagccttatttatgcactgaaatacttctggtctgcttctgtgcatctgaatgctatagaatgacagtccaccaggcacgtgcatctgtctgaggacaatggccaattctgaagcagacgacattactctgttcctttcttgagcttactattgggttggaagagggaaatgaaaacatgacttatcagaaagcaacctggaaaacactatgacatggatttctcaaacttaacacagctaaaattcagcttttatttgaccatctccctccatcacccctgatccacgacagaggggaggttggagaaaatccaccctggctttcctccagaattcctgagcttagtgatgccctttcttaagacccttcaatggcaacctgatgtgcttagaacaaaaccacggccttcacgctgtgaaggctctggcgtctgctcacctggcacctcacttggatgtcatcacttgcttgttcccgaagcttctgggtccttgtggctgctgactctctgccaaaacatcttccctgggccctttgtgtggcttaacctccaggcactggcctggacatcaccacctcagagaagtcccggcctcctaagggggttgttggttctcacacaccctgttctgtctcttcctagcaaagttcctcatttgtgatgatttgttgtttttcttttacttgtttacagtctatctccctcggcaaaatagaaacttcccaaggacaaagaatttgtcagcgtgctccacattacagtccccacacccggagcagggccaccgagatgcctctgtaggatgaagggtacaggcaggaggagtcggggatgcaggaggaacactaactggggggcggagaggagaccccaaagctgcaaaggtcccctgaggaggtataacagtggcctccagtccctcctcacctgtcacacactgtcacaagcagagggtcctctgacctgcgggctgtctgcttgcctcaccctaggaggccaacgtcctctgtgggacacaagtggctgtacaaggatccctgtacaaggagcagggaaaccctggactttgaaaatggacttccatactgttcttctgaggagagtaggcagggcttgccctgtgagctgaatttcttacatttgtacttgggactatacaaatgaccaatgaatgcatgttcccaggctgggtcccagcaccctcagctctccggagaggattccacatcctcctgctcagtttatttggatcttcgtgacaaaaaaaatccaaaatagggcagacagggtgaggcggcagcagcaagagcagcagcagcagcaggacttttgataaaatctgaatcaatgcaaaatacaaggtaaagagtggaggtgggtgtggtgacatgatggcctggggataggactgtgtggtgatgtggtggcctcaggaacagaacagtgtggtgacatagtggccccaaggacaggaccatgtggtgacatggtggccctaaggacaggatcatgcggtgacgtggtgatccagggacaggaccgtgtggtgacatagtggccctagggacaggaccgtgtggtgacataatggcccagggacaggactatgtggtggtacagtgactctaaggacctgaccacatggtgacacggtggcccagggacaggaaagtggtgacatagtggcccaggggaaaggatcatgtggtaatatagttacccctaaggacatgaccacagggtggcatgatggcctggggacaggaccgcatgatgacatggtagccctgaggataggaccacatggtcacatgatggcttggggacaggaccatatagtgacatggtgacccaggaataagattgtgtggtgacatgatggccagagaaaaggaccatgtggtgacacggtggcccagggacaggaccgtgtggtgacacaatggcttggggacaggaccatgtggtgacttggtgcctgggggctggatagtgtgttgacatcatgttgctgaagtcagcctctgaccaggccccagctgacaccaaaccctgccaggctgtgggaccacctcctcagacctctgctgccccgtgccctctcccacttccaggcatctctgccagcacctggctgcctgctgaggaccatcagatgccaaggcggggaggcagaaggccgaggccgggatgagtctttcctgtcagccacgtaccacctgggctcataaggaccactggtagccccagtgccatgtgcctggcatccacatccacgggtaccagccccttgcaacgttcagtgtcgatgccagctgcactggaaagcagggctgatgaggaggtgtgctcaccatgggaagaaggcctaggctgggttccaagacccagttcatttcagcatcctcggaccaccccaggtcttggaacaccctgatcaatttctaggagcatcctaggttgaaagtttatggagatgcagcaattcctcctcttttgactgcaaaggaacaataattttaagcaacaaagaactatttcattttggaaatgtagcatttttccatttaagaggctacagtaggaggggcctcaggctagaaggctacggtcagacggcagctgtgggccatggactgagggccaatcttttaactctgctggacctcagttttcttacaaggaaaatgggataacaaaacgcttttcctatcattgtggtcatagaaatgacagtccccaaagatgtgctaacccttggaatgtgtgcatatgttaccttacttggcaaaagggactgtgaagatgcaattaaggttaaggacagggacctcaccctggattattcagatgggcccaatgtaatcacaagcgttcctgaaggcagagaatctttcatgactggggtcagaaagatgtgacaagagggcttgacccactgtgcttactctgaaggtgccagaagggagccatgagccaaggaacctggtgtctccagaagctgggaaccgccctcaaccgccagcaagaaaataggaaccatgttcctaccaccacatagaactgaattccgccagtgcgtcaaggagcaggaaatgggttctcccccagagcctccaccaagaaggaagtcctgtggacactttgtttttaacctggtgagatttgaagcagagaatccaaccatgcccactgggcttctgaccttgagattttgactgtgagataataaatgggtgtcattttaagccacttaaactggtgtgatttgttatagcagcactagacaactgacttaattagtatgatcgctatgagattcaaatggtaaaaaggctgtttggaaaccatcatgcgtgacaaaatgaaaatgcatgcttattacagaaatccaatcacaaatcaaactgctactgcacagcatgacagtgacaagataccgtttcacttattatcgattgctaatttcccaaattgcacccttttcatgctttttatagttagatcaaaatgggcataataaatgacgcttcaaaaatttttcaaaaaggaatattatacatttattaactgagggcctatttatgagccaggcactgggtccagtcctgggttgatagctgaaagcagcttagctttcccccttcttctatatgggaagaggctcttacgtactatgtgtacgaccaatcatagaaggggatagaaggtactagaagacctgtaagatgcagcacaaaatatgtgaatgtacttcattttggtgtagaatgttttaagctaatactttctaatgtatgcttactgatataaccagggacattaaaatattataaaagcacagagcattgtttttggagtggcctctgaggccttctaagacacagccagtggtagaatagcatggactgtgtttattaaccagaaagcttgcttcccattcaaagtgcatttatataactaatttgatgtctggaaacattcatgtaccatttttttttcctacaacacatttcaaaactgtcagtcaggggaagttagcttaagttgctagtttgtttgcatgcaagctgtcttctagaaaaataccccattcatatgttgactaaaatccatttataaagcatcactgtaatgtctttcaaataaacattagcagaatatactaagccctttaaagagtaatcctgctatcgatcacagaggcaccgcaagtcactatgtactgaggccgaatgcaaacaagtttttctattacaaacagaattacagctaattgctaactttttagaaaacacattcaaattgcaccatgaaaacacacactacaagcctcataaagatcttgcaaagagaattctcatttcatggctgcagacaaaaattgaagttagagtgtcacttgctcttccctttgcttgcctgcctggctgtgtcttgaggcattcatgagagcctcagcatcaggagggagatggcacgggaggaatgggacagaggtgcacgctgaggctggaggagaagctccactggagttgggagatggagtcagaaagcccagggctcggggggtgatggatgcagctctgggattgaggactcaaggcaaaagcagatgaaggacttgagaaggactgggggtcatctggctgtgtggccccttggagccaccacgttaaccagactatcacttcaccaggcttgcagggctttgcaacctttatgggtataactttccatttcaacccagtctggctctgggacagagacatcctcaatctgtacactttgctaatgaaaattggggttcagctttttttttttcccgttgaaacattagaaaaatcagccagtcatgaagcccagacatacttatgaaaaacttggtcctctatgtagaagatgctcgacgccaaatctccagctctgactgctctcttgagcccagcacatgcattgcaaatgccccacaagccacaatcagcagatctctccctggcaactcaaaggctacagtgctgaaaactcaccagctcatttcacatttctcccgactcccccgagtgcattcctcattttgtgacccccttgtttttcctattgtcatcatcatccttttggctcccattggtaccctcttctgactctctttttcctctcggttccaatgttgaattagtggctgagttttgcaattccttctctggagtacctccacagttccttctattcctgcaacatggccctcattccagctctcccctggctactctttcatcagccagtcctgtatattgttccctgagctgttttattaatgcagggctcaaataattcttctgcccttcatatataaagccaaagttgggtacaaagccaaggttcctgagcatcccaggctcctccacctgcctcctcttcctccatcccattcagtgctctagagcagggttgatgcacattttctgtaatggaacagataataaatacattaagctttgttagccatacagtccctgtcatgactgctcaactctgccactgcagtgcaaaagcagtcatagatcatataaatgaatgtggctgtgttccagtcaaactttattgatgtacaccaaaatttgaatttcccatcattttatgtgttacgaaatattcttttgaatttttttctccagtcatttaaaaaggtaaaaaaaataaaaataaaaaatctcaaacacaggaaagcatcaaaatcgcctggagtgcttattacaacagatatcattgcgcccacctcaagtttccaattcagatgatctgggtggggcccaagcatttgcatttctagcaagttcccaggtgatgctgatgctgctggtctggggaccacattgcagaaccattgttgctcgaccaagtttcacaggccagcaacccacaaggctccttcagcctgtagctctatcactggcatggccccaaagtgggcgccatccagtgctgtcaatttgattaagttgctaacacctaagagtcaggagaattctcagacaaatctggatgtgcagcttctgggaggggagaaataccaggaaaaatggcaacccttggtttctacttcaatggtaacagttggctaaaactaactagaggccaccaattctcccagccccacctgccctatgggatccacacatggagcccaaggggcaaagcttacctgtcatcttatgtctggctagcttcactagtttgtaaccctggcctggcccctacaggtattgacttcacaatccctggcctcaagtcaaacaggatgatgatgtgggatacacatgaaacaagtgaatgagcaccccatttatttttatttattttgttttttgagagatggagtctcactcttcacccagactggagtgcagtggtgtgaccttggctcactgcaacctccacctcccaagttcaagcaattctcctgcctcagcctcctgagtagctgagattgcaggtgcatgtcaccacgcctggccaatttttgttgttttttagtacagacagggttgcaccatgttggccaggctggtcttgaactcctgacctcaggtgacccacccacctcggcctcccatttcttcttttgcccttccttctagttcctaaaatactccccatcttccacaaggccccttcagatgccctggcctttaaaactctccatgaaggcccaggtagagctcttctctccaatctctgctcttctaactatactgccacattttacctgaaatgtagttatttctgtttactcacaaacactgtctacccactgggcttcaagcctcttgaggcctcaggcaactttgaagacccatcaatgtgcctcaagcattgcttctttgtatatagaaagtatgaaatcaatgtgtttttggatcaactgtattaatgcctcataaaatgcgctcatcccttcatcagatgctgacagggcagaacctgacactgtgctaagtacgggctgtccaccctgagagtcaatcttgatttttgctacaaagtcaaagtcatcattacatggaataagtggatatactagaattttggctgttgatttgctgacaaagtatttaaattcacccttaacacagatgaatttcagaccaaaatagaaaatgtagtccttgctgaggatgaggctggaatgatcagaagtgtgtgatcaccaaaaccttagcgtattttcagccttcgtggatgatcccaactgaaactaaaccacaggagtgaaaatgtcacagcatttaaggggtcactgtggaaactgcaggatttctcccgcgacagtctcggctgttcaggtttcctccctgttctgctaggaagaggaaaggattgctccattcctaagaatgacctgacttaaatgatgaaaaactgggtaaataatcaacttacttggactataaaactaatgtggacttgaaaaaaaggaaaacagaggaagagtcaagacagctaacagacgtagcacgtgggtgtgaataacttacaactgaccaacatgatttacaaccagtaagaaccaaaattccattattttctagagatatcatgtcatacagagattcctgaactcctacagacaaatcttttatttgtaatgatttcagagaaaatagttcagaaaagatttctgatgcattattaactagaagaaattttgtataaacaaaattgtgtgtagatgtgtgtgtgtgtgtgtatgtgtgtgtgtgcctgtgtgtattctccctaagtatacagtagggtcttacctaaagttgcaatggaataaggaaatccaaaaactgttacatgatcatcaagcttaaatgaaaggtttccttgctaattttttacaaatggaaaatccaggctcagtggaaaataaaaggaagtggtcagttaaacccatcagagcttcagaggaaactataactcatttttttttaatattatagcttcctctccctctccccccaaaaaatagaatcacatagatctggggtcaaatctaagctccatcacttactagctgtgtgatgctttggtcattgttagcctctctgagcccagtgtccctcacaggtaagtcatactatgccagctgggaggactaaatgacatagtttctatcacaacttggacagggatggcacataagaagcacttcatgtgactgacaataaggattacaccacactgccatttgtattggtcatacctctgctccttttgtctaagaatatatttccgttgccctgcaatccaggaaaacactactgttcttacaattgaattttcattttgctgcaaaccataacatcttaccacaaaaatacacacacacacacatacacacacacacacacacacacatctctgttctcctattggaagtgagaaaaagaatcactcataagaagttcatccaaactgacaatcatagttacctgaataagaaaagttaataaatgtcttctcaataactctgggggactctatcctttaccatgaaaaccatgcacactcttttgtccccaatatgcctggactttttggtggcctattgcttgctgttaataaagaaaaacaaaataaaacaaaattatggaatgtaaagtagagagaaggcaagcccatctttcttcctctgatgatcaaagctaaaaatgaaccactgtcatgaagtatcgaacaacagacacacacacacaaacacacacacacacacacataaacacacacacacataaacacacacaccccatgggtaaatcaggcaatcaggcatctaccctacgctacaaccaattccaagttctggcaggaacagtccatgaagggcagtaactggagagaagagcaggctcatgtccatccccgtgcgtggggaccatcaggaaatgtgcaccaaaacattttttaaaataaaatatttggtaggtaactgcctgttccttatttttattttgagatgttctgttgcccaggcctggagtatagtggtacaatcatggctcactgccactttgaatttctgggctcaagcaatcttcccacctcagtttcctgagtagctggcactacaggcacatgccaccatgcctgactaattttttagtagagacagggtcttgctatgttgtccaggctgctcttgaacttctggcttcaagcgatcctccccattcagcctcccaaagcactaggattacaggtgtgagccactgtgcccagccttttaaatatttttaaatgtagtcgagaagaacaatcttttcaaagtcatgcaaattcatttcttcccccaaacacatcttttgtgagggacacacacccctgttccctcagctgttctccctgccacgtggttacagaccagcctctttctatattctgctctggaagcatgtcacagacttcttaaaatgtaaccatggttggagtatttcagatatgagccacctaatttagagttcactgagaccccatgtttccatttctgtaccttcaaggtctacaaatccagtccaggagtgcattcacttgtcatctaaaatgacccctcactctttttaatatgaactgctattataccaggtttccctatcggggatctgcttagctagttttttgtttgtttgtttgaactgcaggccttttcattttacctaacaacttattctgtgaattttgacacacagttccaacctgttgaggacttttaaagctgggattccttcagccaagctggtagctgccaggggctgtgctaggcttattaaaagcatgagatgctggtgttggtgagatgtcaagaaatgggcacttccacacacagctggtaaaagtgcaaattggtacagctttccataaggcagtctggaaacagttttcctactccttaaaaatgtgcatagctttgattcaacaattccacttctaagaagtcatctaaaggaaataactagaaaagtatgcacagatataagcagaaagacattcagcataattcacagtgaagtcagaaaacacctcttctatgtccaactcagggcaatggttaaaaatgaaaaaacataagcgcctgtaatcccagcactttgggaggccaaggcaggaggatcacttgatgacagcaattcgagaccagcctgggcaacatagcaaaaacccatctctacaaaaaattttaaaaaatatattagccaggcttggtggcatgtgtctatagtctcggctactcaggaggctgaagccaggaggatcacttgagctcaagagtttaaggctgcagtgagctagaattgtgccactgcactccagcctgggtgagggagcaaggccctgtctcaggaatgaaaaacagcaaaacaacgtgggaaccacacgatgtgatattccacagtcattaagctgatggtacacaaatggaggggttttgtttctggtaatgacagtttgagtcatttagacctaacttcccactaaaaacaactagaaaagctagggaaaatatacaaaaatggtatttgaaagcaatgtagcatttccaaagtaataaagtattatgggaccatgacccagatggagaagaaaacagaaggtatgatcccaaaatggggaggtaactgtcccactcaaggaatctgcagctattaggagaggcagctgagaggccaaaaaacctcaccagaacttcccacagactcacaaggcaaggaagacaaaatccagaaatgagggcctgcgaagaggcagtattgataactccccactccagggtttgggttgggatctcaaaatgctatacccaaggagagagggcgaatgagaagtagatcagtcttcacaaagcctgagacctgttcagtcactgatcacaagtgcccctagcttaggcaccaaccaaccatatgacatcatctagcggctcaatttgtctttaagctgcccatatacaatgtctgacactccaaaaataaccaggcataagtgaacaccgagaagataagactgaaatacaagaaaaaaaccacaggcaatagaaactgacctataggagatgcagttaaaggaactcagaagcggaatttaaaatttaaaatgccacacttcatatgttcaagaaattgaaaaacagaaaagtcagcagagaactagagccacatggaaattctaaaaactggaaaatacaactcaatgaataggttcaatggcattttaaacacagctgaaggaagaaatcgtagagtgaaaaatcggtctgaagaaaatatgcaggacaaaagcataaagagataaaaggctggaaagttcagaaaaaagcttcagagacatatgggacatggtgaaaggtatatgtaattagagacccagcaaaggaggtaagagaaaacctcagaagcaatatttgaagagaaaataagaatttttcaaaattgggaagagatatcaagtcacatacttttataaaaaaaatcacgaatccaaagtattataaatgaaaaagaaaagccacacctagaagaatcatagtaacattgctgaaaaacagagacaaagaaaagaaagatgcggtatattaaaaagagcaataataactgacaaatgacaccacagaagacaaaagaatatactatatggttcaaagaaacaattgtcacctaaagttctgtatgattaaaattgaaaatgaaatatcctttaaaaaatgaaatattcttaacattaaaggtgaaataaagatatttgcagacaagcaaaaattgagagaattcagcagccgcagattgcattaaagaaatactaaggacttttcttcaggagagaggaatattacttttgacagctgcttggagattgtaggaaggaatgaagcggtaaggttaacatgtgggaacctctaaatgaatattaaaggcatggtacagaaatgagaaagagaggaggtaaacagaacccagtgaataagtttacaacagtttaaacacagcacatatccactttcaatgccttcatttccaggaacatattttttaactggaagaagattccatgaccccaggcctcggcatgcctgcctggaacttcagtcactagggatttagcccagatttcttctagctacgtccactttattcttttctctcattttttcaacaaatctgttgagcatctattatgggcaaggcactatacagagttctggggccacagagatgaagacactcattttataggcaaagaaggaaaactcagagaagttcagcaacttgcccaaggttacctggctcctacatggcagagccaaaccctggatctatttccttgccaggaattttctactaagcaaccttgactcccccacccctaaaaagtcacatacatgaatgctcatgttgaatttacccatgttactgtctaatattttattgctattaccattcagcttttttttttctttttttaacagtctcactctgttgcccaggctggagtgcagtggcgcaatgtcggctcactgcaaactctgcctcctgggttcaaacaattctcctgcctcagccttccaagtacctgggattataggtgcccaccaccacgcctggctaatttttgtatttttagtagagacggggtttcgccatgttggccaggctggtcttgaactcctgacctcagttgatctgcctgtctcagcctcccaaagtgctgggattacaggggtgagccacctggcccagccccactcaactttttttctctgacatcctcatatcaccgtcagtctcttcaccatcttcgaagtattccttttcactttctttcctattatttttacctttgtagaataaaaatatcttgaattcataaatggatcgtgtgaccttctatttcttaagatgcgagcatgcaacgttctgcagttagaagaatcccactggaattttcaaccatttaatgatgctacccaaatcatacacagctactgtcctcttgccctggccaagaactggggtcagggtcaaagctaaagctctaatgtggcccaggaaagaaggaaggaggctaccactttgctccacctgcctgatcccatcccacctgacaggacctgggcactggtcccccactgataaacaggggggaagaggccaattttgatagtatccatggggctctgcagccagaccactctccttccttcttccccttaccaaattcagtacctccaagctaagagttatcctcctaaaccctggcaataattctgcatatatctgcattactgtttaacaacttgcaggaaaaattatatctatacagcaataatcaatcatgggtgtatagataatttacggccaagacacattttaaaaagacggttttgttaaatgaaagtactgtttcattatctctgctattaacataacagcccaattttatttaccacagagcttattaccatatgacctcacttttctttttttaattaataggaaacacaaaaacctgaccctactggagaataaaatcctgcacagaaaaattaatgtaacctttaaaaccctgacgtaaaaggctacataggttgagtgtgttaactcttcccatgtccacagattaacattgccggagtattccacgagattccactagtatatcatgatgagaaagaccaacttctaaggcagcttgaagctttctgtcctcaggtcttttcagtttgatttgcttaatgtaaaacaagtattcaaaataagcaacgacttaaataggttggttgaaatcagtggtttcaacttggggcgattttgccccccagggaacatgtggcaatgtctagggacatttttggttgtctcaacagggtgaaagatgctactggcaaccagtgggtagagtccaggggtgccgctaaacattgtacaatgcacaggacagtaccctccctctccccagcacagaataacccagtccaaatgttaacagtgtcatcgctaagaaaccctggtttaaatttttcttcttgaatagctgcatttaaccagatggtctataaccttgtaagtgctaacaacacactggcttacacagctcccacccttgttattttatttatatatgcaaacagatgtgttatgttctttttaagaccacctttgaatggaagaaaacttgccaaaatgtaattacattcaatctatgtcagggtgagcatagtttcattcagtccccaaatgaagacacactggaaattaggtggcagtgcatttaatatggggaggtttcctgagagttaggccttcagttcttgtttaaaggaagaataaggaaagaagaacctccacatttctaggctaaatgaggaacatggggtaaggggtggggtggctgacatagctgaatcagtggatttttggagaagcaggttgtatttataggaggtcaagacttgtaggatgtgaccagctggtaagaagctttgaggatgatcatcaaaggttatatttaatcccaagcaataaaaaggcagcaaccattacgagtccactaagaaatactcagaagacaaaaacacattggtctactctcttcccatccagattgcagacattgccctttatacatactcttacatcctccctaacttccaggcgtagttaatactctgcctccttaaatcataatttatactctgagcctggggcctaattacttaatcttttcaaattcatggaacatatatgggtagcatgtatcatgaccgtgggacagcttgagccacttaataaaactttcaagtccaaatcgtatacaaaaacatcctggtcttatctaaaatttcgacattctctggagaaacaatctttagtgtgttctccagagggattctcagggtcatccaattctgatgcttaaatcaaataatcgtttggctttctctctttgttcctcaaaccccaccaaccccacccccagggttttgtccgtccaaactgttcattttgcttcaccaagtctgtttctgtgccaaattctgcaagttaagccttcagcctttggactatccttttacaagatgggggctcagattaaattctcactaacttgttcctgttgtgatcccagatgtgcttctaatctgtgttccttttgtgtgtgatctcaaggcatttggactaaaatggaaagtcagcattttttagaaagtaattggtcttttattatacgatactttgaatgggatcaatgtgtttcggcaaaaacagaaatgatgacgagaagaaagaaagaagaacacagatagatgggaagatttcacccctttcgtgaggacacttaggataatgagcaggggtctaagctacaggagggtggaaggggaggacgtctgaagagcttgaagtgatctctgcaagtttaaaacaaaagcacagttgtctcctgtctagagtcagtttgtattcaattgttttttaaaaggaaaccaccaatggtgaggatgtttcattatgctaaattataaatcactcctgaaaaataacatttagaaagaaaggaaaaggttttggaaataggctacacgtaccattaccaaaattgtgtcatttcagaatgataaatgccctgtgtgtatttttgaggcataatgcagtaaagactttagtacttccagttttcactagttgagcacaatggcagtgacgccagaaaagaagtgacttttaaaagaagggaacaaaggaagagggggcatggttttggaacaggctgggcattaaggataaaaaagaactcaagaatggagcaaagtagggagctgggtgcctgggaggacactgacacccagaggaaaataagggagacaggactgatttgatcatttttgatatttgatgtgtgaaacatttttacctacttgaaagtagtgttaaagtacaatgtgatccattgctgttttgggaagcatcgatattcctttttacatgcgtaaaatccccattcatcactgggagctttcaatccttttggtatttccagttgctcatactatcctatgtatatcaccaatgtaacaacagctgtttttattgctgctgtcattgtgctggaaaagcgcaaacatgtttgtacagctttctaagcaaaactgtcattttcccttttattaaattggttgtttgtgattagtgggaagagttaaatcgctgtagaaatcctattagaaagagtaatgtaatagcctgtacagggatcccagtccatttcccaagacaggtcattaaattactttccgagaggagaagattcacacagagcattcagggcaattaagaaaatcaccctattcctggctcttgggcatttttgaagtgagatatgctttgagcaaaaccagggaatgtggtaaaggaaaataatttttgcacaggctttagaaggtcacaggacagggaaataagcaatatgtttgaatcctggcctagccacagagcagctttgagacagattaaccctgcatagcaaagcctctctttacctgtggtgggtttggcttccttaattcattgtaaggtgatgcctcaccttgtttgtcctaattgtgagaacaccatcatattatacaccaaattggctggttcacagaagggcaaagatcctagactgaagatatttttaaattctcccactgtggtatactattatttgacagtagactatgaatacattatagaaccatactataaatttcacagtctttcttgatcagacctcctccagagattgagctgtaataccttaacacatccatcatatatgatgaattaatgtctctcctatgcatttagaatggtgttacttatgcatcatccttgggagaattgagaaagacactcaatcatttttctctgtcttctgtgattacgatgaaacactctaagaaaggccgtgcctcacacaaacacccaaaagtaataaattagttaacaaataaataatacaatagagacaaagagctaagaaaccaacatacagaaaactagaatactgattttttaaaaatccaaaaccaggtaacaaaaaggaagtgaaagaaggaaggaaggaaagaaggaagggagggagggagggagggagggagaaaaacaaaaaacccaaacagatggaaaagtagaaaataaagaacagcaacttcaaaaaagccaaccatattaataattacattaaagataaatgatctaaatactccaaaataaaaggcagagatggtcacaggcagtgaaaaaggaagacttaactacacgctgtcagcaagaaacccactataagtataacaatgcatatagattaaaactgaaagagcaaagagcagtaaatgatatattatagaagatgaaatactatttgataaattggacttcaaaattttaaaattctgctgatcaaaatacaccattaagaaaatataaagttaagccacagtgttgaagaaaacatttgctacacaatcgacttgtatccagaatatataaagaactgttaatcaccttaacgcacgtaaaaatgggtaaaaaaaatctgaacgtttacaaaaaaaaaatatatttgaatggccaataagttccatgtaaacatggtcaatttcatgaaatatcagggaaatgtgaactaaaaccacaatgagataccaatatccaaccattataatggttgagttgaagaagactgaatataccaagtgtaaattataaatcaccaccaccaccgacatataatgtataccttggtgaggatagaaacaatagaacacatatatatttctggcgggaaagtaaaatggtagactttgggagacaatttggcaatttcttagaaagctaaacacttgaaacaggaattccattcctgggtatattcccaaatgaaataaaaatatatttctacacagtgacttacacagagttaattataacagctttactcttaatagctcaaaacttgaatcaacccaaatatccatcaacaggggaatgtatgagcaaactgcagaatatccaacaatgagttactactcaagcaataacaagaaatggactcctgataccaacaacacaaatgaatttcaaaagcattatgttaatcaaaaggagccagacacaaaagagtacaatcacatgatttcgtacatatgagtttctagaagagagaaatctaatctttagtgctataaaacagattggtcgttacttgaagccagagttgataagaaagactgattgaaaaggaacactacaaaggaactgactatgaagaaatatttttgggatgagggaaatatttaatgtcttgatttgggtgacggttacgtgggtgtatatacttgtcaaaattcattaaactgtccacttatgtgtattttatctttttattgttttacttcaaagtttatttttacaaaaatctccactgtgatatggttttctctctttttaattctacaaatttctatggtatatattttgaaaaaatcctaaagcaagtgtttcagattgaaggaaaatgatactgagtagaattatgaccaggctagtagactcattttattattatgagataggactatttctcatcaaacttcctgtcttaaatcgactatatttaatattgttacagctggtcagcttcattttgatgtgtttgcttgcatggcatatatatttttctctccttttacttgattcctgtaggaagttctatatttatatatacttcatttctgtatgtattgacatttaaagtgtatctcttgtaaatcatatacagggagtttggtttcttaaccccatctgataatccttgttttttaatttttccatttaattttactataattcctgcagagctgggtttaagtctggcatccttctacttattttcttgtgtattagtattttatttttcctgtttttttaaaataaactttatatttttattatttcatctttctcttatagcagcttcttatatcttactgtcatcctttcagtgcctactttggagataaaaatgaggatcccagacttattattaacttagtatctttactgttttcagaataagcaaaaatattataatagttgagctctatttgttcctccctttgtgctattcatagtttacttatccatatgttgtaaagccctaaatatcttgcattattgttttaaagagttaatagtgttatatttaccaatatgtttacattcttatgctctttctatagttctatgcttctatctggcatcgttttccttcaacctgaaggacatcctttcatagctcttacagtttgattctgttagagacgaattttatcacctgcttttggtttttaaatatctttatttttcctccatttttaagagaattttctcccagtttgaattctgcattggcagtttttcttacatcttgaccttccaagatatctttccattttcttctggcggtttctattgaaatgtcaaccaccagtcttaactttgctcctttgaaagtcttttttcctctgaatgtttaatagattttctcttggactttgactttcaacagtttgattatcacgggctcagatgaagttttctttgcatttactctaattggggctaaatgagtttgaaattataattaactattagtcataacttttgaaaaattctcagccattatctccttagacattgcttctttcccagtctctctcactcctttccttataggattccagttatatgtagttacacttttcaccgttccatgtggcttctgtgctctgttctgttccttccattcatgtctactgtgtttcatgtctattgatctgtcttcaagttcactattcccaacaacttctgtttccattccaatgagtacttaattttagatattgatcatattattcagttatagaatcatatttgtagaatccaggtcactactgaaattctgcatatttttctccatttcagagattttgtttttcgtttttgctgttttaccacaccaatgctaattagcttcaagtccttctcagctaatttcaatatttatatattggtggctctgtttttttctcttgtcagtcacagtttcctgcctgcctttttttgagatggagtcttgctctgtcacccaggctggagtgcaatggcacaatctccactcattgcaacctctgcctctggggttcaagcgattctcatgcctcagcctcccaactagctgagattccaggcatgcacaaccacatccgacaatttttgtatttttttcttttcttttcttttttttgaaacagagtctcactctgttctgttgcccaggctggagtgcagtggcgcgatctcggctcaccacaacctccgcctcccaggttcaagcgattctcctaccttagcttcctgagtagctgggacttcaggtgcatgccaccatgcccagctaatttttgtattttagtagagacagggtttcactatgttggccaggctggggaatttttgtattttttgtagatacagagtttcgccatgttagccaggctggtctcaaacttctgaccttaaatgatctgcctgccttggcctccaaaagtgctggaattacttgcatgagccagcgtgcctggccctcatgcctgcttttgaaaacatgtctagctactttttattttatgctagacactgtgtatggcagtgccataaaggatccagatgattttcccaccagagagagcacagcctttcatctgtaggaaaattggactgatgtgatcagtctctcacttgccaggaattgagctgggtcagggttgggctgcacttctagtaaggctcagtccaagccttagtaaggctcatcctcaaggatggttccttgacggtgaccatcctaggcttttaatttaggatctggagtatctgtctttttggcccacaaacactacaaaagactacagatgaagttcagttttatctttgcaaactagaagcgtactctttagctttcttgcccatgcaacttgggcaggaaacatgacatgggagactagttatgtgtttgttgcaagccccattcctcttgctggaccttgtctcccaagttaccagcagattgtggaagatttcactctgcctttctcacccagtacctcagcctcctaaatgatgccagaaattatatgtaaatttatactactttgtcaagcaaactttcaacacaagtcttttcttttttcactattaacactttaagcatcaccatagacatattgcttttactattgactgacttaatattgtttgatagtataaaagcaaacttttacacagccactatttaaaattaactcaaatcttaagtgatgttttgactattttttcaaattgtgattttctatttgaggaaatgccctcaaactatatcttagaagtttaaaaatattcattgcaacttggccgatgcctggtgtactttgtggtagaagaaaactgaacatctcatctcagataagaggcattatcatctcatagttagcaactgcaagtaacagctgtgatgtcttggagaccctttaatatcgtatccattgttgaaggtcagatcttatcccttaccagtccaagaatgatgtatgtgtcagctgtcatgaagccccttctgggacaagtagagagatgcatttatacaactgagtagatatctgccatttttgcctgcttgccttctattcacctcttatatcatcccagaacccagagttattttggggaaccacggttctcccacccagtcctgtgatttcagtggactatctccttccccctatgccaagagtggacacatggcccaggcttggccaatcaccgtattctacaccttttgactacattgatcgtttcaaatgagggcacatgacctaaatgagatctcagagactctatttgaggacttctatttacatcgttgaggaagacaatgtttgcagctggggttgttgagaaggggagacaagactgtagctgttgtcagccatcttgccatgatgaaggtcggctctctctgagggcagagacaacagaaagaataaattccagtcttgggaacacttgttgagtcactggagtctctcatatctaaagccagaaaatgcccctggactttgggtattgtaaacagaaaacaaattccaatgtaacataagccggctttagttttctgccactcataaccaagagttgatttattaagtaattcttactaatggatcatcattctcagccagacttcattccaagaaaaaagggctagaatgatgcactgggtccagaaaatggagataaaattaaagtgctcctattgcattacactgagtgggaatccattcttgggagttggctctgtcacaatgcaaatatggacatcaataagccactaagctttggaggagcagagaaatgcagttttaggggctggactagcagttagagagaatagttaaataatcagattgagatgatctaagacagttgtaaatatggacttcagccttgcaaaatattagaactgcaggtaaagattttgtgtcatgttaacagaagcgacagatgaaatgggctgggtgcagtggctcacgcaggtaatcccagcactttgggaggctgaggtgggcagatcacttgaggtcagaagttcaagaccagccgggccaacatggtgaaaccccatctctactaaaaatacaaaaattacccaggcatagtggcatgcgcctgtaatcccagctgctcaggacgctgaggcaggagaatcgcttgaacccaggaggcggaggatgtgctgagacaagactgagccactgcactccagcctgggtgacagagtgagactctgtctcaaaaaaaaaaaaaaaaagtgatagatgatattttggagtattctgaaagggtccagagatgcaatgcagtaaaaaacaagcagacagaagacagaaccctgggagttgcatacatttagaaggctggtggagaacaggagtgggaaaagaagctagtagagtggtcaaaggggtcggaggagaacaaggcaaaacctgggaccaagaaatccaggggcagcaattgcaagtaagagaaagaaatcaccaatgacaaataccaataattaaagaccccagagaatgtaagagaagcaaggtatttaccaaggcattattgaccttgccaaaagatgttccaagcaagtggtagggtagaaccaggctgcaatagttacacagcaaaacccatggtacacagcagccactaaaagcaatcagctgcctctgagatgcctggtggctgaggtaggggcagaaaggcaggtgggtgcagaggtaacagtatggaaactggagtgctaactctcaaaattatgtaaataccatcatattgtttttaattatggatcactgggtgggatgtgtctcattatcaatgggaaggtacaaaagaactttctcagtaaataaaagaaggttgtaatgcagagtagcacaggtacagggaaattattaacatagtctcatagctgtttggtgagaatgggaccaaaatatgaaattgtgcactatgagagggatgatacatttttgttaagcatttattgtgcaaggggatatggtggaccctaaggagcaggaaagaagtccctgcctttagggaatgccagtcttcattaagggtcgttgcagggaaaatctctaggatgcctcctctgagctgagctaatactaaatctcctgcccacctttttagtgggttatgggtcttcctcattatacatacacacaaatacacacacacacacacacacacacacacacacacacacacacacctgcacgcacacaagctgcatgagatatactcaaagactcctcattggttttctgaaatttaaatttaaccgggcatcctatattttatttggcaatgccacattccatgcatgtttgctgaataaatacagaagtataactggggctggagtgggaggagaaacctgggagaggaaaataattctttttaaatctaatctccaaaaaacaattataaaaaagtagcacagtgcttagggcacagcactggcagagcagatgagacctttgtggcataaggaacatgtatctggtctctgccccctgttcctggaacagaacttctaaaacccctgtaatttctcgggtgacaggaacgtcttttgttctaataaggtgactcttggtgggctcctggatgggggctggtcaccagaaagactgagccatgattagaagctgggaacttccagcccacccccatcctctggggaggggagaggagctggagctggagttaaaaatcgataatgccaaagtgatgaagcctccataaacatcctgaaaagaggagattcaggtttcagagtggtgaacacatccatgtgccaggagggtggtgcactgcaactccacggggacagcagctcccacgctcaggaccctctagaccctgctctataggcacctcttcatctggctgctcattggtgtcctttaccatatattttataataaagtagcaagactaagtaaataagtgagtcccgagtcattatagcaaattattgagcctgacaagggggtcatgggaccccttcacttgtagccaagtcagagagaagtgtgggtcacctggggaccctctatttgcaattggcgtctgaagtggagcatcttgtgggatggaaccctttgcctgtggggtcggtgctaactccaggtagtcagcatcataactgaactgtaggacacccaactggtgtccaaagttggagaattggttggtgtggaaaaaaaaaaaaaaaaaaaaacccacgtttggtgaccagaagtgaagtataagcgtcaagaccacggtttgcattttctgtacagctgcaatgagacgacgtcagagaggctgtgagaaacccatggcagagcaccagcgggggacacaagatgggtgcagagggaacccgacagcggggccttccaagcacacctgctccttccctctccaacacctgggttctgtcttccacaagctccagaacagcaagtcctgaagtgagaacctggccgtgcctctggatgaatgtgacttaatttaggtagttgtctcccttcaacaaaccaaacacaagagaagaaatgctgtgtgtggctggatggtcctgactatgtggttaatgagatatggatgccgtgtggtcagtggagtctgggtggtcagggaaagcttcagggaggaggcaggcctgtggggagcctttaaggaggaggagaacataaataggcagaagtctctctgaattcgttgtaattaaacctaaacactaagccaaacatgatatcaagattgtggctggctttattaaatactgtttatgttgtagactttgcccttcttcagcagcaagcaactgccttctcttctcttgttagacaatggtgccgtcaaacccggggacatcagcacatctcaggcgctgacaaaccaggaacgatgccctctcatcgcagccacatatgcacgtgaacatatgtgagccacatcgccaaagctaacaggtagttatggtcaagtcttcagattttgcagtttcttcttttacttttcagtaatacattattacttacttgcataaattagccatgttggttcagatgaagagacaacatcacacgttgctactttgcttacagtttctttgcagcagaaatgcagagcagcttggctgaaaggtcccagcctgagggtctctcatgagggtgcagtcatcacctgagcctgcagcttggctgggatgaaaggacccactgcaagatggcaccctagtatgcctggcaagtcagcgctggctgtcggctttccatatggtatctccacagggctgtttaagtatcttcatggctcagcagctggtttcccccaccagttgagagggccaagaaaccaaggtgaaaagtacaatgtctcctatgacttaacctcaaggtcacacacttctgccttcttctattggtgacccagaccaaccctgcctcacaaaggagagggccttggaagggcaaggatcaccttggaagctggctatcacaaagcccttgaatttaactttgaaaatgcaaagtatggggtcaaagtctcccacctgggaaacagaacattttaagatctcatatggaatagccagacatataagatgaccatataaaagggtggaagagaatacatacacctcatcaacaccacctgcttcaaggtgtgagccccatccatccatctgtccatctgtccatccagccatctatccatctgtccatccgtcgatctgtctgtctgtcttcccacctgcccttctatccacctacacatatatcactggtatttatcacagaagcttctgtggtcaactctaggaaaaagtggtgaataaaaaagataagtctctctcctcatgggatggacagttaaggctgaaaggcagacattaaacgaggacataaacagataaagaaaatggtgaggcagagcgtggaagaaacaaagaataattacagcaaccaagcgagtgggcatctgcttaaatgagataatgagggaaggaagacttccctaaggaaggggttttaaggcagagacgagaagggactcattcaccatgcaactagatggggtgctgtaggcactcacggatggaggtcaggaacaggcattcccaaggacattcccagggctctcctggacaaaagccagaggaggagccaagccaggaataagatgagaagccaagtgtggaggatgaggcatcaccaccgacctgagcaggttggcaggagtagcgtggtctgaggactgctggaggagctgagggtggggcaggaagtaagcttggagagagggacatggacgcaagtcccacaaccatgggaaaagtagccagctcgattgttagagaggagaccaggtgtccctggtgagggagagcagaaaccagctggggatgctgtggggtgaggatatggtgtgaggggggtgctccaaagggagtttcaatgcagacagagtagggcacagggagtgttagggctgcaggccaacgtctggctgccctttggaacatcacctcaatggggccacacattaagaagttctgctttgaatttgggacaaattttgggagcaccctccactcataaatgagacacactcaaatcaatcaagagatacgacatggacattttcaggaaaagaagatttgtctgagagcccattgtctatataaaattttcaatactctattttcaaaccttgtctaaaattacacccccaaaatgtcacttgactactcagaaaccttcagtggctccccattgccttcagaattgaagtcaagcccccagcatgatattcagggccttgtttaatctgaaaactcctcaacccaaccccaaatctagctggaataggtacttaatagtcacttgcaaacataaacagaggactggaacttgcctctcagagcacagtcaatgcagagcctcgttcaaaacccctgctatgaggctttctatggaaggaaagggagaagcgggggtttcagcagactgccccagtttgtacagaagctaggactggtaaggtaattaacgttccttctcatttgggcctgagatgcagggcaaggaaacggtaagcatgccgctccaagtcactgcatttgaaatgaaacagttaaactcatttgccgtcatggttgcaagagcttcttgaaaggagttgctctgaggttaatgagcatgataggtcaattctatgtgtgctgaaattcttggaatctgaaaacatggcagttgtagctagtcagctttcactgaaaaatgtacatgtgttgtcttcgagggtatttacttaactaaagacgtacgtttccacagcttctggacatttattttataggaaaagatctttaaagtttctccaactcatttccccacctgccaactctgctcgccagctctttcctcgtaatgcctgctggagccaaaagaacgtctccgtgttcctgtctgttataaccaacaaaaatgcatccaatcttttgtatttgacttaaggatgctgtttctgtcctttccaaccgatggctccttataaccctgtctgggcaactgaagtatgtggcataaaaatcagaatattagtttgatccttggagctgggaggatgaccagtttgtgttttgcccatcacaggcgtttcccatggcagctgcattcccagaaacacttccagactgaaccagacgaggctcagtacctgccaatgaaacagcaggctggaaactcagtctctggagctccaccgagaccgttctggagatcaacctcacaaagctcccttctctttttacttaaaactgcaaggcaagggtgtctgtagatgtgtgattcttcacttttccacagcagatccagacatgaaaatcgcaggacagcaaatgcccactctcaatgctctttataagcaaagacacagacatgggcagctagtgtctggctgaccgacagctcccagcgatccgatgcattcccacgaagtccacttatgagatttgcctgtgtcaaggaacactaaaaccagcaataacttttggcaatgcaaacgcattcctattagctgaataggcacgaccagagattatatgcccccgtggtcttgttttgaactacaaaagaaggagctggatttcaaaggagatatgatagaattttttacccctgatgggctcttaactcttccttatgtttgtagtgcaggaggagttaacatttctaagagttctgtttgagcaagttgcaaagtagctctgaaatgaaatggccagttttaatgcagtttttaaaagggcaaaatatctctatcacttagcacagggcctggcacataaaggattctcaataaatatttgttgattaaatgaatatacagaaaggactcaacagaaaagcagggtaatctctaatcgtaatttcttccccctcaaaagtgttaagtcaaaactcatggagataattccacccaatagtatcctaggcagggcctccgccctcagcagctgagcaggtttagagccattcaactctaagccccaagttgcgcagggctcaatttacatggctatacatgtaaattgatgaaaacatacacctgatgaggtgttcaaggtggaaaaattaaagaaattggttgggcacggtggttcatgactgttatctcagcactttgggaggctgaggcaggtggatcgcttgagctcaggagtttgagaccagcctcagcaacatggcaaaaacctatctccacaaaaaataattttttaaattagccaggggtgatggtgcactgattgtgccactgcactccagcattggtgacagagtgagaccctatctcaaaaaaaaaaaaaaaaaagaaaagaaaattgttaaaagtctacaatagctaaaatagcattttccaagtggtataatgtgttcccccatgacagacaaatacattttaagaggtatacagcacacttcattttaatcagttttagtgtttgagaaaaaaaatcactaagtatctcaagcatgtataagctattcatatgataagctgtaatattaatgatgtgattgcttttataattaggttaaattcacgctggtgggtcctgggtgactgaagtttgagaaacatggatgcaaactatgttgcctccatatacagaaacatcaccgcgagtccatcaatgatgggaagtgctgtacctgtgatgtttctgcaattgagcgaatccacccacagcccttctgaggagtccttcctgagacacctctggggtgggacctgccaggtgaggccgaggaacacagccaagctaatggctcccatggaaacgggaaatcttaatagagacccaatccacaaccctggatctcagtagctctgtgctctcaccaactctgttttgggtttttgaccaaatctttaaacaatatgcttggaaaattagtaggttcaagcaaaaagaagacccttagtacctctgctgagtaaaaagtgcatatggcagacattatgccagctgaatgaaacattttgtgtgccaactttagaaaagggtcaatttaatttcaagtaattagcagaaaggcagccttgaggcatggatcaatgcaaggaatgtgaaataccagagctaggtcaaatactgaagagttgggaattaatttttttaagaaatgtttttttcccccagggaaaagagcctaatgattaggtttctaagtaattgatttaacttattgaacatagctattttatttatgtctataggtacatccataaagagccaaattcctggcatatttccttttataccattttattttattattttttgagatggagttttgctctgtcacccatactggagtgcagtggtgcaatgttggctcactgcaacctccgcctcctgagttcaagcaattctcctgcttcagcctcccaattttatgccattttaaattaattatgtgaaaagatagggtgtgtctcagccatgagccagcacttgagatctgtttcttttataatctacccacagcagacatacacatatatttcccacactctgtcagctgagaaggcctagaagcaatgactgcccagtagcagtgagcctatctagtacctagagtctctaataccattctccaaggaatcgggctcgtggagaaatggctgactttaggacaggtacaggaaatataccagatgaacccagtgcagcttgcagtgccagaaaggaaggaagtgctagaacacacacacacactcaacagtcataccatctctctcacacacactctcacacattcttatacattcccatacactttcacacactcaaactcacacactaatgtacacccacacactcacatatactttcacacacaaactcacacacattcacactctctcactcgcatacatccacaagctcagagtcactctgtcatacacaaacacacacacattctaacacacagatacactttcacatacattcaaactcatgcagtgacattcacactcacacattcacacattctcagagccacactctctcacacacactcattctaacacacactttcacacacactcaaactcacattcacactcacacactcacatacacccacacactctctcacacaccttcacacatgcatccatgggtgtatgtcaaagagacacaggagccagtgaaaagaactctcaatagccaaagtaggaacaatttgaacaataaaataaataagagtattggattatattctaaagtataaaataaatacctgtattagtctactctcacactgctaataaagacgacccaagactgggtaatttttaaaggaaggagatttaattgactcacagttccacatggctggggaggcctcacaatcatggcagaaggcgaaggggaagcaagacacatcttacatggtggcaggcaagagagcatgttcaggggaactgccctttaaaaaaccagcagatctcgtgagacttattcactatcatgagaacagcatgggaaagacctgcctctgtaattaaattacctcccaccaggtccctcccacaacatgtgggggattgtgggaattacaattcaaaataagatttgggtggggacactgccaaaccatatcaataaccataagaccacattaatgtcgttaaatgattaaaaacataaatagggagcacagacaaatctcacatgcatgagaattccaaataatggatgcagctacctcgccatccaggggtgcagcgtaactccccactcctcaagtatgggatgcgcacagtgacctccttccaggcaacacagcatgggaagggggaaaaaggagctttgtaagtggagaaacccagcaaacacaacctcagccaggtgctgaagcacctacagataagacatatgcacagtatgtccccttgatatggtgtaacaagatggggaatttgcctctgtgatctgctgcccaaaacagacaagcccagtcccatcatgagaaaaacgctggaaaatcccagctgagggccagtctatgccacacctgatctctactccccaaaaccgtctaggtcatcaaggacaaggaaggcccaataaaccgccacaaccaagaggagccttcagagacacgacactgaacacgatataatgtgaggtcccagatgaaccatcagaaaacgaacattgagtcaaagctaagaaaatcagaataaggtacggacattagctcctaataatccactgataagggcttgttaattgtgacaagtgtaacaacaggggagacttggtgtgaggtacatgagaaccatactatctttgcaatttttttataaattaaaaattgttcttatataaaaagcttatttttaaagatctagcaagagcagtcttgggaggatggaagggtgggaattgacttttattcttccttgccccaaatctctaatgggcagatttctctaaacacatgtagtcttgggagacacgtgtttccttttgaccatttacgtgtggtgcccaccatgcattctcaacggggatgagcaaaattggtactaggaaggggacgaaaaccttcgctattacaaaggtttttaccctccaaagtttagcttagcacaacccaataaaatcttattccttagtgttcaagttctcttgttagaaagaaactaaatttaaattcatttagtttttctctttaggcaggcggtaacaaaaaatgctggtaaaacactagtgtgcaccaccaacaatgcatgtcttcctcacattctcagggacacgtgcaagacacaagagcatgaggagtgtcttaaatatatccaaaaggaaattcttcccacagcggctctctatgcaggcatatgttacattctacaacggtgctgtagtcaagcgttgttttaatataattttatatacgtggttgcaggcactgtcaggataggtataaaaatgtttctcactttttagggaaagaataggaggatttaaaaaaatctgaactttacattttggttgaacaaaaacatcttcatcactatcacaactacttattgagtgattattaaggaacggtcctcactggttatatgttgcaacttcaaagaaattccacagtaaacacgtagatgaaggcttcctcagctttcctctgacataaaattataaagtgcaacattaataccattaaatctcttgggaagataagctcttcagtttaaagtaagattttagaatcctaatcctttctggaagttatatgttcttccaaatgacctcaatccccagaatgttctctctcttattaaaaaatgtcaggcttaaaaagaaaaaaatattgtcacaaatgaactacacaaagataattgtgaaaaatggggaaccaaggtatgcagtatataaaaattctctgtaatgtctttgcaatttttcaataaatccaaaacttttttaaaataagttgtttattttttaaaatcccatatgtctgactaagtacttattcaaatttactacagtctgtgagcttctcaagggcaggattgggtcccattcatccttgcttcctgggaacctgacctcgggtctcaaagacaacaagcattcatacgtccttgggcaaatgtacaactgaaaacagaattcatcaaactccttctctcctaatgtcaagtaactataagccctacatgtcagtcaaacataaaaagcattactcaggattacaaaaatatattttacaatttctgtctcaagaaggtaaatcatgatatctcctgcattatccaaatttgttcagttattttaaaatatgatttttttttcaaaaggacccagtttaatgatgatgacagaagcttgtaggggaaggaaaaggtacagaatctaagacaacccgattcaataaaaacaatttaaaagtatgatattaaggccttgctaagaggtcacaagaaacaagcgagtgggtggtgagtgttgttggaaatgcagagcccttccttggttgaatgagagctccctaagccagggacacagttgaaacaagtacaataccttggcctgctttctcctctttgtgtgttggccaaaaaggaggagtgaacaggaaagaccctggcagggagttgggatgcaacaatcacatcttgttgaagaaagccagatctccctcggaggcaagacagacagggagggagagagcgctggcgagtgctcaccacgtctgccccctgaaccatgacctcagctgtctggagtcaagatgtatgaagcagtcctgatatgatgcccaggggaaagaaagttaaagatttttctgaaaggtagcagaggaatatgcaaagaatactggatttcaaatctgacaggccttggcccagatgctagtcttctcgcttaactttctacctgggggtcggggggggggcttcagcaacctcatgtgcacaacagcatccaccttgcagggctgctgggggcatccagcgagctgatatctatggaatatctagtctaggggttataaactatggccctcgggcaaagccaatgcactgcctgttttggttcagcctgcaagctaagactcatttcatattctaaaattgtttaaaaagatttttcatgacacatgaaaatgatactaaattcaaatttcaacgtccagtaagttttattggaacatagccatgctcattcatttatgtattatctagggctgcttctacgcaacagcccagttgagtcgcttcagcaggtatcattgtgacctgtgctgctgaacatatttactgttcagctcttcccagaaaaatctgcagaaccccagtctggctccgtccaaggccaagacggggatcccagtaactgccagtttcctgtccttccacatcttttctcaccgtgcagtggttctcaacccggggcaattttacaccccaggggccacgtggcaatgcctggagacatctgtgactagaagagggtggcgctggcatcagtcaggtgtatcagggatgctgctacacatccaggaactcccaggccagtgccctccccccacacacagcaaaggcttatccagccctggggcagtgataggaggacccggtgagggacaggagagaggctggcatttgctgaggatccagcatgtgtagggcatggcatcaggtcacaaggccaccatcaccatctcctttacagctaaggaaacaaagcctgagcaagggcgaatgacaagcccaacgccacacagcaaggcagagggagtccgaatccatttctgcaggttccaacatccacggttcttctcctcccaccatgcatggaaatgattctttaaacagctgagctcccagacaagatacaagggtgccagcttttacctctccaaatcctctctccataatgatgggttatatgaggtctggtgcaggagttggggcctccagcagcctcctgtgtggcagacacagcttcatgaggattgtcaggccaagggtggggttggggttcccacagaaggtaagaaactgagtgggacagaccatacccaggaacccagagagtctgggaacagtgttccaaccatgagccactgtgcatgtcatatgatgatatctattccacagtaggtattttagtcattacattcttaagaggaaacaccattggctggcttggaagctaatgtaaaatagatgcttcctaagtctgaaaggctaactattgagcctgttcagccaagctggaggtgctaccatctagcctgagcaactcctgcaattactcgaataatcccttagataaaaaatataggtctggctatgtcaacccacccatgtagagtaacagcactgctcttggcacagagctacacttggggcggtgtcccaggtaagataccacatagcactaaagtgaagaaggtagcattctatcagctagacgcagcctccaaatgattttaaaggacccagagttgccaaaaggaggtaggaaacatctaaaaagttgtggtagtcagagtggtttgcaaggctcaggatccaggcacggataaagtctcagagtcagtcaacaagcatcctgcaatcactccactctgtgccaagcactgcaccaaggtggaagggcacagagctgtggctgctgccctgagggagggcacaggctggttgggagaagcagggataaaaactaataatgatggtactctgtgatcgcgccagagagctgaatcccaaagtcatgcatggttggggtctaaggccagtatagaaggtagaggtggcacctgaggcacagtccaaattaatctttgaaagcctcacagctttcatgcttttatacaggttcagcatttcttctccacagagcactggggcattgcttattgggttgagcatagtcgagttggcttattttaggggttgcgctatttcatgatatccaacagaaagaactagaactgctcttaggaagtaagaagcttgcctcatgagaggcagaaggaactaagaaaacagcagatgcccacatgctccttggggacccaaggggatgtgatcacctatgtcacttaagttgcgtctctgcagcatctgtttctgccatgtgcaaggctgaatttgcatgaattaaatgtgtgcatgatatgattgcacatcacagagatgtggacaacttataaagacaaaggtatgggaaggaagaatttggccaggaggccaggggttcaggatgggtttcacaagagaaggtgccatttaagaatgagtgcttaagtggtgcttcaagaatgagtaggactgagggagtcaggggacatggggacagaacatagtgcaagcatggtgtaaagaacgtggcctatttaggcaactggctgccctgacaagcttcatggctaagatgtaggggtgggggctctagagtccagatggcccaggctacccagtcccatgggcatcatgctaagaagcctggctttgaattcaggtgtcatccgggacttccgaaggactggaaagcaggaagggaacaggttctatctgtgctttagacagagtaccctacctccttttgtagaatggaggaagactaatgaaggcagtggtagacagcagaaagaagaagcacatgtcaggatactgggccagtagagttaagaagtgtttcaaaccttactatttcaggggagaaggaagatgacaaccttatcttctagggacaattaaattaagtgggaggcagagtctacgttgggggacaatacatttgcataattgggaactttcagctggaggtacctgtaattgattggaagtagatgatcaaatctcaggggtcaaagcagaatgagaggtgtggattttaagtcaatgcatgctagatgacaaaagccgaagttattgttcgtaacacctgatacagcggttcacacagtgggaactccacgtgtggtagctctcactgctattttcacttatgtgagcccctaggtgcaagtagaccatgaggtcacagttgagagggacatcaccagcgggacccttcatcagaagtggggccacaaagaaactcagaggacaccaagaatgagggacagagccaggaaagctaatgaaaagcaaaaacaaaaacatatgagaagaaacatgagaacggggtctcaggagcccaaagaagagaggagttcagaggaggagagggaatgggtatcaagataagtaagataaagagtgaaaggtgtgtgctggctttggaaattaggaagccatctctgaccttggcaaaggccattccaatgacatgttgggaatgggagctgctaccaagggttgggagggaactggggggaggcaagccagtgaatgcggatcacctttctgggaagtctggctgtgaaggaaagaatggggatggttattggaggggagagcagggctccgttttctcagctgtaaaaaaaggcaaatggaaatgtatggagtagaatgtgcctctgtcattttaattagctgctatttgatatttgagacctgccatatgctaagggaagctttggtttcatgttctaatgggtttgccttccattttccatttcttatactctttctgtaacttcattctcactcaaggaagctggaaattggacatttcctgaagtattcaaaggccgagctcaagtgaggtcatctcacgatcaatcacattttgacatgtcttcgctggttccgcggttaattttttcaagacatgaaattggaatttggttcctaaagacactgtaaactttcagtgtcaccttacatttctgtagtagtgttaagtttctagcgtattttacagccatcgtttcatctcattctcacaatgacccttagagggagggaatgcagataagtttatccctgcattatagacaacaaccaatgaacaaaaaagtgcaagctctccaacacacacaaggtcacctcctttcctgtccctctactctttccactaaattatcagtggcagtgatggcttgattcttgatttggaaaggacattctaacatcccattcagaaagaaagagacagagaacttgacagtaattttacctaaatcagccgaatcgacttgaccagcaatctggcattggatgcagcatcaatttccccaagtggatctaagccttgggtgctcactaaaatcaccggggagtattttttttttttttaagaaatctgcatggacctgcctcaaaccatttaaattaactctcaacaactggaggttgaacactgttatttgtaaaagtttctgggtgattctaaaatgcagctagggtgagaaccagtatacatagtaagtcaatgacgtggtgaacaccaaattagacagggggtcctttctctttgggggtgtatatgatggaagctcctgccacctatgtagccagggccaaaacacaggggttgtccttaacaccttgaatccacgggcaagtccaacaaactttcccttcaaagtacgtctccagtccaatcgcttctggtgctgtccgtggtcagagtgtggacgcctccctctccttcctggacagttgcactggattccccatggctctcctcatttccattcagggccctacactgcagtctgggcacagctgtcagaggtcactgttaaaactcacttgcacgtcctgctccaagcccccaggaaccttctcatggctgttctaccttgtcagggccctgctcacctctctacacgctccctctttggctccctctgtcgctgtttcctcggcctggatgctcttccccagaactccacatggcaggctcacccttcatgtcatttaggtcaccttcagatgtcacctccacagagaggcctttcctgaccaccctcagggcagagatgcagctccagcaccaggtgcatggcaggcacataatccagatttgggaatgagtcactgaacccccaggaacttgttaccactttttagcccaaagtgctttgagacaaagcacagcggggcaggtgaccaggctgcctgaggtcacaggggtggccccatgctatggcaccataggatgaagaagaatgcacatgaggagagaatggagggacagtcagagccccggagccatggcgtggggctgtggttagtgcctctgggtcacagagcgacgtgcctttcatgccaagcctagagtttgtcttcacactctaggatgcggatgtgaggaatgcctctgaggttttcaaggaaaatcatgatgagttagatcttcattttaggaaaacagttgtggaaatctgtccggaagaaagccagaaaggatgtgacttggaatttgaggccccctttctttaggttcccatggcattcccagccagaaattgctggccaaacttccagatctggcttactggacttgccatggccatcagataaaatgtttaagagttagggatttctggcagggcacagtggttcagcctataatcccagcacttggggagatcgagacaggaggattgcttgagcccaggagtttgagaccagcttaggtgacaaaggaggcctgtctcctaccccctccccaccccctcatctctaccaaaataaataaataaataataatacgaagaaatcaaaaagctaggcatttctgtataaataaggaatgtgtttcatggttgtgaacactgcatgtcacctctggggaaaaagagtcacaaaaaattaatgttatgatttggtaagtcatataaaatcagaatatttaccagagaaagaaggtcacagtttatgtcgctatctcagggtgaatgtctgtttcctacaggctactacttccacagtgagttcacacatgggaggagccctgtgggaaatcttggcccctgttgctcccgcatcactccaagtctgtcttattttccatgctctagacacacctgcctcctccctgctcctccagcctcttacactctggctcttctcatggctggctctttagaacttattgaaaaaactatctttccttcttagaaagggctttcctggccaaactatcaaaatccatcttccctgctggcccctagaatactttgttgtttttttcttaacacttatcacaatgtgaatttatttaattatgtttcccttactgcaacgtaagttgcaggtggcagaaagcgtgtctgccttctgcattggctgtatgcctagcacctggcacataataggtgcttagttaaaaactggctgaacagaaagaggcaaggagtgagaagcaaatctaaaagtctatattctgaggcacagcaggcaccgttgttctgcaaaaatattcttcacgtgagtatgttttgtatactgaagatatactgcatgattcagttcaaaatgaaaatcttgacttactggtaatgaggacagatacacacatacacacctttggccagaatgcctattcccacagcatgtatacacgtcttccccatggggaattcctgcaaacaggtacacacacgtaacagacattgacatgcaccactcctcacacaagctttcggggttacccaccaaatatgagtacatattgtaattttatggccatacactgatgccataaactatatgttgagatgagcccactggcattacaacaaaatgctgttcccaacttacctaagtcatcatgcccctacataacgtcactaacctggaattctttagtgcagtaggtgtatgcctgtcacccacagggctctcattctggagacagaaacccagaagagttgggacagctacctaataatcatggttcttcctagtcttctaaaagatgatgcttgtgacccacaagcaccaggtggtaagcttggccagcagtagatgtgccagtccctcctccaacatgccttgtgatgtctgccaggtggctggagggtaggaaggaggaagctgggggtcacaaaccagagaaggcctgagctggtccaccccagcggcaggcccatagccctcagcagcttgtccctccgattccctccagggaaggttgtcagaaacaagacaggacacattcagttaaatgtgcatttcagataagcaacaaatacttaaaaaaaaaaaaagtatgtcccaaatattgcacgagacatatttacactaaaattaaatacattgtttatttgaaatccaaatttaaccaggcattctgtacttctaacttgctaaatctggcaactctaaccccagggaaagtctacataatggctcccaacatccaagaaactttagattattccatatttttctattattcatgtatatcaatattttaaatcaacttctttataacgaaagcccactcctcttttactgtatctattatgttgtttttaattttgctgaccaatagcatgatggaattttctttaatatcttaagtttttcttccagaaaatatcaacaccactatacttgacttgtaccttgtatattcaatttgcaacaatgtctgtgaaacaacaaagttagaaaaaatgtgcacatttggcatttgggccttttaatcaaaccaccaacctttctaaaagctcagtttccaaggtaagctccctagatggaaatcaccttatcattactcatataaaggtggcccactgcaaccattccaggaagtgacagaggatgttcacaatctcaactgctcttcaaaaaatctgctattatgaaaaatgatctaaaaatagttctatataatgcaaggaccaagccatctgtatgatctcttcaaagagctcatatttccatagatttttatcactttccaactgttcctacaagcactgaaatttaagaaagtcatgtcagtttagcagataaaacgcaccaagatattaaatttaatcactattatttcaattattttatattattcttttacatcataaaaggctcaaatcaaacatgtcaaagtaaataaagtttagattgcattaaaactcatgacaaatgggtttttaagttgcataaatatatttctagcaataatcaattcgaggaaatcaatgttaattaaatagacataaatatagaaaaatgcccatcattcattcagttaaactgaacatggaagttgtatatctgggactgtaacccctggtttttgttcaaaaactaattttcagtagatgcaaataatgttggatccctcatcagcactgtcacatcaaaattggtttgcatatttttggcttaagaataaagcttccattctctaaggatagagttagcattaaagtgagtagagacaacccttgaatgagagaataccaaagcagctaatgtgatttaaaagcttcggcagtctcaaagctgagaaaaggagaggaactcaccttggagtcgaagctcttcactgggatccagaggtccccactcccaacagaggcactgacaacttcatcagctcttccttggttccataagctcacccctgaatcaaaaggaaaacagccctatatttcactctagtcaggaagagtttggcatcagaagcttattacataaatgacacagtgaaaatatttggaagttaaataagcccagggaaacactagaacccattaagtcatgaaaagtgttaaaactgctgaattctctgtcaatctaaccatgaaaattttgtaacttaaagaaaacaaaagttaattaatttgttccttcaagacctgtaacatgtgctggggtattatcatagacaagatatataattcagtccttcaacaagcaacaaaaatgcaaaagtgacttttttgaaatgatgaattgatactttatttaggatctgctctgtattaaaagtcacatggctttagctgtattaagactaaatccatttatttaagtcccagtgaatctgttaaacataatgccaattctcctctctgcacttatggagtctaattttatatgctttagtaagtgattctatagacaaaattaattttccagttcagactgactagactggtttatgttttaaaaaaatcaagtcattcaataaactattatatgatcttgtttcttggggtcctgtctgttgaaccagttaatataccaacacaggttcaatttagacccatttccataaacaatcctcacggaaagtataacatttttctcttctggagggtgtatcactttctcaacaaatacgctaatttctctggacttgctctcctatgaggtcatgctcctgctatttggttcgaccacagtatatccctcaaggtgaaggatgggaccagattccctcacatgttattcccatttcttcaagcaggactcataattttcagacctgagtcataatagcacagttttaagttactaaagagttcacatttattgggcacaaatggtattgaaattttaatcctagacattttacagttccccaaatacttttaaatccacaccattttatcatgctcaatgtggaagtctgcagttatattcaggttaccaaaggattactactcccgtagtcactgtctgaaacagcctctgagaaattctcaagctggtcacagagtgtttaaaactctcaggtgttgaggaccaagaggacaaggaacaggaatgaactgaaagtccgaaatacagccaatgggagagggctgagctgcaaccctcgaccgcatggggaaggaaggagggaggggactatgggcccaggacgtgtggtcttcagggtgtggatgggctgagtcttcagggatgaacctgcattcaagcgagaagggttctggcagagcaagtggaggtgctggctctgatggtgatatctgtgacacccgtgaacggctgcttggaggtgaaaagagtcgactctctgaatgggaagcatcagaagtccttctcctggctgcaagggtgcaaccactggcagcatggagatcttgagtaagtgtgtctccctcctcctgtcgcttgagcccatgccttccatgtgctcaaaggcagaatagcccaggctttggaggaagacgcaccctgcagcagcaccagctctaccacacatcagctgcggggccacgggccagttgtgtcccacgtgtttactcaccactcaccaagtattcaactgtctacctggtgacaggcactcttgtcagtgactctagatctgatgccttctattcaaaaagcccattctttcttcttcaagccagcagccccaaagtgagccagctccctccgtctatactgctgagaccctcatctcttgaacacagcttcatcccagaaggcttgcctctctctccgtcctgtgcatttcagagagggacgtagagaaaactgccctcaggacttgcattcttgtactgggagagaaaaacgatgaaaagaagaccatttcagagagccagaagtgctgtgaaacagcaggaccacagcaactctgctaaaactgcaaccttcttgtcaatcaaacattatttcaaagtaaaaaaaaattaagaagaaaaacagggtgacagcagaatggctggggatggtatttctgaaggacaggccaggaaagccccccttttttgttggggatggtgagcttataagctgagagctgatgatgagaagcctccagctgcacatatagccacgaggatcgacagcagtagagggagcgcaagactttccttttccgtaaaatgaggcagagcgtggtgagcccgagggaaatcacatgatgtgtgagggacgcatcggccggtttcaacggcactgttctcgaagctttgccaagaccagggtctcttgctcaggaccccacgggattcacacgttggaatgcagagaaacaaagtgagttctgatccagctatacagctcctgcagaggccgactacagagtgcaattaactgaacttataagacagctgtcatgttattggaattggattaaggcagctttaaaatactagcagttatggggtgaaaactggagatccatctgaactttcccttcacctgctgaaaaaccacaccacgccgagagttaccacgggcattggcgtagtctttggaaagtcagctaaaactgtcaaagcgatcgcgagcattttaaaatatcctccacataaacgaaccagtttaattataaggtactcctggcagcgctgagtttccaacacaagtgaattgttaaactgaataaccacaaatcaatcctattgccaaggatgtgttaaactgggcagagaaagagttccaaaactagaatcctgtgtcactcccaacccaaccccagtaatggggaggatgggatggtttccatgggtattccagccacactaccaaaaggcctggaaggttttcacccaggcctcagatgcctggaggaagaatctttgcacttaatagacttcccttgagaagctgtatgtgtgaggaggaaggagatgatgcgtgaaatccgggtcttctagtcgaactgtttgcaggtgctcctgcagggaggggtgtaggggaggcagcaactccacaccttgactttggggaagttcaggaggtgttggtggggcctcctgttagataatcagggtgaggctacagaaaccaagtgtaaagaacatcctccatcctctggactgtttcttccaaggctcttagtggctgagaaagacacagttatttagtttcctgaaggcaaaatattccaaccactgaaacatttcctgtttcacctacatattccagtatctcaatccaaaaggagccctttttggcaaatatgttttccttgaagaggctttatttccaaatattcgaaggagaatttagaagcaggctgtggcagcccttgtagaatgtggtgcaacctttttgagaaattgagtgactgcacaatttgctgagtacggtatgtattatctatgtacatggataatcaagccatctctcagctttttcattggctgcacaacagcccctcagcaatatctgtagtcagaagaccgtttcttatgagcttttcttatgtatttatacactggtatttcttttagatgatgcaaataaaaattttatttcactgcacggatagacagaataaattatacacagctgtgaggtatcagaatatattttatggagtgatcttattgataaattataaacacgggacctgaatgatggatacattcaagcctgagaaacccggggaaaaaatatgaccctataaaatacacagtttgcatatattttatttttcataatatatatttgggcatcaacagaactcatagttacctaaataagaaatgtggatagattatactgggcaggaagcttttttgccactgcgtaacctgatacactgcttgcagttttgataaaatggccagtttgcttcagcctcagagtggaaaaacacatattagatcgttcatctctgacagttatctgctgtgatcatcagttgtgctttcccatgggaagtgtgtgcctgctttgcttgtctccttgtctgagtttgtcattttcagatctgattcaggctagtcaagattgcaatgaaagtttttaaggttatgggaaagcaggcaaagaagaaacctctcaaagtgactccagatcctcccctcatgtcacccagagcctggctgcctgcatgagtcctgccccatccttgctctagccaaccttcctttggtaacttatgaagggaaacaggaaaggctataaccaagtccacaccaccctgatgcctacatccgcgcaagctccatttcacaagaggtggagactgatgcagcagctctaagacatacacagtgaagaggggacatcttggagccataagacctgaccctggtcctgactcctcctcgatttattttcctttgtcaaagcctgacatctgaggctctaccgtctacaaaatgaaaactgcattctctcctctaagattctcatgaggttaagggagctcaaataagtcaacacagtaaagcgctttcgaaaagcttaatgcatgaaatccgtcttagatatcagaatccaagtttctagactttgaggcagtgtctgtttaaccaaaccacactattggtgcaaaaatcacaactccatattgatcatttgaaaatgccagtgtataagtggatgccagtgggcatcctcctaagccacccagtgggccattgagaaaataaactctgatgagatcattagtcaagagaaacttaaatatcacacctggagttctggcttgaaagggaaatcattatcaacacctacatgaactttaaaatggagaatcaatctgaggtgcaaaaagtagaattaagataaacatccttttgaaaaatctaagtgaaagcaaaaagttggggcagccatttgccaagaagccagggacaaggcttcggaaactgatgaagcaatttttttagcccctaaatatccgagacctaaaggaaatcttacagaactgagcagctccttgtctcagggcaatatggtggtgatgctcctataaatgatagcaagatttcctttcagattcacattttcaatcttaaccaaataatgatgtagttctttcattttagctgcacgctccctacatgtaaattagtaatgcaattttaaaataacgtaagtgaaggatccacaaaagaaccaatagcaaaagttaagctgaaaaaagtaactttataatagagaaacctgacaaaccctgctttagccagatggtcaaggtcaacatcaacagagataagtcctgtggatggtacgacccttgacgtgatgtgatgacagtcccacttccatctgtgatcttccacttcaaaacccacagcccccgtctaatcatgagataaattcccaaagaggtacgctctaaaatataccaaccagtaatcgtcaaaactgtcaacatcataaaaaacaaggacagtctgaggtactgtcacagacaagatgaacctaaggagacaggacaactaaatgtaatgtatcctggatgggactgagcaacagaaaaaatgcactcagtaagaaccaatgaataaagtataaacctaatttaaaatactatgcaaatattggtttactaactgtaacaaatgtacaatactaaggtaagatgttaagaataggggaaatgggatgtggggtgtctggaaaccatctgttctagctttgcaatttttctgtcactctaaaatcgttctaaaaatgaagtctactaagaataatttttaaaatttaatctgaattttacaagaataatcatgtcattctggagcagttcagtacatatcaaaaggctcagggatgactggttatcactgggggctccaaataccagaaagatggcatgtttgccattcactgctcttctgacattgctatttactcagacggaagatgcagtacctgcaggcaagctaaaaccttgtcactgacaaggattcctagagtagaaaaaggcagaggatgtgaaaataattgattctcaagcagcttaaagggccttctgagtactctccagcatactctagaaaacacagaaacggcaagttgaaataaaaacttaagattttttgcatcattggctacaagggtctgggatggcagaaaagttaaagggagaaactgccactaggtttgggaaggtgacaccaagtgacacacacacaaacacattgacaaaaccacgtcaatacagaatatagcttctctcagagcctaagattgtagctaccacgctggcaggctgaattacgaagatgtaggcaggtgtaagagaagcagcataatattttgagtcagaagacgcatcctgcatccaccacacgctctcaatgaccctgggcaagttgcttgcattccttgctattcagatccttggtgagtggagctgggctatggaacaacatccgccacagagggccggcaagaggatcaaatgagatcatagatgcaaacatgtacatggtgtattactcaggttttccagaaccaacagaatatgtgtatataaaacagggagtttattaggaagaactggctcacacaattacaaggcgacgtcccaggacaggccgtctgcaagctgggaaagacagaggctggtagtggctctgtcaaagcccgaaagcctcaaaaccagggaagccaacagtgcagccttcagtctgcagccaaaggttgggaagccactgatgtaagtcccacagtctgaagtcttcagtccctgaagtctgatgtcccagggcaggaggaatgggaagaaggaagagagccagaagactcagcaagcaagcttatcccaccttcctcttcctgctttgaagtcactggtgcaagtcccagagtccaaaggtcaaagaacctggagtctgatgtccaagggcaggaggagtgggaggaagcattcagcacagaaaaagaaggaaatcagaagcctcagcaagccagatcatcccaccttcctccacctgctttgttccagctgtgctggcagcacatgggatgctgcccatccagcctgggaaagggcgggtcttcctcttccagtccaactcaaatgccaatctcctctggcaacaccctcccagacacacccagaaacaatactttatcagccatgtaggcaaccctccatccagtcaagctgacacctaatattaaccatcacacatggatctcatttggtttaggttgttttttttgtttactccttatcagtcattggaaagaaatacaccaaaatgctcttgctggctttctttgagtgctggggctatgaattcattatgattttcttctttatgtttgtatgtatttctggcttttctataactggcacattattacttttatgatgaaaaaataaacttaaaaagatcctttggacttatgatgacaaaacaacaattcttctggcaccacagatacacagccttgggcgtgttagaggacagagccatttggaaataaaagcaatcaagtgctatggaacaattacaatttggaaaagatgttttatgtgtcattttgaaattcaaagaaagctagttatagcttctcataaatgtctaaatagattcataccccaagcacgagctgtctctactacacataaacataactgtccatgcctatggtgcctcccagctgtggggagcaaagtcacttacaacagtaacttacattttttttttttttttttttttttgagacggagtctcgctctgtcgcccaggctggagtgcagtggcgggatctcggctcactgcaagctccgcctcccgggttcccgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgtaacttacatttttataaccgttactggtgagtgagatactaatcccattttatacactgtgagactaaactatagagttgtataggtttttctcaaagttgcctaataatataaatggtggaattaatggcaaaacccaagccctttgcatgtcaaatacatacattcactttgtaatgcttttgcagagggtcagaattcttcaatgcttaccttgcaagaaatgatgtaaggggaaaatgaaactaattgttaaaatgtacacctaggaataatttttggatcttaacagcaaaacaacaagaatggaaccttgtatatgtcattaagtcctgtaaacttattaaatggaattaaacaacagtgaaaaacaagtcattctgcatctacactaaagccccagctccatgtaaaggcattctctcacatccctgctgcttcactgggtatctgtgaccaccttctgccaaaatacacaccaacttgggcagcactctgtgattctggatttcttcccctcctctgcccaggtcttgcctcctccacttgaacattccccaagtctcagctcttggccatcttccctttctacccttactgttccccagagaactcattaatttttaagctgatgttgcccaaatcaatattttcttcccatctggccacttcacccaagcacagtctatattttatctacaggacatgttaatttcaatgtcttgtcaccatcaccacctcaaattcaacgtgtttaaaaatcaaaggtttttaatcttcatctcccagcgaaaaaccaacacgttttcaatcatacacgtcttgtcaataccatccacattcatcgccctttcttaagccacgtgtctggatgactgacttctttggcagagtcctcttcttacaaaactccagttggtgttttgcgctttgcttttgttcttttgtcttctaaaagatgctcctagtacttaactgaatacttctagatagcctcatcacctgcaggttctccctctttcaatcttaaaggagagggacctttaacaagagcaaacatctatgacaggtttctcatcaagagaacatgaatgtgaaaaccccaaggcagtagagtgctttgtgggttccaggaacagccaggcagtcagtatggctaagatggagtgagagatgggatgcagagagggaggagcagaagtccaggtggtagacaaggctcagactgtggcgggcctttcaaggcagggaaattaaattttatttgagtgaagtgggaagccattctagggctttttttttttttttttttttttttgagacagagtcttgctctctcacccaggctggagtgcagtggcctgatctcagctcactgcaacctctgacttccaggttcaagcgattctcctgcttcagcctccggagtagctgggactacaggtgcataccaccacacctagtgaatttttgtatttttagtagagatggggtttcaccacattggccagcatggtcttgatctcttgacctcgtgatccacccaccttggcttcccaaagtgctgggattacaggcatgagccacagtgcccagccccgttctagggcttttaagcaggctaactctgacccataatggacacattctctgcctaagaatggattgtataaagcctgaagaatggataaatgagaactattcataaggcaaacatggagtgttgaacatagattacataaacaagaaatagttattgattacaacgaatgctaattaagcaattgctatgcaaggaagccccattctaatcttttataagcttaccttgtttaaacccaacaacaaccctgtgatatttatccccatctcatagatgatgaaactgaggcacagaagttaagtaacttgcccaggatcacacaaatcatgaagccagggggctgacctatacagccaaattacagaatgctgtgctcataatcctactgtgtgataaataaacactcatgctgattaggaaaacttggagtatgattcagacttttttcctaagttctggaacctcatgtcctgatagcaccatcttcctctctctactgccaccatactgaccagcctcctgaccccttaatagtgctcagctatgtcctacctcgtggcctgtttttttttttttttgaggtggagtctcactctgttgccaaggctggagtgcagtggtgcaatctcagctcactgcaacctccacctcctgggttcaagcaattctctgcctcagcctcccgagtagctgggtttataggtgcccccaccacgcctggctaattttttgtatttttggtagagacggggtttcaccatcttggccaggctggtcttgaactcctgagctcgtgatccacccgcctcagcctcccaaagtgctgggattacaggtgtgagccattgcacctggccacagcctttgcatttgctgtgccctctgcatagaataccctactctcaaaccttcgcatgcccccaaaccttgttattcaagtctctgctcaaatgttacccctcagagagtcttccctatttaaatacttttcctcccaacccaagttgcttcccggcccgtcatcctttatcccgcctacagccactatcagtatcaaatcttgttttatttatttacctctttgtctgtctctaccacccctcaatcaaaaataggaataacaagaggtaggggcctcgtctatcaaatttactgctatatcttcatgtgcagacaagtatttgtgcaatgaattattatcaaacaaattaaaaatttccatggcctcattgtgatcatgatgagacaggaatggggtccaaggcttcgttctcatggacactctgatgagtgattgacttttagctcaccctgcaatgtctgatccctcacaggtggatgcacacaaccaaatccacatgagccttatttataagccagaattccaatttgcttatttttaatgagaaagaactgccaagtcaaccagagtcctcatctaaaacattttgttcattatctacccagcaggaaagcttccttgagaagccaaattaagaggagaacagagaactaagggaccataatagcaattgccatcatagtagcctgatatttccttctctgtttaaggatccatgcctgcttcattagctgaggggaagctaagccccagcatgtacgtggctacacaccagaaggcagtgggcacagggtgatgatttgaatttgaaatgtattttttatagactcggttagtttttgaaggttaactcttaaatgccttttaactcatagagttgactttcatatcaccatttagaacatttcattttctctatgagaaaaatgcactttgacttctaatgtgggtaatagtttctagatctgaaacctcatgcgttttcatgggaaaatagaatctgaattccaaaagacaacaagaaggggcacatcctatgccccatgcccgacagcaggaatgttcatttccctttttccccacttgcagggatgactgtggcttgggcaggatgcaggtggggaatagggtgagatggggaataaggtgggacttcaagcactgcaatgattggaatcacaaagttaggggacacctgcctaagttccagtggccaaggagaaagtgtggctatctagaggtaggtgctgacatgatttttacaacctttgattttctagccattgactttggccattgaatttggaggacccaaatgggcaatcataatttaaatagtcaaacaggataaacaaaactattacaacttagaattagcgtcctgaagaacttttcattctattcaatttgacagatatttattaggcatatagattgacccaggaacattttaaataattctaatgagaattttttttgttcttagtgtttgaaactaaacactgtgcttaactgtttaaatccttgcttcatcttacatagagaagccaaaagagtaaagaaaactgttcattttaggaacttctaaataatttcctctcaacaatacccatcttgattctgatctattcccacagacaagagaactggtccaatccagtatcggctggcaggtcttttatcagagcaagaacatttgtaggctgagaacactgccttggtttaaaatccacactaatgatgcattaattgttctaaatggattttcatttctctgcaagatgagcacttaatatgtcatccaagggagcagtttttctcctttcggcgtctgatcacacagtgtagcaccataaatcaacaaggtgaatccgctgatgagggctggagggagggtggaggggtggggcatgggcagggttccctcctcctctctgctggtcctgaaatgtgactggtttcccttcattcagcaacgaccaggcactggcaagttgacaactcaatagccaatcattatatttttttctttttttattattatactttaagttctagggtttgttacatatgtatacatgtgccatgttggtgtgctgcacccattaactcgtcagtcatttacattgggtatacctcctaatgctatccctcccccctccccccatcccacgacaggccctggtgtgtgatgttctctttcctgtgtccaagtgttctcattgttcaattcccacctatgagtgagaacatgcggtgtttggttttttgtccttgcaatagtttactgagaatgatgatttccaatttcatccatgtccctacaaaggatatcaactcatcattttttatggctgcatagtattccatggtgtatatgtgccacattttcttagtccagtctatcattgttggacatttgggttggttccatgtctttgctattgggaatagtgccgcaataaacatacatatgcatgtatctttatagcagcatgatttataatcctttgggtatatacccagtaatgggatggctgggtcaaatggtatttctagttctagatccctgaggaatcgccacaccatctttcacaatggttgaactagtttacagtcccaccaatagtgtaaaagtattcctatttctccagatcctctccagcacctgttgtttcccgactttttaatgatcaccattctaactggtgtgaaatggtatctcattgtggttttgatttgcatttctctgatggccagtgatgaggagcattttttcatgtgtctgttagctgcataaatgtcttcttttgagaagtgtctgttcatatccttcacccactttttgatggggttgtttttttcttgtaaatttgaattctttgtagattctgcatattagccctttgtcagatgagtagattgcaaaaattttctcccattatgtagattgcctgttcactctgatggtagtttcttttgctgtgcagaagctctttagtttaattagatctcatttgtcaattttggcttttgttgccattgcttttggcgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgttttttgtcaggtttgtcaaagatcggatggttgtagatgtgtggtattatttctgagggctctgttctgttccattggtctttatctctgttttggtaccagtaccatgctgttttggttactatagccttgtagtatagtttgaagtcaggtagtctgatgcctccagttttgttcttttggcttaggattgacttggaaatgtgggctcttttttggttccatatgaactttaaagtagttttttccaactctgtgaagaaagtcattggtagtttgatgggggtggcattgaatctataaattaccttgggcaatatggccatttttacgatattgattcttcctatccatgagcatggaatcttcttccatttgtttgtgtcctcttttatttcattgagcagtggtttgttgttctccttgaagaggttcttcacatcccttgtgagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagatttggggctgagacgatggggttttctaaatatacaatcatatcatctgcaaacagggacaatttgactccctcttttcctaactgaataccctttatttctttctcctgcctgattgccctggccagaacttccaacactatgttgaataggagtggtgagagagggcatccctgtcttgtgccagttttgaaagggaatgcttccagtttttgcccattcagtatgatattggctatgggtttgtcataaatagctcttattattttgagatacatcccatcaatacctaatttattgagagtttttagcatgaagggctgttgaattttgtcaaaggccttttctgcatctattgagataaccatgtggtttttgtctttggttctgtttatatgctggattacatttattgatttgcgtatgttgaaccagccttgcatcccagggatgaagcccacttgatcatggtagataaactttttgatgtgctgctggattcggtttgccagtattttattgaggatttttgcattgattttatcagggatattggtctaaaattctccttttttgttgtgtctctgcccggctttggtatcaggatgatgctggcctcataaaatgagttagggaggattccctctttttctattggttggaatagtttcagaaggaatggtaccagctcctccttgtacctctggtagaattcggctgcgaatccgtctggtcctggactttttttggttggtagactattaattattgcctcaatttcagagcctgttattggtctattcagggtttcaacttcttcctggtttagtcttgggagggtgtttgtgttgaggaatttatccatttcttctagattttctagtttatttgtgtagaggtgtttatagtattctctgatggtagtttgtatttctgtaggattggtggtgatatcccctttatcactttttattgcgtctatttgattcttttctcttttcttattagtcttgctagaggtctatcaattttgttgatcctttcaaaaagccagctcctggattcattgattttttgaaggtttttttgtgtctctgtctccttcagttctgctctgatcttagttatttcttgccccttctgctagcttttgaatttgtttgctcttgcttctctagttcttttaaatgtgatgttaaggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttccttatttacccagtagccattcaggagcaggttgttcagtttccatgtagctgagcggtttttagtgagtttcttaatcctgagttctagtttgattgcactgtggtctgagagatagtttgttataacttctgttcttttacatttgctgaggagtgctttacttccaactatgtggtcaattttggaataagtgcgatgtggtgccaagaagaatgtatattctgttggtttggggtggagagttctgtagatgtctgttaggtccacttggtgcagagctgagttcaatccctggatatcctttttaactttctgtctcgttgatctgtctaacgttgacagtggggtgttaaagtctcccattattattgtgtggaagtctaattctctttgtaggtctctaaggacttgctttatgaatctgggtgctcctgtattgggtgcatatatatttaggatagttagctcttcttgttgaattgatccctttaccattatgtaatggccttctttgtctcttttgatctttcttggtttaaagtctgttttatcagagactaggtttgcaacccctgcctttctttgttttccatttgcttggtagatcttcctccaaccctttattttgagcctatgtgtgtctctgcacatgagatgggtctcctgaatacaacacactgatgggtcttgactcttcatccaatttgccagtttgtgtcttttaattggagcagttagcccatttacacttaaggttaatattgttatgtgtgaatttgatcctgtcattatgatgatagctgcttattttgctcgttagttgatgcagtttcttgctagcctcaatggtctttacaatttggcatgtttttgcagtggctgataccggttgttcctttccatgtttagtgcttccttcaggagctcttttagggcaggctggtggtgacaaaatccctcagcatttgcgtgtctgtaaaggattttatttctccttcacttatgaagcttagtttggctggatatgaaattctgggttgaaaattcttctctttaagaatgttgaatatcggcccccactcccttctggcttgtagagtttctgctgagagatcagctgttagtctgatgggcttccctttgtgggtaacccgacctttctctctggctgcccttaacattctttccttcatttcaactttggtgaatctgacaattatgggtcttggatttgctcttcttgaggagtatctttgtggcgttctctgtatttcctgaatttgaatgttggcctgccttgtcaatagccaatcattataaagagaaagccctacaaatgatgtttggccacttataaagaaaacaaatttctttgttgtttcaatgtgcatttacttatcactgaaattgagccttttcatattttcatcagttatttttatttcttaatttgggggttgtttgctcacatttattgccaatttttaattagcctgtttttctcttatttatttgaaactttatgtgttaagaatattaaacaggtttatttctaaaacaaacttctgggtcaccctgaatcctgccctgagagtggaggctgggagtcagacatccagtgacgaattctctgctgctgctcagaaatggggtaccaatggtacaggctgagagtcaacagcatttcaggtttccatgggagtctagaacaacaccttccagtgagctctgcttttcaccaaaggtgggacctttggagtacagggtgcttaacccctggggcaattgagaaaggagaggatttgtggaaagcctttgtcttagcacctgtacatttagtgctcaattagaagttacggacagagagaagagagaaaaagaaacctcttctgaatgtcagtagcctggaggctcctccctgggtgttttcttaagttagactgcatcctgcctactgggagcacagagtctggtaaagaagacggaaagggatagtgcctttaagagcaatcggagttgggctagaaacctgattcagttgaggcggtccaggatgtcttcacaacagggatgccaatgatatcaggctttgaatgggcaggatctgggcattcacgtgggaggatgggggagggaaaggaagcttcttatatggaaagagaatgggcccaagcatgcctttccgagttatgccctcacctccgtgctctgcctatacaatgtgggaacaaatgcaagagggggagatgagagagaacggatgcatatgaggagaaaaaagtattcaaccgagcccaatcagaagtgcagtagatgtgatctacgtccactttgttctaacagaacactctttttattctgcaggatgactgaactgagatttcctctgtctctgtgccacgtggacttgcaaactcacagagccttcatcactgaggaatgttctttgacagtcactgtttatgagagcgaaccataaattgggatccaagtagaatgatcaaatttagcaaatcaaaatatagaacttccagttgaatctaatttcagatagacaatgaataattctttaggataaatatgtcccatgcaatactgaggatataattacgctaagaaaaaattcgttgtttatctgaaattcagattcaactgggagtcctgttttatctggcaatcctaggtccatgcttccttgaatggtttacaggcccgcaaagccaatacgtttcaatagattcttaggaaacatgttctagtttcaaaatttgaagttaacatgagaatgctttacatttaattattctagataaattcagagtgtacagcactattttctatggcacagaatttgagaccaaataacctagtgacatatttgagggggaaaaggatcctatgctcactggagaacacacctcatagcaattggatcctctttatctcccagcttctgcaacccaactgctggaagacaaagtctatacacaatgcagtgtttcattcaggggcccacatgactccatctgtcaccaaagcacatgtttggcacggactgaaagccaaaagcagtctaacaaatatttcaaaactgaatttatatctttctaacacatggtttatatagggaggtaatacctagagagctttgcagttctcaaataatatcctggctcaacaacaaatgatgtatgcagcagaccacaataccaaaattatttgcttttaaaacatgttaaagaaagctaagtttatgagggggctggtgccagaggtgcctgttttagtatgcagttgttataaaataagagacaggaatccaaatatatccactataaaataaacatttgcataattccttatacaaagaggaaacttccctctaaaggtccaattgagaatgaaattatcaaaggaagcaactcctattttgatgaactttcaacgtcccttacagcctcaacaatccgcatatctcttccatctaggcaaactgtttcgacaccagatctatcagatctataacaatgcaaatactattacatttatctctgctaagcagaaaaagattacataatggaactctccgtgggcagaatcacacaggtatgctggcttgctcttcaggtatgggttttctccagaagacagatttctagatggaaaatgcatatgattgaaatctagatatttgtctttagagccaagaagccacatagtagcctttgtttcatctttccttcaactctgtgattgcacgtggacacagcttccatctaagagagagttgagggtacttgtcactggccggccaatgatattcttataaatatttcaatgctctccctgtccccaagaagaaactggaaaaaattgaaacaactaaaacaaagcagcatccacacactggcacacattgtaattcctaacttttccagtgtgccctaaagattactgttcatgtcaagggctgggtggggagcaaagaaattgtcaaattgattttctgtggaatcaagcaatttgtgtttttcaacttgacagtatcagcataaatcagagccacatggagagaaactctcctcttgaaaatacacacccacacacagagtcggccaagcccgagtgaagcaagttctctacaaggctgactttgagaaagggaggaagaggggagaggaattcagccccgggacagagacagctgcctgggcatggccaccacaactagactcacctggccctgtcaactccatcattctaggaagttcctgctccagagcctgactctgtccatctcttggagcattttccgcagtgacctgcatgtgtgagcagctgtgtctgttgtcagtggcagtcttgtgtcggatgtctcccagttgccaggcacttgacagattacaaagtgcttcccacatgtgtcacctcacatcggtgcacaggaatgctgcaggaagtttgattcatcccattctactgagcaggggatagggtgagtgggaagtgagccttggaggccgggcacctggccagaattcacgcctctggcagtgggcagagctcaggctcacatccagggctctgccttgccatgggtacctcagatccagagtatcctgtgacctgaactgctgccgacccccggagccctgccccttcccctgtccaggctctcctgcatggcacctttgctcatgctggtcttccatcagtctgggccatgttcccccaccacagtgtacccatatcggtcacatagtgaaatgaagcagggtgtggaaagcaggccatggccaggatttcaagcgaagctaggctgtggcagaggtgtccacgggcagtgccctcagcccggaggcccagaccccacctgttcagcccaaagctggcaccagacaacatgtgccctgctcccccaccccaccctgcccttcccttctgtcccaacttccccctttagtctcggctttcctgcagctgtccggacctcaccagatgtgtcctggttgtgactggcttctgggagctctgtcctctgccagccctatccaaatcaagagggttcccactggataggccagttcttggcctcactggtggtcaccatcctgcatgcttgcactacaatggatccctgtctgaagcctcctacaagaaatggtccctcctgctctggccctctggtgctggatttccctgcctgacacagagcccatgcatggcatgtgcttactacctggccacactggaggggagctgactccttgcgacagagactgccgcttcctctcctcggatcccccagcactgcaccttggacctcccacatgctacatcaacatgctgaatagatgtgatagagaagggggaggtccagaagccctccagtgacctgcatgaaaacaccccctggttgatgggtttggatccaggatccaggaacaaatctcaaacctcctcatcaagacaatgccttcaactgtgcattgctctccctgcacccccacccccagtgagaagtgctgagtgcccaaagactctagttggcttcaggggttatttataatccccccactccagcactcagccctcatctggcctttggacacacacaggaagagtggactgagaaagtactctcgggtcactataggactccggcctcgtcccctctgctttagacaaagactcactgagttgttcagggacttcactgaagacctccggcctcaagcctcagaacccagcactcaacagcacccctcaaagggccagacacacccagctggcttgatggaggtgtcctcggcggtgctgacacttaacataaggtcaaggggggaacaaattattcacttttcagtttcccgtcaagccctctaattaggaaaaagtccatttggtattccatgcctaaaacctcccagccactggctctctgccctttttcacaaagagaacaggtcttgggctcagggacaccaacagacactattgtctggctgcattttaataacattgttttgttttccttcaatttatctttatagtatttatgtcaagtgatactggcctatttagaatattgaagtacaacttccttcttaaacaaatttaagcaaaatgtgtatactgacttaaagtttaagataaattaagaaaaattaagataaactaagaaaagcaaacctgtgtatggcacaggtgatatacatttattaaaaagtcatgaaagtaagttctcaaatgacaccaagttaggaaacttggtactatatgaactgcttggaccacagctggtcagcgttgctatgcatgtaattacttaatggctgtcttgtgtcggatgtctttcagttgccaggcgcttgacagtttacaaagtgtttcctgcatctgtcacctcacgccagtgcacaaagatgtcacagtaggttttattcaccccattctgctgagcaggggaagggctgggtgggaagtgagccttggaggctggggaccttgccataaacaacaggaataaacaatagggtgtcaccaccatggcagtgatgtgatccagattcaaggtgggatataagaatgtacattcaaaacaagctcccagggaatggtttcagtgcagaccatttggtagaccagcagtctcagagaccctagcctttgaaacaaccatctctgaccaccagctaaagtcaaagcacaaaggctgctcttgctgtgggtgcatcctcactgtgatcaaagcaggcttctctccactgctccagaacatccttcctcccattcgtggaacatcagagcatctcctgcataccaaatgcagcccacagattcaaaaggaattgccatcactccctatacttaaatggctgtaacaccctatgagtggagacttgaacactgatatcaatgagctcacaacctcatggatggatcattgtgtaaccaggagcttttatttagcaccagctatgtgctaggccaagtccttgaggttggaatcaaaggtcacatgcctagatctgaaagatgttacggtacaagtggggaaagcaacagtgtcatactaagatggtggagctcccagggagaatgtcttccacaatctggagaaaggagccaaggctgaagtgagaggacagtggtgaaggaggtttcccaagggacacaggctactaggcacaaagggagggtctgcagtaacagcattcaaggttcagaaagcaacaagcacagacaggcactcaatgataaacaaggcaaatgctgtgtttacattagtttatcattttttccatttagtttgctgagtatctcaacctgtttattaaagagctgagttttatgaaggtctctgatagcaaaataaataagagatttatgactcttctaatactaaccactatttgtgaatagacaaagctaatggaatccaggtctagcctggtcctgctcatgtatctttcaaaagatttcataatgaactctccagagtccttaaaaagaagggaaagctccctgcggtaatcaattgactgctctggcacaaacagtcatctgtaggcttccagctgcccttattttgaacagcatattttccagggataatacccttttacaagtctacaagaccatgtcttaatcctggccaggggaatcatgttgacagaaaattccaaatccctaaaggaagttaaccaattcaaacttgagatgccatatttgaaatgttttttataatgttaacaagcttttttttttttttaaagaaaaagatatttgcatttctttacttagacttattttttcattgatacttcatcctccctccatcaaatcctgctcctttactggtttggtgtctatctttggacaagtaatttggccttccagatttgccttcctcatctgaaaagtgatggtaaatttatgggttgtcacctggtttcttggggttccaagaatatagtactgcagttccaggagtcatttttattagagtaaaagccctagaatatattttgcaataatgttagttagtttaacgcaattggctccagccctctaccaagcctcagctttcaagtaactcatagtcctgtgttctggaagtagggggatgagaggattcagaagttactgcacatggtatctggcatgcagtagaacgtctgcgggagatggagaaaggttggcaaccacaggactgagtgagtttctaggatctgctgcatctcaaaaattatgtaattgtttatgtttcatagtccttactgacaattgtacatgcaaatttcatttaaattataactaaaattttcatcattagctttttttaaaaaaattagagctttaatgagaaaagataatgtttaatgccaagaacaaactggttgatgattctaaaagaaagctccaccacatagactttagggggaaagaaattttgataaaaatctaagtcttttagtggatactgcagaactgactatggcaagattttgagtaaccactgctaaagtttgttttttttttaatgaatactcaaagatatatttaaccaatgaaattctaaatctgtactcattttatgttggaggggaggcaaaatagggagatgggagcttttcacatatttatattaaaacttgcattgatcttggaattcatagttcacagaaaatctgacccacaagagttcttatgtcaattgtcaaatagcaattccccacaggaaaaaaatgttgaaaggtaaaaaatttttataattgtgttgagtgaatttatacatcaaaatatatggaatgaaaccaaaactcgactaacaaaaaatgtatagttttaactgcttttattatcaagaaatatgaacatagatgaactaaacattcggccaaaaaatcacaacaataaaaagacaaaggagttaagaaataaaaccagaaatgactaaattaaaagctatgaataaaaggaatagtgttgattaataaatccaagactaaattcttctgacaggccaaatacatatctaaatctccgacaggtctaaacaaggggaaagataaattgtaaataaagagaagtgggcaaaaatagtggaacaggtggccccaggctttactatcacccacagaaatttcaactagcaattatctacagacaggaacatgtgggtcaaaaccccaaaacttgggaataagcctgagagacctgcctagactacagaaatgaatgaagtctgcattggaagggtaggagaaatggtctcactttgaccacactgcttctccctccatcctttcattcagcatggtgccacacagagaggatgcctcagggcccatggtttctgcagtgggcagggagaaccagaagcagacatctagcttctctagcattctgagatgcttcccaggaagcccacctcagtctcacttcataaagaatgctcgaggtagcggcatggcgagaccagctggagtcagttagaaacaaagcaaggagacagggcccacagcagatactggtgatatctctgtgtatcttccagtggcagcccccagtgagaggtaccagcaaacagcatagcacacctgcaaagccaagatggtcactcccaagtggtgaaaagttgtgcctggcttgaatcccaacagccatcttccaggcccagccttaggctctacttgaaggctccacctggggagagagctccccacgactacacattttggtaaagagcaagagctagttctgcaacacccaaaacttcaaacagcactcagcttaacctcaaagcctaccctaaggccctggttaggcaaagacgcaaacctcaagcatacatttctactgaagcaccagataatcccatccttcctgagcaatgactccacctaaccccagggaacctcctgcaactctgtacaactgaagaattcaaataaaagtaccacctggtgaaggaatacaccctgtagcccagcccaatcagaggaaattgcaatgaccagccagtagttctgcctaattacagagttcagctagtgctctcacctgacacctgagcccagctagcttagctctaccagaactcaaagcaaaggcagcatcccagccatctagagaatggaaagcaagctttgcctgcctggggtcattaccaattggcccatccggaatcacaggctagactaaatagtaaaggtgtatttctgccaaagaacacctgtaacatccagaagaggtgactgtctccccaaatgcgcaaaaaccagtgcaagaacatagcattacaaagattcagaaatcatgacaacaccaaaagaaactagcaaaactgcaaaaatgaaccctacagaaatggatatctataaagtgataaagaattcagaataatcctcttaaagaaattctgtaaactatatgatactacagattaaaaatcaaataaaatttggaaaacaatacatgaataaaagtttgatgaagaaacagaaacaatcaaaaaacaaatagaaacactagagataaagaatacaatggctaaactttaaaaatgcaatagaaagcttcaacagcaggcttgagcaagatgcaaaagaattgaagcagataatttaaaattatccaatcagaggaacaaacagaaaaatgaaggaagccaatgggaattatggaataccatcaaatgacctaacttttgcataatacaaatttcagaagaagaaagagaaaaaggggccacataatacatttaaagaaataatggctgaaaacttccctaacctggggaaagatgccaacatccaggtcctgaaagcacagaagtttccaatcaaattcaacccaaggaggagtccaccataacacatattaatcaaactgtcaaaacttaaagacaaaaaattgtgagagcagcaaaagataaaaaatactttatatacaaagaagtctcaatatgactatcagtgcattactcagcagaaaacttgcaggccaggagagagtgggatgatatattcaaagtgctgagggagggggaaaaaaaaactcctgtctaccaggaataccttacccagcaaggctgtatttcagaaataagggacaaataaaaactttcctagacaaacaaaagctaagcagagattgaatgcataataaaaagtctcccatcaaagaaaagcctgatggcttttctaatacagaacctgatggcttctgtattagtccattctcatgctgctaataaagacatacccaagactgggtaacttataaagcaaagaggttgaattgactcacagttcagcatggcaggggaggcctcaggaaacttatgatcatagcagaaggcgaagcaaacaaatccttctttacatggcagcagcaagaagaagtgccgagcaaaacggggaaaagacccttataaaaagacccatcagatctgtgagaactcactcactatcacaagaacagcagcatgggactaactgcccccatgattcaattacctcccaccaggtccctcccatgacacatggagattatgggaactacatttcatgatgagatttggatagggacacagccaagctatattagcttcactgctgctgaattctacaaacatttacagaaaaacaaatatgaatccaaacttttccaaaaattgaagaggaaagattacttccaaatgcgttaccctgatgccaaaggcagacaaacacctcaaaagtaaagaaaattgggcgaggtggcgggtgcctgtagtcccagctactcaggaggctgaggcaggagaatggcatgaaccccggggggtggaacctgcagtgagccgagatcgcgccactgcactccagcctgggtgaccgtgagactccgtctcaaaaaaaaaaaaaaagtaaagaaaattacaggccaatatccttgttaaacatacatgcaaaaatccttatcaaaaacctagcacaccaaattcaaaaacacattaaaaggatcattcatcatgatcaggtgggatttatccctgagatggaaggatgtttcaacacagacaaatcaataaatgtgatacatcacattaagagaacataggacaaaaaccatgtgatcatctcattagatgaagagaaagcatttgacagaattcaatatccttttatgataaactctcaacaaattaggcatagaagaaatgtaccttaacacaataaagccatatataataagcccacagctaacatcatactcaatggtaaaaaattgaaagcccttcctctaagatccggaacaagacaagaatgcctacactcaccatttctattcaacatagtgttggaagtcctcgccagagcaattttgcaagagaaagagataaaagacacccaaataggaaaggaagaagtaaaattgttgctgtttgttgatgacgtgtttcttcatgttaaaaaattctaaagattctctaaaaaaactgctagaatttagaataaacaaattcagtaaaattgcaggatacaaaataaacaaaaaaatcagtagcatttctatatactaaaaagagactcttcaaaaaagaaatcaagagaagaatcctgtattagtccattttcatgctgctgataaagacacccaagactgggcaatttacaaaagaaagcggtttaattgtacttacagttccacatggctggggaagcctcacaattatggtggaaggcaaggaggagcaagtcatgttttaaatggatggcagcaagcaaagagagagcctgtgcagggaaactcctgtttttaaaccatcatatctcacgagacttattcactatcaccagaacagcatgggaatgacctgcacccatgattcaattacctcccaccaggttccttccacaacacatgggaattcaagatgagatttgggtggggacacagccaaaccctatcattctgcccctggctcctccgaaatcgcatgtcctcacatttcaaaaccaatcatgccttcccaacagtcccccaaagtcttaactcattacagcattaactcaaaaggcaacagtccaaagtctcatccgagacaaggcaagtcccttctgcctatgagcctgtaaaatcaaaagcaagttagttacttcctagatacaatgagggtacaggcattgggtaaatacagccattccaaatgggagaaattgaccaaaacaaaggggctacaggacccacgcaagttcaaaatccagcagggcagtcaaatcttaaagctccaaaatgatctcctctgactccatgtctcacatccagatcactctgatgcaagagttgggttcccatggtcttgagcagctccacccctgtgactttgcagggtacagcctccctcctggctactttcacgggctggtgttgagtgtctgcagctttttcaggcacacagttcaagctgtcagtggatctaccattctggggtctggaggatggggcggccctcttctcacagctctactaggtggtgccccagtagggactctgtgtgggggctgcaaccccacatttccctttcgcactgccctagcagagattctccatgaaggactcacccctgcagcaaacttctgcctgggcatccaggcatttccatacatcctctgaaatctagctggaggttcccaaaccccaattcttgacttctgtgtacccacaggctcaacaccacatggaagatgccaaggtttggggcttcaccctctgaaacaacagcccaagctgcacattggcaccttttagccatggctagagcagctggaatgcagggtaccaagtccctaggctgcacacagcacagggaccctgggcctgacccacgaaaccattcttttccccctaggtctccaggcctgtgatgggaggggctgccatgtagacctctgacttgccctggagacattttccccattgtcttgggattaacatttggctcctcattacttatgcaaatttatgcagctggcttgaatttctcctcagaaaatgggattttcttatctattgcattgtcagtctgcaaattttccaaacttttatgctctacttcccttttaaaactgaatgcttttaacagcacccaagtcacctcttgaatgctatgctgcttagaaatttcttcctccagataccctaaatcatctctctcaagttcaaagttccacaaatctctagggcagaagcaaaatgctaccagtgtctttgctaaaacataacaaaattcacctttactctagttcctaaaaagttcctcatctccatctgaaaccacctcagtctggatttcattgtccatatcactatcagcattttggtcaaagcaattcaacaagtctctagggagttccaaactttctcacattttcctgtcttcttctgagccctccaaactgtttcaacctttgcctgttgcccagttccaaagtggcttccacattttcaggtatcttttcagcagtgccccactctactggtaccaatttactgtattagtttgtttccatgctgctgataaagacatacccaagactagacaatttacaaaagaaagaggtttaatttggacttacagttccacatggctagggaagcctcacaatcatggtggaaggcaaggaagagcaagtcatgtcttacacagatggcagcaagcaaagagagaggttgtgcagggaaactcccatttttaaaagcatcagatctcgtgaggcttattcactatcaccagaacagcatgagaaagatctgcccccatgattcaattacctcccaccaggttcctcccacaacacgtgggaagtcaagatgagattttggtggggacacagccaaaccttatcaaatcccatttaaaatagctataaaaattaaacaaaatattagaaataaatttaagcaaggagttaaagaacttgtatattgaaaattataaaatgttaaataaactgaagaaaacataaataaatgaaagatagtccatgttcatggattgaaagaatgagtattgttaacatggccatactacccaaagcaatctacagattcaatgcaatctctatcaaaagtccaatgtgattttttatagaaatagaaaaaacaatcctaaaatttatatggaatcacaaaaaaccctgactagccaaagcagtactgagcaaaaagaacaaagctgaaggcatcacagtacctaatttcaaactatactacaaagtgatagcaactaaaatagcatggtactaagcataaaaatagacacatcaaccaatggaatagaacagagagcccagaaatgaacccaaacatatacggtcaattgatttttgacaaaggtgccaaggatacatgatagaaaaagtgcagtctcttcaataaatggtgttggaaaaactggataatcataggcagtagaatgaaattggacacttatctcacactatatacaaaaaagccaactaaaactggattaaagatttaaatataaaatctgaaactagattgctagaaggaaacaaagaaaatctacatgatgttggtctataggcaatttttttttagatttgtcccaaaagctcaggcaataaaagcaaaaataagcaaatggaattacatcaaactaaaaagctttcacacaatgaagaaaaaaattaacagaatgaagagacaatgtaagcattgggagaaaatatttgcaagccattcatctaataggagttaatatccaaaatatataaggaattcaaacaattctgtagaaagaaaactattagcctgattttaaaatgggcaagggaccagactagacatttctcaaaataagacatactccaaatgaccaacagatatatgaaaaaaagtccaacataaataatcattagggaaatgccaataaaaccacaatgagatattatctcacacctgtcagaatggccattatcaaaaagacaaaagataacgaatgttagcgaggatgtgaagaaaagaaaacacttgtacactattggtggaaatgtaaattagtatgatgattatgaaaaactctatagaggttcctcaaaataatattaccatatgaccctgcaatattaccatatgacccagcaatcccacttctcggtatttacccaaaagatttgaaatcagtatgtcaaagagatgtctgaactcccatgtgcattgcagcaatattcacgatagtcaagttatagaattaacccaagcatctgtcaacagatgaataaagaaaatgtagtatatatacaaatggaatactattcagtctttaaaaagaaaaaaatctgtaatttgcaatatgtttggaattggagatcatactaagtgaaataagccaggcacagacagacaaatactgtgtgttctcatttatatgtggaatctaaaacaatcgagctcatacaaagagtagaatggtggttaccaaaagtctggggatgggggaaatgaggagatgatggttaaagggtactaagtttctgttaaacaggaggaataaggttttttgttttttgagatctattgcacagtgacatgaatatagctaataacagtgtgttgtacatttcaaattcttgaaggaaataaactgcaaatgctcccaacacaaaaaagctacatatttgaggtgatggatatgttaagtcacttgatttaattattccatgttgtatttataaatcataacatcaatttgggccccatataatttgtcaactcataataaaaataagttttaaaaaaagaaatgagtataattattgctacaaaaattaaattgtaatcaagtattacatgttctttatactaatgaatctgaaaacatggggacaataaatgattttctaggaaaagataagttatctcaactggttcaataagaaatagcaaaaccaataagtctgtaagaagttcaaaaatctgtacaagatttatgttccataaagatattggggccagataattttaagagagagttttttaaagccccaatgtgacagattattttcatataatttttactgtcccaaaaaacacacagtaaaagactggataaaagaaactttaggattatggctgattgctaaaattgctctaatactttaccatccctctatctgagccccaaggagtcccttgtctgggggtgggatatggcttttccactcctgctctgaagaggtagaacctccttccccagtttgcttccctgacatgtcaatggaatgttagcaggtgggtcccaagcagatgcttgaaatgggcttgtgtctaaggacatgtctgttcttatgcctctgccttctctatgagaacatgctgggttagcctgctacggagatgggagagacatggagaagggcctggtcactctattatactcagcaggcccataaacatggcagcaagcctaacggagaccagacctgcccagcctaaatccctgactcacagacacatgagcgaaagatgggttttattgttttaagccactgagtttgtataaacagagaactaagaccactttccttcctaatatagatgcaaacaatcttaattagaacactagggaattaaattcagcagcatattaaaaatatgatacaccttgacagagcaggatgtgtcccaaaaatataagaatattttgataaggggaaatccatgaatgaatatttatatcaataagtcaattaatatttttatcaggtcacaagatttaaaaagagagagacaagatatggtacctctgtacatgtctaaaaaaagttaataaaattcagtatccaatacttttttttttaaaaaaatctatttgaaaactagaaataggttcttaaaatcataaactcacatcttaaatcaacagtcaatattaaaatcaatggtgaaatatcaggagccttccattaaaacccaaaacaaaagaggaattattgctgtttgtacacatttttatagcaattctttatgtttgagacactgcaataaagcaataacatttcagggaaataaatgttagaaaagaaaagttatttataagtgatatgattagttacctaggaaacccaagaaagtcaactgaatatctactaaaaccagcaagacattttaataaacaggctagtcccagaatgtgtgtatataaactaatacaagatatatcattactaaaataaaattgaaaattggatcccatttataatgacaagggaagaaaaataactagaaaaataacacctaaaaagtgctttgtaataaatgaatggtatgctgttcattccaaattatggctcacaaaagggtagtgctcatatataaacagctcttaacaaatcaattaaaagaagacaaatcttcaataacaaagtgaccaaaggatatgaactaacaatttaaaaaaatcaaaaattattgataaaaataaggggggaaattaaactgcattattaagaatttaaagagaacctccttccctcaactcctccctcaccatcccacctttgtccttgttttagtgtacatgaatttccattagattaatattccgggcctccctcccttcccctaactcccccaggtaaagaatagtgatgtatataagagtttgaaaggaggaacttaattttgtgtctcatttcttctgggatctccctgtcatcctggatgtgtctacagcacactcattctggtctgccctttgccatatgttaagggatatgaccctgttgggcaagatactacattgttaatattatccagtatgattggtgactctcaaatttggaagtaaaacagtagtaagcctacacagccaaagacctaaagccaaattctatgatcagctgtgtattaataactgatcatttgttctctaacattctgcttccggtgccatcgtttacttctgaacctaagaggggaaggaaagtttgtttaatagactcctaagaccccaacaataaatttaaaatgcaaattagaatattttaacctagaaaattggcaaagtaaatatgataataattggtaacaataatgccactagctaggaatgaagaagcttcagagaaacaggccaggaagaacataaaggggtgtatcagtctgttctcaggctgctatgaagaaatgcccgagactgggtaatttataaagaaaagaggtttgactcacagttccgtgtggctgggaaggcctcaggaaacttgtgatcatagcaaagggcaaaggtgacgaaagccaccttcttcacagggaggcaggaaggagaagtgtggagcaaagggggaaaagccccttataaaaccatcaaatctcatgagaattcactcactatcacaagaatagcatcggggcaactgcccccatgattcaattacctcccaccagatccctcccacaacacatagggattatgggaactacaattcaagatgagatttgggtggggacacagccaaaccatatcaaggagcacagcgattggaaagccaattacaacacatagcacaaattttaaaggtgcttactcctgtcttaaatcacctgcttttcaagtgcaatcctgcttacatttattgggatttcttttagattctaaagtttatttatatggaaagtaatcaagaaggtacagaacaattctgaaagaatattatacgaggtttagatctaccaggtgttagaattatcaaatagcaataattaagcatacagtccaagtacaagaatagacagatcaatataagtatataaaagtgagaaaaattgacacaaatatgtataaaaaaatctaataaacaaggtagtatttcaaatcaatggaaataaaacagtcagtggtcataactgggtagtcatctgaaaagagaatggattcctatcctcaccttttgtgtaaaaatgacagatgaatgaataatttaaatacaaaaaataaaactataaaactactgtatgaaaacactgcttccatattaattccatgcagccttttaggatgtcacagcaggatgcgtgatcctttctataactctctaagttaaagatacatattctaattcctatggcaaacactaaaatataataataaaatgaagaactacagctaaaaaagggaaatattaaaactactcagtacaaaagaaaatgggaaaagaagggaaaaaagcaaaaacatactgggcaaacagtaaaagacagcaagataatgaacgtaattctccataagaataattaagtgtaattggaataaatatttcaattaaaaggtagtgaccctcagaaaagattaaaatgcaaagctaatacacactgtttaaaagaatgcactttgagcataaatatagatatactgaaaattttaaaaaatgaaaaaaatgctctgcgcatacatatgcaaacactaagcataggaaagctgaggtggccatatcaatgttagtcaaagtggactgtgggacagaaattactaccagagataaagaggaaatttcatcatgataaacaggtcaattcgtcaagaagacataacaatcctagatgtgtataaacctaaaaagagtttcaaaatacatcaagaagactgacagaactgaaagtacaaatagataaattggcaacttcagttaaaggtgttactcctctcccaataattgatagaaataacaaacaaaaaatattagtaagcttaatatgagatttgataacaccatcaactaactatgctatttacgggacattaccctatccaacaacagcagattttacattcctttcaaccattcatggaatatccatcaataaagactataagctggagtataaaacaactctctaacaaatgtaaagataaaagtaataaagaagacataatctgattataataaaataaaattagaaattaataacaaaaatcttaacatctcaaatattcagaaatttaaaaacatatttctaaataagccacgagtcatagaaaaaaattatgaaagaattttttaaaatattttaaactgacgataatgaaaaaataacctatacaaatttgtaatattcagctaaaggagtactgcaccagggatatttgtatttccaaatggctgtactagaaattgagaatgttatgttaatattctaagtaaggatcaaccaaaagcagctaaagagcaaatcaaagacaaactagaagaaaagcaacaataagtagcaaaaatcaataaaataaataacaaaagaaaatctttgaaaccaaagttggttgtttgcaaatattgataaaattgttaaattcctagcaggatgaaaaaaatgagaaaaaaatcataatttaccaattttaggaattaaagaggggtacgtcattacagataatacaggcattaagtgataagaaaatattatgaaacatgttatgccaatatgtttgttaactcagatgacatggacgtattttttgaatctccaggcccagatagctacactgaataattctattagacatttaagagagaaataataacaatcttatacgaactctttcacaaaatacagaaagtgagaaaaccttaacttatgaggccagtataaccctgataccaaaactagacaataatataataagaaaaatagcactatctcttataaaaacagacataaaatccttaaaatattaggtaataaacccagatctgtctctatatgtacataaatgtatatgtgtgcatgtgtatgtgtgtatatatataaacgtgtgcatataagtatatgtatgcatgtgtgtatatatatgtgtgtatgtgtatatataatataggataaacaacaaatgaatgggcatactaatttgtgaaacctaggtaggtctcatagttcatattcccaggactacaactaatcaggctacccagttgttatttatattaaaactcttcagaaacataaatttcattattcctttgataacttaattcactgttttatgatcccagcttagattgtgtgatttgttttttttttttttttttttacaaaggactgaagtcaaaccaccaaaagaaaaatgtattgtaacaacaaatagggtacaactttaaggaatgtacttttaaaattactatgagtttatcaataataacctttcatgttaagtcttccaatttttgtacataaaaatgattttcatcaaaccactgaaactatccattgtggatgtaaataaaataaccaagttcaatgtaagaaagcagcataaaacaaagtaaaacttgtgatttgcaaatcagcctgatgtaagtttgttgttgttgttgtttttttttgcctttgtagttgcagaaggtgagctctgttttagaaggagtcatttcattccccaattgaatttttactcatttaggctaaaatcacttcaaaagtttaaaatgagggtagaggaaataaaaaggaaaaaaagtaaacatatagttaagtttatcatcaccagatcactaaatgctagctatagaatatccaaacccaagcaaatgcatagagttcttcatgcccatcctcgcatctgtacatttctcagggagataagaacaagctaaaattaatagagacctcttgcgatttttattagactatcagctcacattttctacccaatatgaaaattagcatccattacagcatcatagtatttccaaaagatgttcctttaagatgttcctttcgtatcactaatatatactaactaccttttccatatcaaatatttggatacatggtattttttttcaaaaagactttccaaatgtgaaaattcatttacatgaaaggttgtacaaacacaaaaaatttaagagtagagctttagtgaatcacatttgttgaaatgaaaaagcagcacaccaagtgggactatttactcatcatgccaatatttattgagcagctgtgatgtgctaggcacgggggacccaacagagaataagatggatgtggtctctgtcaccacagagcttaaattctaacctagaagacaaaccgttgattagaatgtgataagtgctctgacagagacatagcattttgagaacatttagcagggggacctttccttgactggggttgggtgggaaggaccaagaaccggctgcctgtgaggaagtgaagtctaagccaaggaggagttcagccaagtgttggagtgagagtgggaaaagaactgtcaggcaaaggcaatgaagacactgcagtaaaaggacatgaaacagctaagcaacaaaaatgcagaaacagagccaccttaccaatcagatgctgctgccagctccaggacttgtacatagtgagtggacacctctgaaaacagacgctttcacctgtcaaagccattcctggtatttacaatgctgattatctaattaactcactgtgctagactgttgagatggttcccagtgcccccgcctcctggtattcactctcatatgtaaccctggtagggttagaattaagcaagtcactaggttaagagacttagtgacttgtttttaaccagtagactatagcaatattcacagaccatgattggattatacaacttgtgattctgtcttatttgcagattatattgccttctcagtctgcaggccttgatgaagcaagcttctatattggagagaatactgattaggaaaatgggaaccagctaggaactgaaaccttcagttcaacaactcaagggactgaattctgccatgtttctgtgagcttgaaagcagatccttcccagttgagcctttgaatgagatccagtcctggctaacatcttgactgaaaccagtgaaagaagctgaattagaggacccagataagttgtgcctagattcgtaacccacaaaagctgtgagattgtacacaggtgtgatagtaagccactaagttgtggcaatttgtcatacagcaataaataacaaatgcactcatgcatgtgcatttatcatgtttacaagtattttctacagccatcataggtagcagttattaggttgagtcctgcattttatttgtgagaggaaacagaagatagtatacttaattattaaacagtaagtttctccttcaggaagaataaattttagctggtaagtccacatgttcctttgatgcgaaaatgaaaggtcagagataccaggccctgcaaatgggtctccagtcctgtttttcctgccagtccttgcaggtcagagcccacaggacaagttcctgggattcacacagctaaagactcaagtattgttctatctcagtgtcttcctaggttctctcctcaaatcccaatgtcccaagataaacacaagctgagatagctgcaaagggtctggagtatggaagagttcctggacatcataggtcctcccttggcagcccagtggtttagcatgtgggccctgaaaatcaactgcctagttcaatcctggctcagcctcttataagatgcaagggctaaggcaaatcatgagttctctatgccttagtttcttcatctgtaaaatggaaataataatggcccatacctctaagggccatagggatattttaaccacataattcatgtaaagggattagtcgagagtctgctgaatgttttgttaaatgccggtgtcatcactattagttattcgtgtaagtcccatttctagtatattccctatttgtgcagtaattcatgtgcataatctcagctgcgtcaccttgtagctgtataactgcacaagctgaatgtcctagccttggctttcctatctggaagaaagagtggtcatagtgcctgcctcccagggcatggtgagaatgtatgagaagctactgaaccagtgctagcacagaaaccacacaggcaaaatccctttatggaattcctcaattctatcctatgaagaaagagcaattaccactcagaaatgtgattgttttccaggtacacagataaacctgtcaccaggagcccttgggtgttgtctgatcatgcactgaactgagtaaacattttagaaaattcatttgctgctgtgcaagtcagaagataatggtagctgcaacttagtttcagaaagattcagatgaacaatcttagtagtgtgggagagatctttccattcacttacgttttgctgtaaattgggaaaacaccaccaatatttggtcttagagtggaacatttctgtcagattctggatgttctaaatgtgtactgtttagagccacaaggatgtagagtgcttaacgggctttactgctgcaatcacctgctctaactggtaattaagatataagtcaagagcttatgtgtctgcttcacccacaaatgtgaggttcctatttctgcagcaattcttattcatgccaacccaataccctgagaggcatgttaaattttatttgccttgccattctacgcttatcctccctcccacatctctttctcaaaaagccagtggaagctgaaggctaggaaaattcatgcccctggcctgggcatctgctaccattcattctctacagcccttatgcctagcccacagtgagtcccatatagcagagaagaaggaaactggtgaccattttgtgtgctataagtaaatgatatttgaaagagttcacattattaacacaatctcaaatagtcctggttaacagagatgcccctaatggtagactgataaacaacaaagatggaaacatgagatttaaggtaggagaaaaacgaatagaaactgccttcctctcccaattctctgccaccccctctgtcaagctttgggattaacttggatacccatctaccatgagcagaaggggacggtggctcatggatgctgagaacttgtgccgttcaaggcatgaggacaaacctcagcactgaatgaacatatgaacagtgataccatgtgccccctgtaccatcaaaagagaagaccttaaattacaaaacacattccccaacctctccctcatttggaattcaccacaacccagggaggtaggctgcatccttgctcattgttgacaaataaactaagttcagaaagatttagtgggttcctcaaggtcacacagccataaagaggccaagccagaactcagagccacttctcactccaagtccagaattctggccatgatccaagccacctgtcaattttataactacaacgccagaacacacagcactcttgacccactaaatccataaggaagtaacatcaggggagataagctgaagaaatctcattattttatgtcactgaagtccataagagaagcagatgcttctactaggagcttttgtgcttgaaaacagttgtcttgatttagctttacagaccatatcctatcccagccctttctgcctccctcttttgaaattgctttctcactgagcctctataaccaatggcttagtcttcagcagcactgagggagaaagaaggatgataatcacctttttaaaggagagcagagacaagaaacagaaaagagactaaagtatgtgagaaaaaagtttcaagagtaccatctattgcagctgaataaattatgctccaaggagcagactctccctactaagaaactggaagtaaagcttagtgaattgaatagactaaatctgacatgtccaaattttagtggcaaatcaggcgtctgattttcctgtagataaattagtggagaaatcaatctatatggaatcatagcattcattctgaaggttacaaaaatatacaaatgagtgtctccattgttggcttactccattgtacaatcttctttgtatactagaatgtttaagtatggaatgaattcactatacactcctggaaggctcacatgactggaattctgttgacacctctgctggcagaggagcggcttctgggagtggatgttggccttgcttcccagctgttctcattttgcctccgccagagggagatgggaacagctgatggcttcacccccaaagctcagcttggccccatcattagcacatctcacccctgcagctgccaaggccaagactaacatgccagcaggaaagcagctgactgacttttctgactgagtgtttggagtactggaagttgagaatcaagctgccaagcgggttcaacttattttctgtacatttttatgatccactcgctctagaggccatgaaatgagggtgtctgttcttctcaacactgtatccccagttcctggcacaaatctgggattacaataggcagccaacaaatgtgttgactaaaagacccaaagaatcattatcagagatgtctagttctgaaaacacagtggactgagttgacacagctagaaagcctttctactacaaacacagaaaaatgttaaataaaatgtgacaacctacataactgaactagaaagaagggaaaggaaattatcagggaattaaggaattcctagccagagcatccacccactgccaaagtcatggaatcccaaaggcctggcagacataggacttcagcctggaaaccatgagttcagtaacaggaggtatgatcttgaacacacaagtcagagaactctagctagatccttgaataaaaccaagcccagacaggctgcccttcccaagtcaccagggctagaaaacctctaccaaatgccacagggaaacttcaaagtgacatgtctccccagagatctggtgagggttagggagtttcgcaagagaaatagaaacttcaagcctttgccacatgggtatggagaccaaaattagaatagccatgtggtgtaaaattcccacaataactgggcttagacaagggaaatccctgaggcatctgtcatgagtaaacagactctgctccacaggaactcttctaatccagggtacataggactcccatggagagggtagcagtggagggaaaaaagctgaaaatgaactcacaatttaaaattgcaaggcattggaagagataatccacagtaatacagaatcagcatcctaagaactttaaataataacctgaaatggataacaatatataaatcccaaattattaaagacatgtaagaatacaaagaaaagataataaaagataattttaaaatattacattttaagaagatcaggcaagtttgaaaaagagcaaaacaaagcttccatacgtgaaaaagtaaagatattgaaaaatgtgaagtcaatagacagtttaaacagcatttagacacagctcaagagagaattggtaaactgaaatttagacttgtagacatcacccagaatataaagcaaagagtgataaagagatgaagagaagctaaaaacaggaggactgaattataaggcccaactacatataacaaaagttccaaaggaagtgatgaagcaaaaacggcaaggcagtaattaaagagatgcttgctacatttttttaaataattgattggattcaagaagcaccacaaggccagaaatacacaaatttaatataaaaccatataaaaacacacgaataaaatacagaactacacatacacaaacacacacactccaccaccaccaccaaagaactaccttaaaagtaaccagagaaaaaggcaggtttagtgcaaaggcacagtcattaaatgaaagactccttaacaacaacaggagacgcaaggatacaacaggtaatatctgctaaaagaaaaaaatcgccaacctctggtttggttatccatacatacctagactaacattcatgaaaaagaaaaacattttccaggcaaacaaatatagggaatttgctactcagagaccttcaatgaagactacttcaataagaagcgactggatccagaagtggaagtggtttgcaagaagccatggttaaaaaaaaaaaaagaaagaaagaaagaaaaagaaaggaaagaaaggaaactagttgcattggataaatcagcataagcctggactgctcagcacagaacaaagcctagtatttccccactatcttttttgatgagagatgggtttcaaaatggcagaactaaaattctagacaataataaaaaaacaggaggcacaatgaagggcactaaaccatggttagcttgtaattgtttgggaggaggccaaagttactgactacctttggactctgtgtctgaaatgcaaatgttaaaaatttaatggtactactaaaactgtggaaacagaatatgtaacctctaaattaacagaactgggaaagagtaggtataaataatcctacaacaatagaagaaagaaaagaaaggtgtaaagatagcaaaagttagttattttcattaaagttaaaaaaaaaaaaaacaaggagactagcaatcacttcttcttcttcttttttttttttctttcttttttgagacagggtcagggtctcactgtgtctcccaggctggagtgcagtgcaagatcacagcagcctcgacctcctgggctcaagcaatcctcccaccttagcctccctgcgtagctgggactacaggtgcatgccacatatatgacttttttttttttgtagaaatggggtgtccttatgttgctcaggctggtctcaaatttctgggctcaagtaatcccccctccccaccccccagcctctcaaagtgctgagattacaggtatgagtcactgggcctggctaatccttttgtttatcattgtaatggatatgctacccaatgaaacaagaaaaataaaggaagtagaatgaataaggaatgtataggaaaaaacaaaacttaccctttcaggtgattattctcttagaatttctatgacgtcaatctacagacaaactattagaataaaaattgagcaaacacctacctatgatttgaatcatcaggattaaaaaaaaattgagcaagatttctgaattcaaagtcaacctacaaaaataagtaacattcatatacactgaaaagaaaacatcaattacaactttcaataaggaaatgactccacagataaaacaagaacagccatgaactggcacttgttgaaactgagtgatagaaacacaggtattgattgcagtctgtctacttctgtgtatgtttaaaaatttcatattaaaaagttaaaatcttttaaaaatagtgataccatctaaagtgacaataaatctattaggtacttaggatatctagaaatatatcttacaaagatgcacaagaacattgaagagaatattattgaaaacttattgaatagcattaaagggaacaaataaatagagaaatcaccacattcatgatgggaagccttgatgtcatgaggatgtcaattctcccctaaattagcctacaagtccccatacagtattttgcagaacttagcaagaagattctgaagttcatatggaaacactaaagtttcagggctagtcaagataactttaaaaggagaggaggggagaaggaaaggagacattaaactttatactttattgaatacttagcatggtctgagcactgttcaaagcactgtatatgtattctttcatttcacctgcactacggccctgtggaggtagatatgatctttatcaccatttcatcaagggaaaatggggaaagaaaaagattacatagtttgttcaaggtttggggtgagcaacgatcccaatttgcctggcactgagaggtttcctgtgatgtgtcatcttcagtgctaaacctaggaaagtctgggcacacaggatggttagttactttctcaacatcacatgtcaggagccaggtggcagagctgatctgcaaactccagcaagctggcttcagtgtctgccctctgcaccaccacataccaactctattagtcagggttctctagagggacagaactaatagagaggtatataaaggggagtttattaaggagtattaactcacatgatcacaaagtcccacaataggctgtctgcaagctgaggagcaaggaagcccgtctgagtcccaaagctgaagagcccggagtccgatgttcaagggaaagaagcatccagcacaggagaaaaatgtaggctgggaggctaagtcagtctagtcttttcacattttttttttctgcctgctttatgttctggccatgctggtagctgattagatgaagcccatccagattaagggtgagtctgcctttcccggcccactgactcaaatgttaatctcctttggcaacaccctcacagatacacccaggatcaatactttgcatccttcaatccaatcaagcttaaccatcacgccaaccaatctaaacactgaaggcttattgtgaagtacgggatactgagaacaatatgatgctggaacggaggtaaatagaacagtaggacaaagaacccagaagcatatctgtgtgtgcttgctggttatcagaagtggaaaaggattcaacaaatgttactagagcaattggttttccagatggggggaaacagacatggatctcatacaagaaataaaaattaaattccagttattctaaaagcgaaaagcaaaaattttaaatttagaagaaattatcaacatttatttcggagctcaggaaagagaggaggattgtttaaactaaacttaaaaagaaacatgagtaaataaagataaataattcaaagaagaaatacgaagaacatataaacacataagaatcttagagtctttagtaatgagaaaaatgccaattaaaacaatgaaatatttaacatccagcttggcaacatttaaaaagcctgaaattaccaagtattaacaaccacataggtaaccagagctctccaataagtaggcacataaattggtacaaccaatttggaaagcaacttaacaaaatacgttacagtaaaaaatttgtgtactctacagcttagtaattcacttgtaataggttccctagagcttacacccatacctaagatagcaaggatcctctcaccattgcaatatcaaaaagttggggaaaacatatttattatcaacagaggagtacacaaattatgatttagtcattcaattaaaaggaatgaaccaagcacatatatgaataagtctaaaatatatattgattttttaaaaagttgcagaaggttgtcatatatagtagggtaccatttacttaacagttaaatacatgaagagtatcagatattgattaggggtatgtgtgtgtgtacacacacacgaaccaaccaacttcacagtagtatagcctctgcaaaaggaagactgagataaaatagtctgaatgggtggggagaaaaggtatggctataaatatatctttaacattttacatctttaaatgttgaaagttctgaagtacatatagtagaatctggctggcaaaaatatgggtgtataacttattctatgtccatttttcaactttaaaattgtcatattttagaaatgaatgatggggccagatttctttttcaatcatcttttatatgatattctcaaattatactgaaattggctgaaataatgattttagcttaaaagttttacttagtatgcttaatttcaggaatgtacctttccataggcggacaacagctgcattttgaggtataatgtagaccctaaatcctaatgcaggctctgaagaacactaccaacaacaacaaaaaacccaggatgaaaacaaaaccaaaataggaaggcttttacactgttggtgggagtgtaaattagttcaaccattgtggaagacagtgtggtgatttctcaaggatctagaactagaaataccatttgacccagcaatcccattactgggtatatacccaaaggattataaatcattccactataaagacacatgcacacatatgtttattgcagcactattcacaataacaaatacttggaaccaatccaaatgtccatcaataacagactggataaagaaaatgtggcacttatacaccacggaatactatgcagccatgaaaaaggatgagttcatgtcctttgcagggacatggatgaagctggaaaccatcattttcagcaaactatcagaagaacagaaaaccaaacaccgcatgttctcacccataagtgggagttgaacaatgagaacacatggacatagggaggggaacatcacacactggggcgcctgtcagggggatggggagctaggggagggataacattaggagaaatacctaatgtagatgacgggttgatgggtgcagcaaaccaccatggcacctgtatacctatgtaacaaaactgcacgttctgccatgtaccccaaaacttaaagtatattaaaaaaagttgctcatatatctaggcaatccttcatgtactcccagtatttcaatttttttttttaaagcaagactagattctcagatcacattcagattcaagtgagcatatctctcaaaagcaatgtctccatcctatcctggctttaattacaaacatagcaacacataatacaaggaatcttttggccaaattgcagaccagtgctcaccatgcctgctaggggaagacatgtcaaggtgtttcaacatttctaagaatggatcatctaaactgattaagcagttcaaggcttccaggagtaggtaaacagacagaaaacgttatccaatgaagctgtccaattttttaaatagttgccaagaagctgagctcttaatgtagccttggaatgacataaaagcttaaaggataaaaaatatcaatatgatgctgaattactcggcttttccatcccatctatcaactggaggcaaggtatattgggcattcaacaaagcacaaaagaaacagggtgaaaaatgggctggagaaagtatgaagattgaaatggcagcctgtgagaaagtgtaatattcaatgtgcacatttcaattggcaaataatgttcatttgaactgcattaccgttctgctgagatccaagctaattacaatctcactgctatagttatggcaaagataggttatgaactgtttgccacagctaggttaagatccagtctccagcgtgaggtagactagattgccttgcctctgacactgctgatctcactatctgaggctatcatttccttttctgtagaatgagggtactaacaggaacaacaagattctttcagcagaattgcaggagatagtgcacgcaaagacctgcgcaccgctcctggcactgacgcactcgacaaactcctttttaagtaacaatgtgctggtatgacaattttaggtttaaaaaaatactaaccaaacatatgaagaaacaactatgaaaaatgcacagcaactactctcaaaaacattgtctagattataccaatttcacttctccagcccagagacctgacaattaaagagcatggacatactccagagctgcttcatatagctccctgtgggcacacagccaaagggttgtagggcttagccatttggtacagaagaaacatctgaaaattctacacctgtctttgtaaatcatggacgctgcagaaaccatttagcttaaggaggcctctgaaacacactctgatacaaaattttttttctgcaactctgatgagttcattacagcatcatctacaccaggaaggaatgtgcttagcttctttaaatgatgtagctacattccttaagaaaaattttgttacagtttccacagctgcaacatttatctaattaggtatatgttgactttgagtttttatagattttgaaaagaaagttttgaaacatttaaaaatgagtttaatttttgtttccacaaggaaggagttagaaagtgccaaatgacaagtgagagaaagaaaatacatctatatgtcgagcatggtaatcaaagccttggctaaattctaaatgtacatggcggagtcacaggtgtttatctgtatgccctcctgaaaccctgccataagggaataattgtaataacaataataggctgcgtaccatggttcaatgcctgtaattccaacacttttggggggctgcggcaggaggatgcttgagcccaggagttcaagaccagcctgaggcaatagagtgagattctgtctgtataaaaatttaaaaattatattttttaaaaaaaaacttttgagacagactctcactctgtcacccaggctggagtacagtggcacgatctcagctcactgtaggctctgcctcccaggttcaagcgattctcctgcctcagcctctggagtagctgggattacaggtgcctgacaccatccctggctaatttttgtatctttttttttagtagagataggatttcaacatgttgaccaggctggactcaaactcctgacctcaagtgatccatctgcttcggcctcccaaagtgctgggattacaggtgtgagccaccatgcttgaccaaaaatttaaaaattaagaacaaattagttgggcatggtagtgtgtgcctggagtcccagctactagggaggctgaggtaggaggatcacttgagctcagagggtcaaggctgcagtgagctatgattgcaccactgtacatcagcctgggtgacaatgcaagaccctgtctcaaaaaaaaaaaaacaataataataattaaaacacaaagcagcaaagctttggaagatggaaaggggatggacaagttgttacctatttagcagggaagagagaatgggaacttatgacctggaaaggagggcagccatcagaaggtgggatggataagcagaaccctggaaaggtttgggaacagggggcactgggcactggaacagggggcactgtatgggccaaggccaatacaggctgaggctgaaaacctgtataaggagaagatagagccctagatcccctgcaaagccaacacagctaggtgttgcctgtcctactccgaccaacatgggaggtgtatttcctgaagacactgaagtagagaagttctgtacataaggactcccaggaatcgtgaaggtgggttagcaaagtgctaaacggaaaacaaaaggattaagtttaaacaatacaagcatacttaacggcaacactatcttcttttcccctgctcagttcacaggccctagagccaggcttaaattgccagagtgaaatcgccttggcaggaagctgaaggattcttccttggagaaattgaccagcctaagaaaaatagagtctgtgatatgtggacgtctctcagcaaaatgaatgttcatcagtcagtaaatccatctgtggaagtacacagaacttctaatcagctctttaatgccccgttattaaatatcaacagagagccaaaaatcagacatttgaagaaagtcagacagatattaaacaaatgggggggaaagagaatctcaaagctaacaatgagaaagaggtgaacaaaaaatgtttaacaagtaatgactaacacattcagagttaatagcaattttacatccattacaaaaaagaagaggacactataataagaataaaagaacattcattgcacaagaaacctcttggaaattaaatgtggtaggataaaatttaaaattatttatttattttgatacagggtctcattctgtcaccgaggctggagtagcacggcatgatcatggttccctgcagccttgacctcctggactcaagtgatcctcccacctcagcatcctgagtagctggaactaaaggtgtgtgacaccttgcccagttaattttttaaaaattttttgttgagatgtggtggggttggggggtgtggctcactatattacccaggctggtcttgaactcctgggctcaagcaatcctcctgcctcagcctctcaaagtgctggaattacagacatgagctaccgtgcccagccaaaaaatttaaatagaagggttgggaaatgaaattaaataactgtcccagaaagtagaacaaaaatgtaaagggatgaaaaatagataagaaaattaaaggatgttttcaggaggctgggacattcagctaatagcagtttcagaaaagctgtggtaaaaacagtgaggaagaaataattgaagaacgaatataagaaagtatactaaaacttgacaacatgaatattcaaactgaaggggcccactgagttcctaacaattactgataagagcattgctaaagcacataatcataaaacgcaaaaatactagtgacaacgaaaaaagataatcacttccaaaaagaaaaaaagactacatttaaaggtttgacaagcagaataccatcaacttctcaagcagtaatggccatagagacattgaagaaatgccttataaaatactgagaaaatatgatttctttcttggaattttatacctaaacaaactagcaatcaagggtggaatgaatgaatgtgtgtttatctatatattttatacaaggtatgccagagacacattccaacctttgtttttactcacagaactgttttgtttgaagcagcaatgtacatagttaaaaatatttacttttctagtattctgtacaagctagcaggggccctgggtcacagtctagccaatgatatctaagacaaaatctactacaaacgcttatggaaatattattttcctgatgaaaatagatttgactggttctgccttttgtcctttctgctgtattactgcctggaatgcagatatgatgccaagaggtacagcagctatcatgagaccatgaggaagtaagcataaaggcaaaagtcaacatctacgtatcgcagatagaaataaaagaaagtgcttgggtccccgatcacatcagtgacctgacacaccagttacaccagccaccaaaatacttactttgcaactgcttgtaaagaatacgagcttgtaaaaattgctgctgtcatgtttttttgttatttgcagctgaaagcatccctgacatattcacaagttatcaaaaaaagttgtatcttcccaacacccatcctcaggaagttactggaaaacgtgctccacagaaatgaggaatgaactaagaaaaatttacagtgctcagaatacagatgattcaacacaggaaggatgcaagaggaattcttagcgtcttggtaataagggtagtcctgagataacagctgtaatgtatgcctaaaaagtaacccgtgagtcacattggaacaggaggatgaggggctctaggaaagatgacatcaggaaaaaaaaaatcatggctagactacctgatgtgttggatcatattgaaaggaggttgatagttcttccagaaagtgtggaagtaaaatagaggttgcgtaagggatgggaaaaaccaaaaaccaagtattctccctactctcactctcagtaccgaatgtttcacctctggtcacccaaatgtgtgggagtttctccccaccaaccaccagttcttcagtagagatcaactgggagtcctacaatttaactctattctgactctatctacctggagaaagcatcagatcacacaggttaagggctcagtcccacaagacttccccccaatgtcagatgccaatcacaagtagtaggttgtcacacctatacttctgaccaactagctataagttgggggtccacaacccccttctcaggttcagttaatttgctaggtaagctcacagaaccacagaaaacacttgcttatatttaccagtttattatattaatgaaggatgtaattagggacacagatgaaaaacagttggaagagatgcaaagggcagagaatgtggaaagggatacagagcttctgtgtcctctctagatacgccaccctccaggaactttgatttgctcagcaatctggaaattctacaaaccttgtcctttggggggtttatggaggcctaattacacagccatgattaattacaccattggcgatcaagtcaaccttcaatccgtctcccctccctggaggttgcaagggaggtggcactaaaagtcccaactctaatcatgccttaacaagctcattagcatacaaaagacactcttaataccccagagattccaaggattttaggagttctgtgccaggaaccaggggcagagacatatttcttattatatcacaatatcacagcttggtgcacagaaaataaagcaaacaaaaatcaagacaaggcaatcattaactctaggaaaagcaaaaagttacaagagggatgaaatgccataaaacactgcacggcaaaacagtgaaaagtatttgcaaagtcttcttagtgcaaacattgaatttttttttaatgatggcactactatattgggtagttgaaaagaagagaaggcagtgtgtctggagtagggtgagcaaagggagaatggtaagaaaggagatcagaaaggaaaacaggaattaggtcatgctgaggtttggattttctttcctaagggtgctagagagccactggggagttttagacaggaaacttgaatgctctaactcatgtttgaaaataataactttggctctattgtggaggaaaatataccatgcagggataaggtgaaaagccagtaggcccgttgggtaagagggataagaggcttctgcagaagagatttttcctataatgtggcctggactgggaaaggcacacttcgggatgtaaggaagtgggtaggtgggaatatacttaggaggttggtggcttacggagtaaaaagagggacacagggatgacttcctgcatgtcagcacaaggcatgtggagaaggcagaggaggttgttactgggttcaggaaggctggggagggaatgatttgcaactagagagtctgggatctagggttctgttttggacttgttaggccgagttgccccagaaagtaccaagtaggcaactgtgccagggctcagggtacagacaaggctagggagaaactcagaatatgctcagactcaacaggtagtaattcctccttttctcttgccaatgcaaagaaatgtttcattatatgtttggcgttttatacggcctcaatggtatgatttggggcactgattgattgaagacttgatactgagaatctaagggtaaacaagcagtgaatcctggaatatatcacaataggtaacccattcaaagtgcttaggcctccctggttttctattttgggtcatatctgtcttaaggaaacactctctctaccaaagctgaactcataaaatagtaaaagtcctcccccgcccacacacacaagaaataatttcccattattagctggatttaataaacattttcttccaaaaaaaaaatttgtccctgctcagtagacttctctttatgtgtacaaagcacgtgccaagttaaagaccatgtcaggcacactttgagacactttccgttttttaaaaagttctttcttaataaacattcaaaaggaccaatttgtttaaaagtctttcaaagcacaattcactacaggtcgtagagttctttaaaccctcagcaggattctttcttgactttctcattgctttgtgcaatctttgtatttaatcatttatccccgaattggtcttcgcagtgtggcttttaacaagaactgggttttagccacattacagtagacgcggtgggggcggagggcagcagtggcaatcgcaaaataaaacgtatcataaagtggtaacggttcgtgatttaggccagttgttgaaaaataaatgcctgttatatagaatcacagaacttgagagcttgcggccaagggaagtcgttcatcggtggaccgacagcgccccgggcggcagaaagaaggcggcggcggcggagacccggggaagttgccggatttttaaaaaggcacctgctgggtgagtcctcactgtgcaaacgggagccacaggtgcccgattttaaggggctacaactcgggaaaacctaagtctgtaaaactaagtacgttaaactaagtaagttctcgctgtgcaccaagttgatgggggcgattatttacggcggagaaactgagtggaggaaggagggagaattccgctaaagtttgcctgcgactgacagctagggagtgacctggaagccaggaagaggggcagagaggaaactaaagaagtaggtaagagagtcagtttatgaaaatagagcctgctgtggagagcagcaggcacacctgcggaggagggggctgcctcacctgcggggccgctgcgcgcccccctaagtgtgttagcgggggaggcggggctggaaaggaaacctggtgaagggctggcccggagcctggggtggggatattcactgcgggatagggccagcaagaggacccgacacgcatcgtcccgagtgacacgtgtaaatgtcaagatacagagacatctgcaaatgtcacccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagttcggcgacttacctcgggcctcgcagggcgcgagcagagcaccggccagggcgagcaggagggcgcgggcgggggacacgggcagcgggcgcgctgccatcgtcgccggccttcagtgcagcagctctcgggcccggcggcgagcgctgcaccatcccacgcgggcgccgagccggggccgggcgtcgcgaccggagggatttcctgcctcggcgagtcagctccggagccctcgcgcagcgcccgcgccgccgctgagctcttctagcctttcatttttaaaaaagtttccccccgtgtgtgtgcgtgcgtgcgcgcgcgcgcgccgttctggcacaagccagccttgaccgttgcaataaatgagcaaactgtccgagttggcccggggactaggaagagcgttagtgagagaaggcaggcctgtgaaatggatccacggccagcagtcaccgttcttattaccgcggaacaaattattgtctcccccgcacccccgccagttggcggcgtcccgcgggtcctagagaccgctcgggtccccccgccagggtcccgccccgagccgcggctcgctcacccccgagggtgggcggctcagacgtggctcagtggcgtccgggcgcccggagcgcacacgtccccgccccaggatgatgtggccgcagggcccggggcgcccggctgccaagcgcacatgcggcggcacggtccagcttttcaggctgaagctggaaacgatgactctgctactcgctccccggctctctgggaaccctcggagtgcgggtcaggtctccaccgcggcccacagcccggcgcgcgaccccgcccggccctaagcgcccaaaggggcatctctcgcccgagaaacaagcttggactcgcaggcacaagacacctgggcgttacttttgatcaacagtgttaggttttacgttgatagattggctcacgtttccattccatgacctggacccagaaaagggtgtacagtgacgttccccaaactttcctgattgtaagaagcacctgggttggcttgttaaaaagattcccgggcgccctcctacgctttcagaatgagactctccaggctgtgaggccaggggagcccagggtgtttggagaaacaccaatgaaagaatggtgcgccttgccttctcatccttgttccgggctgaccccacctcttcagcctcgctcggccctcagggagaccatgaaaagcagcagcgagggggcccgcacagacagaaatggctggagctatggaggatggctgatgcccaccctgcgggttaccatgattcccaaccttggggacttattagaatagtaagagttaaagacattgccagccccagacaccagttaactcagtttcccacaatgcgtggagctcaatagttttcaaagcctcaggtgattctactgtgctgctcagacctaggaccacctgcagaaattccatcctggtcctgcgacctcgcaccgattcctgacggagcacccactcctaggaggcggttatccagcatttgaggaagctgccttccataccatctcttcccactgcagaggagttttctcaggagttccctcccacggcaggttttgcagtgttcccaaaacccaggtcgatcctcctaacaaggtgcaggactttctttttaaaaaaccttagtgggaagcacaggctctccagcccccttcccaatgctgccatatctcagtaccagatctggaaaccaggcctggttcaagccctgtgtcatatctaaccgtactaccaaccagcgttgcagtgtacttcttttgttcattcattcagtcaatctacatgagcaaccctatgttagaacttgggaaactaaacgagaaagcctcttgccttcaaagacttttctttctgatcaaactgataaatcatcattattggacagtgtgagctagttacttaacctagttaataatgattaggcttgtttactgatatggtttggctgtgtccccacccaaatctcatcttgaattcccatgtgttgtgggagggacctggtgggaggtaattgaatcatgggggcaggtctttcctgtgctgttctcatggtagtggataagtctcaaaagatctgatggttttaaaaagaggagttcccctccacaagctctctctcactttctgcctgctaccatccatgtaagacatgacttgccccttcatgtcttctgccctagccatgtggaaatgtaggtccattaaacgtttttcctgtataattttacccagtcttgtgtatgtctttatcagcagcacgaaaacagactatttactacttcataattcattacatacctcgtataatcggagtattgtgctaacgtctttcacctgcattatttcattttttaagtcctgaatatacagatgaggaaactgcagcatagagatgtagctttcccaccaccacacagtgaagtaggtcagagcccaacctcagatctgttaaagataaagcctgtttctttaaggctgagttccaaccttcagttttagcagctgttaagtgaaggtaaaatacaaacctcccaggtggttgtgagcaccaggtgaaataatgcaatgtctcccaacccacctgatccctgggatgtctgttaagaattcaattcctctggcgtttgcactggagattctcattagaaaggtctgggaaggacaagttttagcaagtacttaggtgatcctgatacttgtggcccatagaacttcagacacatcgacgcaagagaattaaaaattgttttcttccagctcaaagggccagatttgcttgcagatgagcccagccactggcctctcggatccttctgactggttaaatggtttattcacaatggacctaacatgtgctgtgcactgggctgggggccttgtatacattttctcttaatgatcaatttattttcgctctttcatattcaattgttaatgttgactgtaaaagtccaatttcttttaaacctggatgttgcaaagcttcctccaaagaactaaatgtgccccaagactgtccttgatttgtttctgactgaacgaaagaaaacagccattgcagaggaaaaatgaagaaaaataaaatcctggctgcaagctctggatttcaaccctgtaattcaccatctctgtgaagcaagcggcctgggctgacactgtctccacaaagccttcatagacatcaataacagccagctaaggcaaagagcaaatcctgcgtctggcagatggtctgtctttggatggaaattctgcctcctcattcacaggaaatggaagccgacatcacattcaatactggattgttaggtaatggtgtggggtcagaggccaggatctacacacgaaaatttcagatagatggctggttgtcccttcctttctggaagaattgacctttgcaatactgtttcctgtgtgctattttcgtttaacagcctgggcattcacaacgaacagggcacttatttcttacccaagctcatgtaagctcaatctgctctgagtacaagcagatgaaaaacggagacaaactttcctaagccaggaatttacaggcagccactgctaatttctgcagtaagtgaagagccggcctccttgcagagtgacctattgacagaacttcagacacaggcttgcagaacagctttcctctctccaagcacagttcccaaggcttactccaaacgtaaacaaatgtgatcaccccaagattaagattcttggaaatcatttttattctatctcttggagagatgaaaactcctgctcctctcggcgtattataataacatgtagtccatttttcttttcctagatctctcacttcaagaatccatgccttcacctcctcagaaacctgcccccagtgaacctcttctgggcagattaaaccctcttgtctctgatgctttcattattgcacagaattagcacttaagtagcactaaacgccaaagaaagaatgctcctggggctggggacaaggaactcggggatgcgctgtgtcacaagagacaggaaaggtcaccccatctatattcatctatgtcacctacccactgaccagtcaacttctccaaccaagtgacagtcatacttcacttaacaaagatacattctaagaaatgcatcattaggcagttttgtcgctgtgtgaacatcacagagtgtactcacacatctaggtggtaccgcctactacacatctaggttttatggtataacctgttgctcctaggctacgaacctgtatggcacatgactccactgaatactgtagggaatggtacagcaaaaaggcagaaaggtacagtaaaaatacagtggaaaagattttaaaaaatggtacacccggatagagaagctccattataattttatgggagcatccttacaagtgctcaagtgcgtaccacgtgattgaccaaaatgtcatttggtgactcatgactgtactgtgatgggaaacttattatgcccctccctacacacccccagattccattttacgtaccccaagtgactgacagtactaagagaaacagacacctcctggagcagcagcagctgctgagacagcctcctagaccaggtgcttatctctcccgccatcagcgggggcaggctgagtgcaaagccagcacacagcgaaaggaaaaggggaatctcaaaaacaaacatgaactatgacaagaatgaccaaacatttgaggatacttcatttaagaaatagggctggccgggtgcggtggctcacgcctgtaatcccagcactttgggaggtcgaggtgggcggatcgcgaggttaggagatcgagaccatcctggccaacacggtgaaaccccgtctctactaaaaatacaaaaaattagccgggggtggtggcgggcgtctgtagtcccagctactcgggaggttgaggtaggagaatggtgtgaacccgggaggcggagcttgcagtgagccgagatcgtgccactgcactccagctccagtctgggcaacagagcgagactacgtctcaaaaaaaaaaaaaaaaaaaagagggcttaatcatcttcccttttcatgtgggctgggcttagtgactcttttttttttatttcaataacttttgtggtacaagtggtttttggttacatggatgaattatatggtggtgaattctgagattttagtgcacctgggacccaagtagtatatgttatccctgatgcccctcccatccttccccttctgagtctccatagaccattataccactctgtgtgcctttgcacactcatagcttagctcctacttataagtaagaacatatggcatatggttttccagtcttgagttacttagaataatggcctccagctccatccaagttgctgcaaaatacatgattttattcttttttatggctgagtagtattccatagtgcatatataccacattttctttatgcactcattggttaatgggcatttagattggttccatatctttacaattgtgaattagtgactcattctaacaaaacgcagcctaagtgagcagtgtgtaagttctgaggccaaatcatgaaaggcatttcagcttcctccttgactcaggttgctcgctctggaggcaaccagctgccatgtcgtgaggagcctcaagcagaccagtggagtagagctgaggtggggaatgaggtttcctgccaatagccatgtgagttagctacgttgcaagtggatcattcagcccgtcattttcagatgacagcagccttatgagaagaccccagggcagaaccattcagctaagctgctcccaaattcctgacacacagaaaccccctgagataatgagtatttgttgttttgacccattactttggggaataattttttacacagcaataattgttatgcatgtaataaagcgaacattccatttctatggatttttctagcttttggaatgtcttgataatttcaatatgaagggcacccttcttgtttatcagctttgaaaacagggtgtagatagggtggccatgggtcccagtcttgtcctattgtacttatcaacggcagtccctttctctctcactagagtcctgatttgtaaacaaagtgcacagttatcctgtctgtagataaatgtttcttttgtgccgtgtcttcagggcaggagggatgggcaggcacacgtgcttggttgtacatcttgacttgattccttccatgaaggttggttggctgaatgagctcgctcgcggtgatagataccaagccacagctcccaaagcaaaactggctgaggccatgaagactcacaagattgtctgagtatccccactacacggttagccagtcacacagtgatctgatctggactgccgtttccggaagttgtaagacatttttcacctcctgccaaagtacctggggctctgctggtggctgtatcttgaatgcatccaagagaagatgtgatgaaaggtcatgcttgctctttctcttagagagaatcaccagaggaagcatagtggccccaccacccaggctggccactcaagtgtcaggtttctgttcctgcaaggatgcatggactcccagaaaccaggagggctggggtggatggaggctgggggaggactccaaggtgctctggggacaagtcttggcctccctatccaatctccagcaggtttcttcctagggagagaggccagacctactttacgataacgcaggaaaagccatcccaagacctacatgccttattgaaactccgtctttacctgatctctcttgtggcaaattaggccctttgcctcttattctgtgcccttaaaattggcaaataactagacactggtcccacttcatgtacttgaatatagttcccattttgtctctactgtttcaggcaaatcaaccccaatttctttaatgtaccccctgggtcctattctcactctttctaatcatgtttgttgctgtcctttggcacctctccagtttcttgatttctcttaaactgtggaggccaaatgtggctacagagttccaagaagggtctgcatgaagccaagggaagcagagcactggctgattgcgcctagtggggtctctctgcagctgagacttttaactcctttttggaggcctgacctagtttctactctgaggatgaagaagcgattctgggtctggggaggccagctgctctgagagcagggtggctgaccctgcacccatccgctcccaagccctgcatgtggtatgtgcagtccccctcctttaccatggttatttcagtctgcttcttagacctcaattttctccgctgcttcagtttctctcagttctgcatcctggtgagcacttttgtccagggctccattctccctagaattaactccttgatgagctcaggcagaagagacaactcagaagtaccagggcctgggatcaattgttgtttctcctacattaagctctggtctggactctaatgcagctttaattgtttagcagttaccaagcatttaaaattttcatctccatcagatcctgagccagcagcaccccactgctgcaagtcccccagcactcctgagtgaaggaattatcccaccgccttcctggatagaaactccagcattcctttccctaatatccctaagccatactcacaatgttccagctttctttgtcctaggctgagctgaaaaataaagaaccaatagttgaggaagcgtccccacaggttaaggacacagacacagatcctgccttcaaagacctcctggtcttatgatacagagaatggctttgagcctacctaaaataataacaacagggcctgtcctgcagccactctgtccaaggcctccaagatctcatcaaccctcattgagacagttaactactcctcctcttttgagaggaaatggtgcctttgagaagtggcttgcccatgaacacaaaactcaaaagtggtccacctgggattggaggctgggtctgtctgactccaaagatcttccatttcatcttctccctgccagtgctggtccaaaactcgagtcatcgttggccccttcctttctctctccctgaaccacacccatcaagtcctgtgcatgccacctcagaaatatccccctggctctgccctctccatacaatcccccagggtagataaccatggtgcctcccctcaaagacaggggtagggtcctgaggcttgttttgttgttattctagccactgctcctgcaaaggcacttttaaaatggaaatctgacaaaactttcatgggtcctcattgtcttcagaaatatattgaatctacttcatgagacatacaaggcaatttggggttggtcctgatatggtttggctgtgtccccacccaaatctcatcttgaattgtagctcccataatccccacatgtcatgggagggacccagtgggaggtaattgaatcatgggggtgggtttttcctatgctgttctcatgatagtgaataagtcacatgagatctgatggttttataaaaggcagttcccctgcacacactctcttgcctgctgccatgtaagacatgcctttgttcctcatataccttccaccatgactgtgaggcctccccagccatgtggaactgtgagtccattaaacctctttcctttataaattacccaatcttgggtatgtctttattagcagcatgagcacggactaatacagaccacagtcagcactcccaggctcctctctttcctgccacctgacacagcaccatcctccagtcacatggcaccacttgacttttgcaaaatgttgaacatgtcatggttttccatgtgcttctcccactgtctgaatgccctcctcttccactccgtagaggatctatccttcaaggtccagaatggcaccatttcctctgtgatgccttctctacctcttcaggcaaagtgaacatttcattttgtgctcccacagttctgtgtatccgctgatagcatgaggcttaatgcttggtggtataattattgctgggcaagcctgtctgccttgcgagacagggatccccttggaggtaaccccgtcttgctcactcttattgtccatgcctagctcagtgcctaggaaagagaaggcacaggaatttctggttaagtggataaatgaaccagtgtgtgcaaccacgttcccatctgggtctttaggaatttttctctctatatagtttcccaatccaggcttaaggacagggattccatgtaagtgtatttattgctgaggttcaagacaataagtggacaatatttcatttctctcacaaactatttttccaataacctccctaattattccagttaaggctcattaccattgcaaatcaagtttgaactgatattcacagagctagcaatctgtactgggacatgttttatttttgaaaatctttgatttttaactaagtctgttacttctggtactattttaaaatttaatagaaacaaaataaaactcttttaaggctctaaacaacctcaaactgtgttttgttctggtaatcagacaatacataaggactgtggttagttggagatattgccaacaatggaaaaaataaatatgagcctgagtcagaataatctgaaaccagaaatgtgtgttggtaataactcagaaagtcacatggaagagcctcggtcacaacaccagatttgatggtttttcaaaaattacaatctcatatattagagagccccttccacctggtagagtgccaagaattcttacaaaattgagtcttgagaaatcaaaatcctgcaccatcaggaaaatgctgtctctgttgggggtaagatatagacagtctggtgcatggaaaagtggcccccagtgatgaggacacaacattgtcattaaaggggagactgttaaatcaggtaaaagccattcctgcagcctgagccttttaggcacttttccagcagcagagcgggaactgcagcatcactctgggtgggggggttacggaataggattccatgtccaattccactgcactgaaataccagaagcatgacccaataatgtggttttgctattcaacaccagtgcttattcacctacccagggaggggagaaagtatcctgcttattcatccccaagcagaatgttgccctcaaccccatgctgggcttcctaatgacatcaggcttaaatctgccacttggtcctgatgaccagcagccgtgatctctgccctggaaaaagaagatgcaggcagcaatggtaccgtagagtgtctggtgtcacccttgtaccccaaatggtcctctagcatttaaattagccttagcagaactg

SEQ ID NO: 1217 - DNA, 183340 bp, Homo sapiens
tgatggacacagtggcatgatttgttttgttttgttttgttttgttttgagatggaatttcgctctcgttgcccaggctggagtgcaatggcgagatcttggctcactgcaacctccgcctcccaggttcaagctattctcctgtctcagcctcccaagtagctgggattacaggcatgtgccaccacgcctggctaattttgtatttttagtagagtcagagtttctccatgtttttcaggctggtctccaactcccgacctcaggtgatctgcccgcttcggcctcccaaagtgctgggattacaggcatgagccactgtgcccggccccagtgacatgattttttaatgtgcaaaggaaagaatagaatgttttagaaattggggaagaaatgagtttagataccagatagcactgactactccctgtggggtaggattggattttctttggaagctggaagaggtggagggagagaagagagtgactatagaagtagacgggtcatttatgatgggattatgtttcaaataccccttgcacaacgccattgaggagaatatttggcatccaagggcccttttcaatatgggagtgtttcctcttgggtaatatgatgctgatgtagcattagatgtttgcttttgtttgcagttagcttcacactccaccaaggtcagtcacagaaagagggggtttctgaaggagggtcaagcatgcagaggaacagtgactagggctccatggcactgggacagaaggcatcaggctgggaggcctgggggaagagcccagcctgctgcatcccatagtcctggtcagcccactgggctcccacagtggctgaggcgctgctgctgggtggtgaaactgagcacgtcctccatccctagtcaggaaggccacctgtgccctgtgcctcactcaggccccctctcctgtctggaagctgaaggagaagctaaagtgatagagaataaaggggcagaaaaagggggtgccagctctgtcctggttgggacagcaccttcaggagcccataaactctttcctcttctcttttattgtggaccactcagagggtttctcctcatgagacttcctctgactctggttttcttcttatttatcaattaaagaagaaagtgtttaaagcagataccaaatgtagtttttccactgctctgtccaacgtagttatcctgccaagaagcgatgaatgggccaggagtggtggttcacactgtaatcctggcactttgggaggctgaggcgggaggatctcttgagcttaagagttcaagaccagctagggcaacacagcaagactctgtctctacaaacatttttcaaaaaaattttaaaaagaagcaatgacattgctgaagatataatctaaattccgtagcccagtttgtaaaaattaaacatatcaacatttcttagagaaacattgcattatgattacttacagaatagtaagatcaggagtgaagatggctttgtcattcttagattttaaaagtcattctttgatttttttaaagtgagataaggaaaaaaaaaaagaaaatctaaccatgccaacatctggttttaaattagaagaaataattccacattttaaaatgtattttattggctttttaaaaaacgtacaaaagtcatacataattgccattacaatctaaacagcgtgaaatgtgtctcaatatgaggcccacggtccctgcttttcaccaggaatcacccgtacatctttttctctagaaattatcttagaatttaaaaactcaaacaatgatatacacaatacttgggaactttacattacagatagatagacatccatacacacacatttgcattacgcaactgctttgcattacagatagatgtccatacacacacatttgcattacgcaactgctttacattacagatagatagacttccatacacacacattcgcatatgcacactccaaccaaactactcctgcacacacacagaagcatgaacagtcactgcacacgcgcttcagggtggggccacttccgtgcagagaatatctaaggggctgggcacgctgttgtacccagagccatcttccctgacggacactcagtgtcttcactgccacactcccagccgctcagctcgagccacctggtgtgattcttctgccccagctccgtttcagtgtctgcaatggtggaattgccccggggaattctccaaattgaatcctgacatccaggccctaacccttacccgtgacgttgggctctggtgatgggtccagaaatcaggaagtttacaactcctgagggattctgaatgcagcgctgagggaggtccgtggccccgatgagccttctcggggtggggttcactgggagcggagcagctgtcagggtgagtgtagcagcaggctgttcttagtgaggcagcgggaacctcctcccttgttggggctaaccccagtgttcacaggcctccaggtttaccaggcaggactaagccttcatcccaagtgccttctccgaggaagcacagggcacctgagccctgccacctcccctctggcccgaggcctctgcctgcacttgctgccaacagcctcaagatgccggcctcccccagctctcctgctggcaggccacagaccacacacatgcctttcctctgaagaccctcgtggaggcgcccccaagcccccccagcagcaggatggagttgtagagtgtcctccattaggccctgggatggaaagaagattgtaatggatattcacgttacaatgtttcaacactctttcctgggggatagaaacgtcattggctctggctgattgtacgtgtttgcacgccctgaaggcctcattttaacttgatcacctcagtaaagacccgatctccaaagaaggtcccaatctgaggtattagagtctaggccttcaacataagaaacggagtgggtagattcaactggaaacactgattaacctactgtgttccaacaaatgaagaaaaccaaggctcttcttcactacccctggagagcatgactggggggaaggtgcagaaagctgcctctcaacagccccaccccccaccgcacccccactcccaccagcgtcacggccctgacctaacaccatgtacctctgtcctcggcctggcactgcccgtggtgcagatactcctggaaggcatcacacaggaaacaccattccctagatccagtctgcatctcaggtcactgacgaaggtaacatgggagcagcaacaacatgttccttagatcaaaatccacaaaatggtgaggtttgaaatgaaaagccacagaccgacggcaagcaagactaccttctctacccctccctgtcttcacaccttcgcaatgtggtcttgcagcttctcccaggaagcagcagagtctcttcccttgtgtctgagctgcccatagagcttggccagtagaacgtggcagaagcagtcatgtgggtacagcaggcccaagcccagtcttcaaggccttccatgcagttactctctctcagaacccagtactaccgggaaaacaagcccaggctggcctgcaggagggtgagaaactgtaagaaatacagctggatctgaccacttgttccattaatgtgagcaagcccaattctactcagccaacaacccaaccccgtggacagcacacctgcgtgaacccagccaagatcgacagggcccatcatgaccaccagataaccagccaggacgcagatgcacaggcaaaaagaactggcttttgtttcaggtttcggggtattttcttacgcagcaatagctaactgatacaccaagctccgacaattatgccgcctttgtacccattggaagaaagtatgtttggcagaagccagtgttagtatggaccagaagtcttcagggaaaagtgctgagacttatttcctgaggtgtctgagtgactgatcttctatgtgcatcttcagcactggggaagagtgaggggtctcaccgcaagagatgctatggaataccaatagcaataataataaaataataacaaatatttaacttattattattagaaaaaagataattattgtataattagatacattattactatttaacctaagtatttctgtgtttagtaataaaaggaaaggagcttataaatgccatattgtgattgtcattggtttgcaattttcttttcttctttttactaaaaacagtcaagtctcaaagtaagggaggacgacagaaacaagagtgcagtcatgaacaggatcttcgtgtaaaccgtgggctgacgtgatctggttactgcctaggcatttgaaggacgtgtttggcctgtggagggaaggacgctaatcctattagcaccgaggagctgagatgctcaggttcagttagaacttggccaaaggatcttgtggaaacacagggggctgggacaagtgttgccaaccactccggaggcacagttcttccagagccctctgatttctaaagttatactgagtccaaattcatagtgagttctacattttatataattcatttaatatttcttcttcaaaatatctttttcttgtgttttactatgtgaccttctcacattgtcggggtgctgtgagcactgggagacagtgcggtgcctcactacttttggcctataaatcatcttattgcggaggggccaagagcagggctggggaagagtaagtatatgaggcctgagcgctgtgcccctacggtgggtccgcagacctgctggaccttcctggggcttggttttctcaactgtaacctgcaaagagggactagagccacccataggcctccaagctggaaagttatttgacatcattgtgtctgtgttttaatgacactgtgttctcataatttgtataaagtaataaagaacgactctaatctttcagaaaagaatatgaactacaaaaattttgcacacaatcattgtaattttttccactaaagacaagtgttgatgcacaatacaatgctaccttctttgaaacctgactagtttcagctgtgtgtgagatgaggaaggaacaaaattacagactaaacagaatctttgtagggcacaaacacatccaattcttctctgtttcggttgtatggatggtggttttacatacaaggtaatgtgcccacttgcactgctttagtttaaagtttatgcaatttagaaaagggttatgacaaagtttggtccttttaatctaaaatgccatttgtttccacatgagaaagggccctggctcctttcattgtgaaagggcactgggcatgggagagcatgcagccgttagaagaaactctctctcagatcctttgctaagcactttgtttttatttttaatttaatttttattctctattgaaacgtctacttgatattcaaaatgacctaagtaatcagaacctctgtctgaaaggaaacaagtgctaactgtgaatggtctaaataatttacagcaacatttttctgtgaagggccagatggtaaatagtttaggctttgcagggcacacagtctctgttgcagtgacttaactctgccattgtgaaagcattcacagacgatctgcaaacaaataaaactttatttacaaaatgagtcagctggccagatttgatcttaggcagtagagagttttctgaccctggatgtaaacaaatgatgacaaaactgctttcctaaactttgacctcaaagttaagagtgctaagttcttgaagggctgcaaagtgaagtagtttgaggctggcggtttgttttgactcttccaatatttgttctcagggttactttgctgggacacctttaaactgaagggactccatatacatatttagatttccattttacctttaaaaattaggcaggtctggtccccaatactgtatggcaccaacccatgcgctggccactcagtgccaggagtcccttttaaggcagacacgtgtgctccagtttgcccctccctctccatccctccctgagacggacaggcagctgcgagttactgccaccatgttagatggccagtcttaaactcggtccactcgtgtgttttgcatctcagctcccactctggcctctatagcctggactcaaccacccctctttgttacctggagacattcatactgcaggatgagcgctgaaatccgtgcaccgctagaggaactgggaaacactagtcattttaaagaatgttgtttctttcttcacaatgaaaagagactcatttagcactgctctggtcttactgttcttaagcataccgtaagagtgaatccttttatatcagccattcttctttttttccatctgtttgaacttacagaagagggcccctaggtatctccatgtgatagactggaaaaaatctcactccctttcatgttacactggacacaattagaagtacgtagagatccccatttatcaagcgtgcaatgtactcaggacaagggaaattctgccggcagattctggagacttccaggcactgccgaacccccccttcaaggtaagtgtaagctccctgaggtgtgagctgaggcagacgcttgttaggcattggcagagaggaagggtggcaggtgttttaaggtccctcccaatgccaggctttatgtaaaaaatatttgcactttgaggaatggtttcaaataaatgaataagagagggagtgtgtgttgctatggaatgaggatgcccatacacagccaggcggttctactgcccctacctggggtctggggcttcaggacagccctagcagggcgcctgctgggagctctccctgggtacccacagactcgcgacaggctgggcaaagaaagccagagcccaagacaccatttcccccattcatccccctctccaaagtgtgcaaaagaggcaacgtcaagctaagctggctgtgaaggacactggaaccaaacaaagggcagctgaaggcccaggatccacataaggtgtgtgatgggaaagcagccacggatggggagcgccacacacacacacgtgtgcaaacatgcactcccacgcgcgcagtcctactgagaggtgacagcgtgctggcagtcctcagagccctcgcttgctctgggcacctcccctgcctgggctccgactttggcggcatttgaggagcccttcagctccccactgcactgtgggagcccctttctgggctggccaaggctggagcccactccctcagcttgcagggaggtgtggagggagaggcacgagcgggaaccggggctgcgtgcagcgcttgcgggccagctggagttccgggtgggcgtgggcttggcgggccccgcactcagagcagccggccagccctgctggccccgggcaatgagggacttagcacctgggccagtggctgcggagggtgtactgggtcccccagcagtgccggcccaccggggctgtgctcgatttcttgccgagccttagctgccttcctgcggggcagggctcgggacctgcagcccgccatgcctgagcctcccacccactccatgggctcctgtgcggcccgagcctccccaaggagcgccaccccctgctccacagcgcccagtcccatggaccacccaagggctgaggaatgcgagcgcacggcgcaggactggcaggcagctccacctgcgccccggtgcggggatccactaggtgaagccagctgggatcctgagtctggtggggatgtggagagtctttatgtctagctcagggattgtaaatacaccaatcagcaccctgtgtttagctcaaggtttgtgagtgcaccaatcgatactctgtatctagctgctctggtggggccttggagaacctgtgtgtggaaactctgtgtatctaactaatctgatggggacgtggagaacctttgtatctagctcagggattgtaaacgcaccaatcagcgccctgacaaaacaggccactcggctctaccaatcagcaggatgtcgctagggccagataagagaataaaagcaggctgccccagccagccgtggcaaccggctcaggtccccttccatgctgtggaagctttgttcttttgctttttgcaataaatcttactactgctcactcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctactgctcactctttgggtccactctgctttcatgagctgtaacactcaccgtgaagatctgcagcttcactcctgagcccagcgagaccacgagcccaccgggaagaacgaacaactccagaggctctgccttaagagctgtaacactcaccgcctaggtctgcagcttcaatcctgagccagcgagaccacgaacccaccagaaggaagaaactccgaacacatctgaacatcagaagtaacaaactccagacgcaccaccttaagagctgtacccactcaccgcgagggtatgcggcttcattcttgaagtcagtgagaccaagaacccaccaattccagacacactatgggctcacagcgtgtactcgcgcacacgcagtcaggtgtggatgtacacccgcgcacacccaggcacatgtacacccgcgcgctcacacaccccatccagctacagcagaattctggccaggctgttgaccgcacacctgctgcctccttggccaccctgtccacacagtagcccgatcgacccccgtggcggccgagacccaggcccatccgcagccctgagacctccctagggattgcacccagcagccagtcaccggcctccgcggcctggccagttgagggtggccgtgaccgcggggccaggagcgccgccacatctcggggcaaatggcgcgggggaagagtttcctcctcagcctccccgtctccgatcgctccgcaaactccagagcgaggcacgcgcctttaaaggcaggtccgcggctctcccacgtcctggcgcccggttttccgcacccagtgtccccacagctgtgcccgggcacagaggcgcggccagaccgcactccgcgggctgcaggtgtcccggcctctggcggcgccggtgcggcccggaggtgggagcccgcggagccactgcagtagctggagtcccgccgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgtgggcagctccatcttcccgcgtcctcctcctctggcgctgcccgctgtctcccgccttccctctgctccccgctcgcctccgcctcagcgccccgctgacctcgcctcctcccctctgctctttgtccctgcactctcccctcctcggtcctctgacccccccgccctcacctcctcccctcctctctcccctgcccgccccgcgctctcccaccgctcccgccgcccccgccgccgcggctgccactccgccccccgcgccgcacggagcttcagtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggtgagtcccgggcgctcccaccagcgcggaaaccgcgggtccggacagctggaggcgagtcccccgcggctcctctcccgcggaccccgccgtctcaccgcgatgtcgccgctgttttccgcaggcacctgcgtgcgccatgggacccgcagcggcagcgcctgggagcccgagcgtcccgcgtcctcctccacccgcggagcggccgggctggatggaaaagggcggtaagtccgtgaggtgggggcttctaatccttgccatttagcagctcgtaatctccgtgccgctggtttattaggtgctgtgaatgttcacgactctgtggaaccctacttttaagatgctgttgtgaactttttttttttttaactgtatgagcgagccccgatgagtggatttccaccaatatttacattttattccctggcaaaacggtttgccagagttattgatataacattaggaaaaaggtgaggaagttcattttattttattctaaagagcttaggaagaatctaaagctattaatgtatgcatcaaagccgtcataaagagcaaattactttcttttccgtccccttctacatcctcggatcctccttcccgtccccaacctttcctccttctcctcctttatagattaaaatattcctctatcgttgcttattctcagtgaaggagataaaagaagcgcttagcatctcaataccaaagttaatgctccaacaatcagggcgtacttcaaacataatagtgcctgaaatggctaatcagctgattgtgacaccatcagcaacgttcatatcctgggccacaatttgacatgagggcaagtcttattctttttcaatgcatgcttttacttctgccacttacaagtgacatttggaaatttgctgtcttatggaaagggatctctgtgtcttcatactgcatcaggtaaatgagaacgcaggtgtgtcgcactggttgctaggtggttttttaacctgaacccatccaatgacagttaataaatattattttgcattgttaccaacaataaattgccgtatcaaatgttaatattaattgacttttataggaagaactaggtttcattctctcaatgtatttccagaagatctagaaaattaaagttaacaattcagaatttctcagtatagttatttcaatttgataaaataacataaaggcaagcacttaatatatgcattaacttttgaaattattccctgccaaatgagtacacaaatagtatataaggtgaccggtgtcagattgacgctcaccatagtacctttttgagaaccaccagggggcgctaggtgcaaatgatataaaatgttaaaaaaaattgtcacagtgaatttacaagagaaagttaattatctgtccatttacagactatcctcttgtggttgtccttgtcctttttagggttttgcttacaatactaaaagttaattcttacaattttaaaggttaattctaattcacctttttaagtaagatttttgtaaaaaaaaaaaaaaaaattctagttccctaaaaccatgaaaattccagagggactcaggagatttccacaatagtttatggcatttatgaagttttatttaagataaaacacattatagacacagaagaaagaagaagaaaagccagggcttcgtgcctaagtgtgcttttctcctaaagtgattcaatctgcttcagcatcctctctgggagtggggtgccagtgtgctgctctgaacacctggcaccacagttgttgtcacaacgtatcgtctccatgacaaccacttatctggcttggtaagaacctgaaggggaagaggcaaacccttcttagtgaagttctagcccagtggacacagcacacaccctcctcccctaccttctatgcactttagctccttaattataaatggctaatgtgtgagtctggacatccacaacaagcttttatgccaccagagaaaagatcctcctcaacagtgttgcctgtttccctctgacctggagcagaagagctagaagacacttggtgactgctggggtcaacttactgttgcctgtctaggtatccattagacaagttggttctgaaataactaattgtagccatacattttgtttaaagtagcgcatgactcaaactattattgcaaatcattcttggtggctgaagtaattacaaaatagcaaagagaacaaagctggaggtgtcacacactacctacctgacttcaaactatgctacaaggctacagtaaccaaaaaagcatggtactggtaccaaaacagatatatagatcaatagaacagaacagagacctcagaaataacaccacgcatctacaaccacctgatctttggcacatctgacaaaaacaagcaatggggaaaggattccctatttaataaatggtgctgggaaagctggctagccatatgaagaaaaccgaaactggacccttccttacaccttatacagaatctaactcaaggtggattaactatttaaatgttaaaacctaaaaccaaaagcaattgcaacaaagccaaaactgacaaataagatctaattaaactaaagagcttctgcacagcaaaagaaactatcatcagagtgaacaggcaacctagagaatgagagaaaattgttgtaatctatccatctgacaatgggctaatatccagaatctacaagaaacttaaacaaatttagaagaaaaaaacaaacaaccccatcaaaaaatgggtgaagtatatgaacagacaattttcaaaagaagacatttatgcggccaacaaacatatgaaaaaaacctcatcatcattggtcattagagaaatgcaaatcaaaacaacaacgagataccatctcacgccatttagaatggcaatctttaaaaagtcagaaaacaacagattctggagaggatgtggagaaataggaacacttttacacagttggtgggagtgtaaattagttcaaccattgtggaagacagtgtggcgattcctcaaggatctagaacaagaaataccatttgacccagcaatcccattactgggtatatacccagagaattataaatcattctactattaagacacatgcacacatatgtttagtgaagcactattcacaatagcaaagacttggaaccaacccaaatgcccgtcaatgagagactggataaagaaaatgtggcacatatacaccatggaattctatgcagccataaaaaaagaatgagttcatgtcatttgcagggacatggatgaagctggaaaccatcgttctcagcaaactaacacaggaacagaaaaccaaacactgcatgttctcactcgtaagtgggagttgaacactgagaacatatgggcacagggaaaggaacatcacacaccgggcttgttggggggtgaggggcaaggggagggatagcattagaaatacctaatgtagatggcaggttgatgggtgcagcaaaccaccatgatacatgtatacctatgtaacaaacctgtacgttctacacatgtatcccagaacttaaattataacaaaaaaaaaatcaatggtcacatgctcactagcgaacataataacaatgcagagaatataaaatagaattgtgctagtttctcttcctacccccctctgcctttactatttgccttctgcattttgtccagataatctacaagaatttacttattgccctgtgttccttacaggctacactttttttcctttaaaaggtcactttggcttcagagcttacaacgtactttgaaagctcattatttgatcaactttgcctcatgtggtgaaataatattttagatttcattcttttagagtatatttttacaagctttaaggtattcctttctatagctttatggtaatttagttaccaattatccgttgttgattattgtttaaaattttacctcattacaaataatacttccatgaaaatatttacataaactttttaaaattcgtctgggattatttcctcagggtgatttcccaggtcaaagtattttgcaactcattgccaaagccgactttaggagggtagtgtcatttttatttcctgatatcagcagcgtttgaaagaggtggccggtggtggactgattttttgttaatgcgattgatttctatttagaaggctatacatctcctgccacctgtcccacccttctgtctctgttttctggattctccttccctgctatcctcttagggtgctcgtgaacattcctctgctcttagagagttacaggctctgtctttgagtctggagcaagctgcagtcaggtgccatctaagcagccaactgtggaaagagtgggaagggtggagcccgtgggagatgctcctgttgggtgggcgaggcatggagctctgtccgtctcccccagccttttggaattgagctctccgaaaacaactggggcctcacgggagccttgcagggcttcttggagttcagtttgcctgaacgcggagattatgagcctaccacttatatatatgagtttttagataggacaaacttttcctcttgcaagattattgtgtttgaagtctttcaaatacgtctttcccatttatggaaaaaatactgtattaataaagacaccaaatcactgtgagaataattaaaatacatacatttacagtgaaattaattatattaaaaacattgcaatactcaaagctcatcatttcataattatttcactatatttgataataatctaggctcttgaggccactggcctcttttgcatctgtatggtagaaatatcacacactgggggctgctgcgtatctctgtgcactgaatattcagtgatggcacagcagtcattgaaatcagccatgaggggaagatttacaccagggaaattggcaaatgccaaaatccaggtcgttcttctccagacagcgggttgttgaatgtttattaccacagcattgtgtttatgtaaacatggcttaccagtagttattttgcatgataaatattatatgtgcccccagtaaaggacgaatattttctctcttcaaaataaaggtcataagaatatgacttatttcatctgagaataatttgatttcttaaagagtaatcacctttttatacacaataaaatgtgctaaccttccactgtttggaacaagccatcctgctttctgtcatccttcccctgactcagctacagtggtaggagctggtgggaggtgaggagcatgcccctgagtggctgggagggcagatgacagctgttaacatcaccgcatcactgttggagaatttcctggcttggtaatagcacattatggggcccttgttacaatttttttctttaaactgtgatgttccatattgcacactttgaattcagtatgggtaggtgttgcatttttcttcatcatttttgactgggtggaaaggtcatgtggtaaaataatattatatcttaagacttcctgattcttctcggaattccgaaatgactcagcctctgctcactcttttgatttcagaatatgacctggtctctgcctacgaggttgaccacaggggcgattacgtgtcccatgaaatcatgcaccatcagcggcggagaagagcagtgcccgtgtccgaggttgagtctcttcaccttcggctgaaaggctccaggcacgacttccacatggatctgaggacttccagcagcctagtggctcctggctttattgtgcagacgttgggaaagacaggcactaagtctgtgcagactttaccgccagaggacttctgtttctatcaaggctctttgcgatcacacagaaactcctcagtggccctttcaacctgccaaggcttggtgagtacagcgcaagccccaggtagggaggcgaggttggtgatggtggaaaggagagcgtaaccaggactttccctcgatttcgcatagatgttcttctagtactgcagcgcagattaagcaggaggaatattgccaagtaaaacttttccaaaaaacattgcgtgcctcctctggcctatttggaaacagtgtgcacacccaccctgctgctgctgttctagaattattgtggacgagcacttcagcttgaaacttgtgtataagaaccgctggccaaatctgaattctttagcttcttaggggatgtttttactctaacttacagcttctaactgacagaaactggagaaatgtcttcattttgaataaaacaacacaattcaagagattggccatgaggattatttgatcagatatttgaaagactttgaatactgtacatctttcattctgatgatgataatctgcttacacattagggcattcatccatggcagggcgttgctggtcttcctggactgatgaatccaggggtgcattccccatgtcctgcatatcgggtttggaatggcacatcacttcaatgcttctggtgctgcagtttacagggacgctagagccgggggcttatggccgagctaagaatctacctgcatccctcaggcctacccaagtcaaaatctcaatggcttgctttttacttaaaatattttcatatatttagggagaaaaatctttggagattcttagattcttggcagcaaatgaattgctcaggtgcagaggagcgaagtgtgacttagacagcagagtgaaaatgtgtggtcaacagttcaaggtcttgaggatgttaaaggtttggccaacaggtctgggacgtttattgcttctctagaaaaagctttcagtgtgtcttaaatttcattccctctttgaggagagggaattcagaccccacatctcataaagattttgtgtgtgtgaattttggatgctgaattcataaccaatttcttaaaatactaaatatatgcaaatgctaaatcctgtaaaaaaatttttttagatgttaacattctgctttttagagaaatttgatatgagttgatctcattgctatttcacttgtaagaagtttttgggttgagttgccagggatagggtggtggttatttggcgctcttgttaagcatgaagacaatggggctgatttcttccacactctcccaagaaaaataagtcttccttaacggactagaactcttcatgaaatgcacaaaatgaagatacatcttccttggttttctttcacaagggcttaagccagaaatggaagccatctgtgtggcagcgaggtgtgccttgccctttacacttgggtaattttggatttggttgtggaaattggtgaggtgcttcttgctaacccagcaaggatgcaagctccctgaggcccctgggtttccctgagccagggaggctgagctgtgccctggaatctgttccctgaatcgaggtggtttgcagtagcttgaaatttctggctctttttgagcttgatcagagttaacaggaaaagttaacagtaaagtaagtgtataattataatgaaagataaagaaattataaataacagaaaaaaatgcttctctggataataacagtggtatctgatactgtagctgttggaagagaaatttatatgtcttcttcattaatcttccaaatacttgtagtccagctttactgatattttgtccatagatggtcactacaaatgagacctcaaccagacttaagagtgtgaggcttagtgttttcgtcataagacaggacaaatcaaaggcatttgaaagagccctgttcttatttaggtatctttgcagagcccaggggcgatcactttgaaaagaagatctcttctagcaggaaatgctctatattccattctatctgtttaatttgtaggataagaatattactttcaagtgtaaaaatatattgcttaattattacataatatcttgtatcatttaattagagaaaatggtttacagttgtgaaacaatgcaatttccaaactggtacatagtttttcaccctggttctgagattctgcatttggaaggattttgctgttgtccactaatgattggtttgaggaatagtgtgaaagtgaatcattgaggtgttgtcctatttatagtaaacaaatattcataaagaagaaaggaaaaactaaacaaacataatacattaaatctcatgttcacagtgacaatttgagtactgaatgaccttgagaactatgtatggctgcagcctagcagacctgggccccaggagtttattgtctaatgagagaggcaggacacaggcaagtcccttacgggggaggaaacggggacaggcatgggagccagaaggacccagaggaggatgcctctgcgtgccttgctggtaggtggagagtgtcagggtaggattttagagactgtccagaaaccaagtccaagccctgtcctcatagtaaagttagaacgtgatgcccataagtgaaggagtaacaagcagtcctggagaagactgctggcatctgccaagctcacagatcttgtaacactacctataaatgttaagagcttaacatttgcatattaaacccaagtataatatattcaatgggatctgtaaaccctaaaattatttctagagtttaccctggtattgccaccaagtatcttgacttaaaatatttcttattcagttaagtaagggtaatttttggaaaaagggtccctgttatatttatgtctctaccaaattgtcattagagatctgtttgtggtcaccaaacacaagcacataaatgtgtgtcactcaggtactttccagtacttggttaaataatggatagacttagagggctagttataagtaagagacaatgatgaccatggcaatagcacaaagaacaataatgacttactgaatgttatactttgctaatagctttacaattgttatctcacttagcttgaagataagtcgaagaaataggtactatttttaaaacagctttattgagatgtaactcactctttaaagagttaattagctctattcatttaatagagtttcaccctttacaatgtatcattcagtagtttttagtatattaacagaattgtgcaaatttcactagaatctaataggagacatttatatcacctcaaaaataaacccttatgggcagttctcacttcccctaatttccccattcccatcctaggtagtataggtttgcctaatctggccattgattataaacagaagcatacactatgtggcctttgtgactgactcatttcacttagcataatgtgttcaagattcatccacgttgcagcacataccagtactttatccttttttattgctgaagtataccacatattttatttacctgtttatcagttgatggacattattgttttactttttttggctactgcgaataatgctgctatgaacatttgtgtacaggtttttgtatgaacatgtgtcttcatttctcttgggtaaatacctaggagtgtaatttctgggacatatggaaactctacacttaacgttttgaggaattttcaaaccatttttcatattagctgtaccattttatattaccctagtaatgtctgaagtttcctatttctccacattcttgccaaatcttgttattgttctctctttttaaatagccatcccagtgagtacgaagtagtatcctttgtggttctgatttactgggtagagattattggcttgtgaagtgggttcactgtgcagaggttagcaacttgtctgagtttggtgagacagcaacccccacacacaagttacatgaagtggctttattacttagagataggtagggcagcaagggacagctgaagcctaggaatcatcacgggccggtgcacaaggctcaatacagcagcctgagtggatgaagtcttgtctgtgcatgcaacatggctggggcacccagaaaagcagcccaccctgggttttatacccgggcacatgacgtgctggacaagttctgcagttcaatcatcacaacaagttctacacttcagtcatcacgtcataccacaaggcagggactgcaacagagtccaggttgtttctgccctttcctccctatctcatgatgttgcatttccagcacattttgcagtcattcttgagaacggcaaggaagaaaatggggaggactcagttggtccatagtcatccgtagaattgttctgcataggttgacagttttttgttgttttactttcagcactttcaatatgtcatcctactgctttctgacttccattgtttctggtgagaagtcaactgtttatctcactgtggtgtattatgcacattgcattatgcatatgttagtatgtatattttggtatccattatgcatatgttgatatgtttaatgatgtcccacatttctctgaggctccattcattttttcttcattcatttttctctgtcttcttcgtttatcttcaagttcactgattttttcctggcagttcaaatatattattaagccccctcataaattttacattgtgtgtactgtacttttcaattccaaaatttttatttctttcttttaaaaatgtaccttcattcaaattctctgtgcaacactgccatcatggcttcctttatttcttttctcttatttatttatttatttatttatttatttatttatttattgagctggagtctcaccctgttgcccaggctggagtgcaattgcacaatctcagctcactgcaacctccgcctctcaggttcaagtgattctcctgcctcagcctcccgagtacctgggattgcaggtgcacaccaccatgcccagcaaattttttgtgtctttagtagagatggggtttcaccatgttggccaggctggtcttgaactcctgaccttgtgatccacccgcctcagcctcccaaagtgctggaaccacaggtgtgaaccactgtacctggcccatttttatttttaatgtatttttatcatatatatttaaggtgaaaacatgatgtttatacacacacacacgcacacacacacacaatgagaagattactacagccaagcaaatttatccattatttcccatagttccctttgtgtgtgtgtgtgtgtgtgtgtgtgtgtgtgtgtgtgtgtgtgtgtatgtgtgtggggggtaagagcacctaaaatctactctttaatcaaattttcagtatacaatacagtattattaagtatagtcttcctgctgtacattaggtctttatacttattcatcctatgtaacagtaagcttgtattctttgacctacttctccccattttttcctcctttctgccactgggaaggagtgttctaatcaatactctacttgctacttctatgtattcaacttcttttttagattccacgtgtaagtgagaccatatagtatttgtctttctgtgtctggcttatttcacttagcatattgtcttccagggtcatccttgctgtcataaatggttcttcctagttgctcacaaccaaaatctttattatttttgacaatgcccttaggcatgaaattcccacattctgctccaaataatttcaggccctggaggcaagctccttgttcatgcagcctgtctcttctcctgggcaaaacctccaagacaccgaattgcagatgggactgctagaatggcttgcttctcccactgtgacacccttactctatgagcagagctccggtggggatggtaaccccttgtcttccctggttgtgcttcctgtcttgaaactttaacctacaagtgagatggagtggaggtattcagggtttcattgctgtcggcctgataagcctggagagtagtgtccattctatgtgtaggggctgcttggcagaagacaaacaagttctgttggccatgcctgcctggaacagagcttctgcaatatggaactgaaggaatttcagatgcaagtggcttgcctcccctgtagtgcaaatggagtctcagaatagaagttggctgggggtaaggaaatagggattccttatcttcttggctacacatgcctggagaagaacctctgttgcatttagctggggccaaggtaaagacttaagcaaaccatggctcaaacactaccaaatttcactgttctgttcaaggtttattaaaatgtttttcagtaattgtttctccatattttatgcacttaagataatttccaaggactttaaatggttgaagcctgtgtgtgtgcatgcatgtgtgtaattttcagcaataagtggttctttcactggggtgaaatcccacattgctcctcaaattgccattctggaagtctgtcttcaatagacactattattaacatattttacagattatgatccaagaccactttattatccccattttacagatgatcccaaagctaattcttcaaaacatgggaatccagaactagcacttgaaaccacagtactatttcacttcccttaatcatggagctgttgctgccttacagggacctgtgagctcatgcacatgaatttgcattgtgtcacctgaactttctctaaggggtaatgactttctcattggtttccacttcagtgccatcttcctcagcatctaatgctgtttgagcttagtgaccacatttgcagtttgtaatgttaaatttgcagtgtgtaaatattaaagcacatatgtgtactttattccataattatttatttacaggttttttaataccagactatgaactcttcaagagtcgtttatcattcatctttgtatcccaaagttcttgttaaacattaacctaaattcattttgttcttgtaatgagtgattgtatttccaatttacaaacagaaatcctatatcttctcaacctctatttttgggtattaataaaggtaaaattagttttataatccacttcatctgatttcttgctatgactaatgtcaaacactgtaaattttcttttgaagtgtatagtttattaataaatcgttcaatcactagggtttttaacaaaactattttttagaaactccattagtcaatatttttaagtgagggttgtttaaaaatgttttctgttgcatatgatgggaatagatttttcttaggattttctgaaagttctgtacttggattagaaaaaaatatatataatctgtcgactgccattggcataaaatctgcatgaaatttaattcgtcttgcataaaacatgatgtttgtcaaggcattaatgcacaggataggtatcatttttcctaaagtctaattattgttttcaaaaatgttggaatacttgtaaatgttgtaattctcagttctgtctatactctcacttgatttgacacttattcagggccctggtttgaattgtactgggttttatttctacccacaaactccagggattccctggaaattctagtcattgagagatttttctaaaacactcaataaatcctaggaaactgtctgaaatgctgccagattttcaactgactttaaaaaatgttcttgagccagtataataaaataggaatagagaggaagaacccacatgggggtatgatcagaagagatactatgatttttgaaagaaaggtgtcactatctgagaagactgctgatggcataagcagatgaaaatgtcagtcttgggaggcatgtgagacagctattaggtttttggataaagaacggccaaagctggtggtgactaggaaatttaaggtggttgtgaagaactaattgaaagtgtagataatttcttacttttctgctaattacataagaataaatataatagtgcaatttggaaattaacagaaatgaatatatttcattagatcaaataatattttataaggtaatctttcaagtttgaagtgataacagatttttctattaatttactgttagttgtaaacaaaaattagatgactagagaaatttagctataaaatctatggttttgttccacttctctcatttttgaagtgatgaaactgagatccaagtggagtggagtcacttgggcaatatcacaaagtcgggtggaattcagacaggtctagggtgcgtgtcttcagattctctgtccagcgatgttttcaccaagaatcacttgatgatattacttcatcatcatgaaatagggatcaggtggcatagcagaagtgagatttgtagagttccatcctcagcctcacaaagcagagtttaaaaggatagtttggagttaagagatgacttcttagtaatgctcagacctgaaacttgattccctgggtgtaacagaagatgatccctgtggccactaactctcggggatgatacaggcctgggactgtctgaatgacaggatgtctgaaatctacttttaaagagagtgcttgctatctacttttaaagagagtgcttgctcaagcaaaagtccagtacaaagagagtaaaagagtccaaatgaaaccaagctcttgaaggcaggatcttgctttgcctgaggtttaacgagagcagcctgattgtatctgcttaacatggatatgacctttttttcctccttaaatgttaccttttaagaaggaagtccactgggtctagacaggaagcccactgggacagacaggaagtccacaaggaacagataggaagtctgttaagggcttccttggcccacccatctaaactcgcccagtccctgtttcattcctatccctgtttcccacttcctatccctattttatttttctgtttggcatttattattaactgtatcaatcacagtctagtcaggagacagaaaccacacaaattatttgaagagagagaattaatacaatgcattatgtaggcatttgagtactgaaaaattaaacagagaatatcaaagcaccctagacaacaactacaagaatatactgcccctggggctgaagaaactaaggggagagtttgggattttcaaaattcagacgtttggagctgggcctcaaatcccttagtagtaggagctagctggtgctaggactctgagggagaacagtgtagctggttctttaagtaagctacaaactagaatcagcggctgcaactggaatgatctgccacagcaagggtgaagtgagaatgacaggaacaggaggcaggaagcccactggggacaaacaggaagtccacccctgggaaaaacaggaagtgagggaacagacagaaagtccacaggagctgacaagaagtccacaggggacagacaggaagtgagggagccaacagaaagtccacaggggttagacaggaagcccactgggatggacaggaggtccacagggaacagacagaaagtgaggaggcagataggaagtccactggggctaaacaggaagcccaatgggacagacaagaagtccacaaggaacagacaggaagtgaggcgtagacagtccgcaggggctagacaggaaagagcaggttcttccaccttccttagactgtccgcattgtgtgggctgttggtggatgtgaatagagagcaggtggcaaagcagaaatgggatttgtatagttccaggttcacatcaggaaacagagtttaaagggagaactttgagttgagaggcgatttctttgtataatcaagctgcctactaccctaagtattgagagaataactaccagggatgtttgactttttcttgctttatccccaacactttcaatagtgcctggcatatagtaaagccctcaataaaaatatgtgcaaagaatgaatgatttttgcaatggaggaacaagacttctgttgccttacaaaaatcatctgcacaaacaccaatttggatgggggaaaagagatcccaaaaactgaagtaggaatattccagccttatatagggaaaggaatgggctaactaaaccttgctaggccttgtgacaggcttattcttgtatggggctggaactgtcagacacaatgtgtccggacattcctcccccatggtaggctgcacttgaccttttactgctttgattaaaattaagcctcctatgtagcttgccaggagggagaaggaacagtttcctcagtaggcttgggggttgtatttcatgactcatacaggtataaattagcactcaggggcttgtgtgtgtgtctattttcagtctaagtttggctactctaaatcacttctgaaggagaagttagggtatatcttctagaggcctgaggccagactctgtatcaaagggaatttacacactcagtggagttctgtccttcgtgattgtggacaacagctgttctcagtaatcccctaccaactctcaagtgccatgagccgcagcagtgaatcagaaactcctagttgcacttgctctcctgttgatcctccatccccagtgattccaggcatggatcatttttactgactttgattccttttaaaataataacatccatcatttgtcattagttgaatgtatttttcactacttaagagtttaactttttttttttttaggaagaacagcatgtgtttaaaatcaagtaaatcagcattttaaattagtagcaaaatcagtgctaattttgtatcttctataatttcacagaaatatatagaaactaaatatataaaaactaaattaaaataatttatttgaaaaatgtctacctaaaaataggttgaatttctattttttcttcatatttaattgataacaaatggaaataccaaataagggatgtactggcattatgtaaaatcttagcagttttgtagcaaaaataagcctctctgggataaaacttaaaaaaaaatcatatgctgatcactccctagctttatatatatgattaaatggctggttgcctttagtttaaatatggtaataaaataatagaaagcttcaatagtagtgacatgatgcatctggtggctctaattttctgtcactgaataggtatttgtacagcccttaagacattagaaattggactcaaaacatgtcaagtgaaatgtgtcttaagcagttggtgatttcttttagtatccaaaatccgtgagaagtaattgtctcaataaccctagggtcctttattcttttatcataatttaaatctgtatgagtcttttcttcttaggtgaaaaaaagcaagagcttttccttcaatgtgttaaacccctctttacgtccacagttgttgagaactttttcaaagaatgttatttttgattgagctttcctccacataaggcacttcaagttgtgccctgtggaacttccagcaaaagtgggcaaggggcctgcaccaactttttgtaagttccaaaataaagaaattccccgtcccctcagggttttagcggatgctgttgcctctgcctgcaaaacgactcccatcccattccttctggttaaatgtcactttgttctttaggtctcagttgaaaagtcattcccataagtaatatcacactgtttcactgttgctccaagccagggcaggcttccttcttatgcatccatactacaccttatttttctctttatgaagacttatctcaattaaattcttatttgggttaccagtttagcatttacccctccctctcaatagacaaagagcattttaaagggcagcaccatgattgttacgattcctacagtaccaccactgcctggcagcgttcccaacccatgaaaggaactggatggatgggtgggaagatgggtgcatggttggatgaataagttgatggatgggtaaatggatggaagaaagatgctagttctatctgtactggaaagagtctctgtatctacagagggagtgcattgactgcaaaaggcccaatctaaaactggacctaagttgcatttgggaagcatacactccccaatcagccatcatgcaggtccaaggagtgtctctgaggccctgggagcatatctgaaaagcagggaagcaaatggggcaagtgctgttcacatgtgggtgatctcaggaaaggccaattggaggtgagcacttttcagtcctaaccatgtgagtcacttttctagttacagataaagaaaatctctacacaaattctaaataataaatgttgcaatacactttaagtaacatgatatgatgtaatttatatgaagtacaactcaagcaactaagtggcatttgtccagctcttagccttttgtatctaccgcttaagcatagagaagttgtaatttctgtgcttcagtctcttaggcatgtcttatttaattaccaaacttactccaaggagagattgcctatcgtgtattaagattctcatgaataggcactttcaccaccctgcatcctccacaaaaagtgatacagtgaccatctatactgacacccaaagccgaaaggctggcgcttctcgtaaaatcagaaacatgctcaacatttaccttgtttggttagttaagataaaccagataataatcaatgtcttttatcaaaatccagaaccaagtgagtcaacaagcacttcagagaacctacaattgaaggactgtggaagtcattctgcaaaataaatcagcaggaaaacatgaactctacatgagaagaaagatattgacttagacaaacattcaaacgagaagcagaataaaaatgcttcttaagtaaatggaaaatatgatggaaaaacatggctttttgagtcagacaggtcttgatcaagtgtgatttatcttactaaccagctagctcactaccctgggcttcagctttcttaattcacaattaacactgtggcctcctagggctgagtgagttttgagtaacaacatatgaaagcccttaatacagggcttggcacaaagtaagaactgaacaagtatttgttctcctcagtccccgccgcccccactcattattgaactgtgtaatacaaataaaatctaatcagaaaatcagtgcacattttgtaatgcaagccagttcaaacagagttaaggaaccaagaggtgaagttatactgaccttcagagaagtcccacagatgggatggcaataggattagaatgtattttattacattagaaccttcagagtgacttatgaaagcaattaggatgataaaaagacatatcatttgagcaagctatttaaaatgtgagagtgttctgcaatgtttagagccattgctgacgcgcacattttgaaagaaagttgtctattcccaacaccgggagatcacttgtgcttaacaagttatcataaacaagggaagtgcccagaataaccagcattttgatttgtattcaccctgaggcagtcaaaggagccataaaccttgtttttatttgcagagatgacctaactgaagatgggggagttgttactattccctttgcaggttatcattaggtaataaataaagaatgatggattgcagctactaagccaaaaagaagctaggatcttttatagcacatgtctagctgaaatgtacaagtatgtgtagaagacttgggtgagtaaatattgaatgtttaagaataaagggctgtgcagaataggcagaccataagtaaaagcaaaagtcattatctgttccttaagaaggccccaaatttaatgtagccttatcttcaccattcagcaccattgttctgaatttctagtgttgctttgacatgtaacataattatatgtttactactttaaaactttcttggatctaatgtcaatcctaattatctattctgccttcagtagttcagtatattgtccattgggaaatagtggtgggctcatgcagtctagttaaatcccactgactcccagtactttgaagtttgctgtgattaccccatgaaaagttagagcaatacctcctctactagatgaagaaccagagctacttcgtttataaaaatgtagaagaattatctatgcccacgtatttgaaatagacccaagtctaaagtcttgaaatacctgcaactgcaaccccaggctgtggtgggtgcaaaatctttatgggataaataatttcctctgaatttggtttctcaaatactgactgggtcatgcacaagtttacatttacttaaactagtgaaagtgcacctgatcttgtcttaaaactttacaaacttaaaaatataccaaaaaaaaaaaaaaaccagctttacttgacctcaggcctaagttacatgtgtgcaccattggctgagaactggcaaacccagcttttagtcccaccagagaggacaagtgccctgggagccctgtgcctttatgtgtatacaaaaaacacagtgttcgatagatttgggcacatttgtcttaaagtgttaactatcttagaataatttgctaatctcacagattgcaatttaaatgtaaaaatatcttaaaagcccataccttagtaatcacattattgagtgtcagctttcagttacatatacactagtttattacctatatttttgtatgcacatggcattatctatactatgataaaatcaagagttatctgttctatccaacagacatatgcaactatgaaggccaagcatattaagtacgttttgacattgtatcacattccattgtacagtttgcagattcatcctgttatttggcaattattcacagtttagatttcaccttcatcttctgcactctaaaatggattagagttggatactttcaagaggtcatttttgtttgatcttgatttcaaagtcaacaacaaccaacttctttctccagtttccacctttcatccaccctttgtcaatggtgtggctgactccaggctctgtcatgggataaggggacataacacagctgtcctagatacaatgcacatatgggtgaaactgtagagtcgataagtataatggacagttaattatcatgttgggcaaaatatcagtagatacgtagatgtgtcagaagagtctggttgctgttgccaccatgtgtggttggatgctgtggataatttcttttgtgatgagctaaatttccaaatttccatactgtcttaattcaccttccattcacaggtcctttccactatttttctcttcacattaataccattcttgtagcccacattcacagcccttacctagaagagtagcttctgatgcactcaataatatattttctatcataggaagagcagacacattctttgacctgcttcatttatgtgggtcttcagaaatggttcttctgctccctgtaactagataatggctggggcaggggacagggactgtgaaagttttatgcaaagggcattatttatcttactgttctttttcaacacacatatcccttttctccaactcccaaaccaaagcttgggagaaaaacgttttctcatctttagtgtaccccagtaccaaggcatacttgtaatctaatttccatacttggttgttatggagcaagcctatggtgaattctgctttattacgatagacgtatgcatgttaaagtatgtgccagtgatataatttgaatagtttccaataaaatctgaaaatgtacccattataagtcgggaaaataattgatattgaaacaagcacctactgtatgccaggcatttaaaaaattattttaggcagattcattacaggagctactattgcatttaattatattaacattatgagaaacatttttattcctattttatttaagggaaatctgccaatcagacccattatctaacctgccaaaagttgacatctaacaagggtgagagcccggaaaccacagcatggctatgggatctcagtgtaaaggctgagcatttgaccaggcatccgttatctcctcccaggaacattcccatgagcatccttggagtctaattgattgtttgggcaacattgggtattggagggaaaagaggaacttagatgtacaaagtctgtgcttttaatcactttggtgcatgcacggggaacagctctgcaattctgtatgaccttgctgagaaagccaggattcctacagagaattctggagggcttctttaactttcatagctctggtggctatcagctcccatgattatatgattgagtgatgaaagaccagagagagagagaaaaagagagagagaggagaagagaagagaagagaggagaggagaggagaggagaggagaggaagagagaatatggtagacagacagaaaaacacatacatttaaagcatttttagatcaaaaactaattgaaagaagcctacagagatttccagtcctagagagtggatggtctccttagttcagcttgattcacagctatctggaattctgcatttattgtggacataacagcaatagttccaacagcattatttccatttaatgtggccaagccaaaaatgctcgtggagaatttacaggaaggtgacttcagggagcttcgtggtaacagccaccactgcctgaccaaaaagggtgagggtctcacctgcaaattgctgagagaataggtattggggcatttttatttatttattcacttattttgtggagaaaaatatgtaacttgccaggaaccatccttgtcaatgagtgacaagcatacacactgctatacagtgattttagaaaattctttttagaaaccttttgttttgctaaattattttattgggtaacctgagcataaataacttcactgcctgctttggtttggctgtgtccccacccaagtctcatctgaattgtggttaccgcatcatctgaagattatacaatttgagctagcatcctgaaagatcattcataacttttctaatccccacaggattctgacatgtatgagagtatatgcagtcatatatacaactggggctggaatttatgaatggtcaaatttggtagccacagcaacagatgtttaaggtaatggcctggggtgttacatgtgtaagggaagtcatgtagaatatgagtattggtacaaattatcatcctcaggccctacagtgcaaaagccatgatgaggccatgtctttagtctgtgtcagtgaacttaatggatggttgttgtactcagtattgctttcgatatttatctatttgccatcagaaaattttggtgtctaaggtcaacttgcttgagagtaaggaaatgtcagtaataacaaactccacttaaagtcagatggtgtcctagcagtcctttggatatgtggtggacaccccacaacaccatgctttcctgcagaggccatgtcctgctccctgactgcagggctgaggagaaaaacaaacacaacaaacagagcacagggtgaacaggaactagccctttgtgatccatgtggtgtatcccagtgttgagtttgtgaatcttactaaacatgtcctttatcacaccccacccacaccggctgaggcagaatatttggggaaggaagatcttctgagatgattcccacagacaagagttctgagtatcatgggtagatatgcagaaggcggcaaactccataggtaaccttcaacctatcagtcccgttttcagcgcagatacattcagttcctgttgtatgcccgcagctgggaacccacaagtgaaaatatctctgaccttccatttcgggctgccctgtgcagtggcagtgtggaggaggcaggaaacaactggtctcaaatcatagctgcctttagagtgacgttgctgaaagggaaacaaagactcttgtccacaatcttgctgtgttctgcataagtcaaggggagcgagtttggcacatgacgccttcctggcactggctgcagtctctcagctttcttagttgcctctgtgttcttttgtaaggaatctagcccttcagtcagccttctgagtctttgtgctgcactgttagactgattctcttccaagggcactctctctgaatgacaacagcacaatgccctgggcaccaaggaagcaccacggtgtggaggaagtgtctggagtaggagcccgccagccctgggctcaccgtgtcctggtcaccctccagggcttcagctttgttctgttttctttttcctttttttcttttttcttgagacagagtctcactctgtcacccaggctggagtgcagtggcacgatctcagctcactgcaagctccacctcccaggttcacaccattctcctgcctcagcctcccgagtagctgggactacaggcgcccgccaccacgcccggctaattttttgtatttttagtagagacggggttttgccatgttagtcaggatggtctcgatctcctgacctcatgacccaccctccttggcctagctttgttctgttttctaaatgctttattgaggtatgatttacataactacccctcaccacttgaagtgcacagttcagtaattttttagtaaatgtggagttgtgcaaccttcttcacagttcagtcttagattatttccagcacccagaaagcactcacataccccttagcagtcactccagccccaccccagccccagcaaccactcctctgcttcccacctccagtgccttttttggccatttcatagaaatggaatcacacaacactgggtcctctgctccggcttcttttgccaagtataatgtgtttggattcatccatgttgtgtctatcagtacttccctcctttccattgctcagcggcgccccatcgtatcccactgtgtttatccattcaccagttaatggacatttggattgaccgagcttcaatgtgttatctacacaaatgcagctgctaatccctaccttgcaaatctgttccaaggattatggataatataataatatggtataaaatacctgggacagaggcagaggtgtagtaggtggttaataagtgaatgctatccatgttggtatgactaagagaagaactattaatattgtgtaactttcctggaagctgaaccctaaagagcatcgttgtgagagactggatatcaacagcaaaaccggtaggagaagtaccactagtgtcagaattaaatagagaaaacagctgattcatgagctaagtgccaacttgatgagctcagcatagaatttgcctcaggctggcagcctgctgtggccagagggaatggagccatggggccgcacactgggatggagtgagtgtgagtgcaaaaacatgggtgagttcagcaatggcttataggtccaggtgacaacccctcatgacccatgggctctgatgagaaacacatgtgcgtgcctggctttctctcaccccgcctgccagtgtggccgcctcctctgcccttactcaggcaatagctatcctgaatcatctgcgactccctcgcactgtccttagcctttcggtcattttcaacagcacagagtcctgcacccactttatctcctgtcttccacaggtccccatgcactgcctttattctttaaaaatatgtcctgtaaacttgattgataactctaaaatatctctttttttgccatctttgaagtttatttaatctacagtcatcctgtgaaatagttatggatttatcctctaattgggaacatggaaactgggtatctggacatacagttactctctccccctgccccactcaccatcacacacacacacacacacaaacacacatacatacacacacacacacatgcacacacacggagctcatgccctgaagacaggcagagtcagaacttgcaccagctctctgacctcagaagccaccactggctatccgatgaccactgtgtgtgctacagacctgggtctaatatgagctgcacctttaagagcaacatggcatggctggagggtcttgagctcccagagagcctgggggaaaccaacactggccagggggtgcaggctcctgggaaggcttcctgcgggagtcctgggctgtattcccagagacaacgctgcaaagttgtcagtagagggtgatctggtttataaatcagtagagaaaaaaattataagggattccagagtgatagtagccagatgacaagtgtagctctctgaggaagaagatggcaatgtctcagatagcacagaaaatcccaaaactttgagctgtcccttccataggatgagctaaaagataatttccaagacagtgtttccagttggaaaataaggccctgctgaactattattattaattggtgaaagtatcatatgtgaatattttgcaaagaacacacatgtcagtggctgccacgtggaactgcaggtccttactgcatctcttccctccgctgggcccacggccttccctcctgtatgctcacagccagctgctcgcttcatcaaagccgtcactgaaataataaccctatttaatgatgaccctacctgatgaccctatgtaaaagtcaaaccctttttcctgcactctgacatctgttttcatccagaattgtttatttctcttcttctttttttgtactgctcattacctgttaacttcttatgcttcacattttatgatgactactgttgattatcagttcccccacccacattggaacctaagcttcatgaggatgaggatatttgcatagtttatccattgttgtgtctggattgtgtagtagagtgcctgtctcataacaggcagttcatgaatagtgactgaatgactgaacaaaaacactacactccctggataagagagactgagtttgttccacggtatggaatgagattcatgtctaaaggtgacatagggtatcttatgtcccaggaatatattcagtcctttgactgatgatcatttgcttcaatatttctctttgtgtctttggaatgtacaggtacaggatctcagaatcttaagttttggttgttcttagttcagatgtttttgtgtcaaccaaagcagtcttattgattaatcagtctaggttggcgtgttctaaatattttagctgggacagttttagaaggtcgctagtgagtgtgatttctaaattgcccctaactgggctatgtgtgctacttatacagaaatatcgtagccacttctcctttgtctagcgaattagccttaagtaagctttcaaagatgtgttaattacccagggttccagagccttgctctccacaagtgctttgccctgggatacaaatgtctgtgctgttcagggtagtagccacccgccacatgtggcaattgaggagttgaaggcctaaacgttaaattttatttgattttaatttatttaaacttaaatttgaatacccatgtggggctgttcagtaactggagaagtgagtttttaactgtatccaattttaattaatttaaatttaaatgtgcatagccacatgtggctcatgtctaccatgttgagtagcccacatctggaaggcttcatctaatagacttagatccttttagtatgttggcctgaaagatgtcacagaattgaaaagcgtaacaaatataactacaaatgcaacaacaaattcactaatgtaaagtaacaatacttattatgatgacatttaatctccaagaaaagttccatcacttattttaaatctcagtcatatatcatctattttcttgaccttttaatattttccttcattccatttttatgaggcatgtccattttggtgtaaaaattagctcttgaattgtcttgactcctttaatattctcattgttttactcttttacgtctttatttatccgaaacattattattattattattattattattattattttacaattcctttctggtttgcgggtggtcattctttgcactttttaaaaactcttcaagttaatgcctagtttatttattttctttacttttaattaaaaaaaagcattcaggactttaaatgtctctaattgcaccataagtaactatcaccatttttattatatttttatttttttattatattattatatatattatattatatataatatataattatatttttatatattatattatatataatatatataattatatttatatattatatttatataataattataattatataattatataaatataatatataataattataattttataattatataattatataaaatataattatataattatattttattatattttattatagatagagcccttattttccactttataattaactaattgttataatcttcttttctttttgatctagtagttactgattagcaaggagcagctaacaagctgggtcaggagtatcctaacacattgaatctgggatagcccctgagccccggattcctctcaatagtactgtgcagtgccgcttcctccatctcatgaggtagtgttacgtatcctacctcatacccatagcatgggtatcctatggcatgggggctagatgttttgggatttgatttctcacttcctggcttggaaactcaggttgatggcttaatccttcataggtatcagttcctacaacctcttcacaggtctacagcaaagaccaataaactaatacctatgaaatgcagttccttgcatagatgacaggctcagtaaatggaagttctatttaataattatcactatgctccttctggcaacatttcttgtttcaacgtagaaggaaatactagcctttggaaaacattcatgcttagctgctacgaattctcacagaaggcccctccagttttgttaaatgtccagcgaaggctgaagagggacctaggaggacccccacattcattcgtcattgcccagcacactcagtctcctggaattttgttttccatgttagttgtactatctgggacctctcatgactggatgtgcactgtggaattcctaggtgggcctcagctggcttctgtattatcaccttccttgagcctttggtgtactggtcctcctctgttgcatctgacagagccattagtgattttcctccacatggctggtttgcctttctgcagcgttgattcttgtcattaacatttaatcacacgattgctcgctaggtgtccttgctgcatgttcatagaccattcacgggcttcttctgtggctcctttttgagtgagaagcaggtcgtccacgcccagtttctgctgagagggtgcttactgagttcctgttctcgcctgctcatgtgccctcgggttcttgtctggacttgggtggacagcagaagtggatgtgtctactccctggagatgtgtgtcacctcctaatttgattctgctgaactaatgttgaggctcttcaccttcatctctaaatattgggtcattttctttatccatttgttttttgatggacatttagactgcttccaaaccatggcttttgagaatagtgctataataaacatgggagtgcagatatctcttcgattttcttcatttggatatatacttaggaataggattgctgaatcctatggtagctctatttttagttttttgaggaatctccgaattgttctacagagtgggtgtactaatttacgttcctaccaatagtatacgaggattccctcttctccacatcctcgccagcattttgttgcctgttcttcaggtaagagccattttactgaagtgagataatatcacgctgtagttttgatttgcatttctctaattttcgtatacctgtttgccatttgtatgtcttctctcgagaaacgtctattcatatcttttgcccatttttattttatttttatttctatttatttatttatttagagacagagtctcactctgtcacccaggctggagtgcaatggcgcgatctcggctcgtggaaaccttctcctcctgggttcaagcgattctcctgcctcagccccccgagtagctgggattacaggcatgcgccatcatacccggctaattttatatttttagtagagacgcggtttctccatgttagtcaggctggtcttgaactcccgacctcaggtgatccgcccgcctcagccccccaaagtgctgggattacaagcgtgagccaccacacccagctcttttgcccattgctaaatcaaattcttagatttttttttttcctgtagagttgtttgagctccttatatattctggttgttaatctcttgtcagatgggtactttgcagacattttctcccattctgtgggttgtctcttcactttgttgattgttttctttgctgtgcagaagctttttaacttgcagggatcccattggtccatttttgctttggttgcctgtacttatgaggtatattcaataaaactttgcccattctagtgttctggagagtttttctaatgttttaatagtagagatatgtcacttctttggttaattcctaggtattgtattttatttgtagctgttataaatgaatttactttcttggtttcttttttcaaattgttcattgttagcatatagaaatgctaccgattttcgtatgctgattttatgtcctgcaactttactgaatttgtttatcaattctaataactttttggtggtgtctttagatttttttcaaatctaagattatttcactggcaaagaaggataatttgacttctttctttctaatttgaatgccctttctttctttctcttgtctgattgctctaattaggacttctagtactattttggataacagtggtaaaagtgagcatctttgttgtgttccagatcacagaggaaagactttcagcttttttcccattcagtatgacactagctgtgggtctgctgtatatggcttttattgtgctgaggtatgttccttctatacccagtgttttgatgattgttatcatgaaggaatgttgaattttgtcaaatgctttttcaacatcagttgaaatgattatatggtttttgtccttcattctgttcatgtgatgtatcacattgattgatttgtctatgttgaagcatctttacatcccagggataaatcctacttggtcatgatgaataatcttttttgtcttgttgaatttggtttgctaatattttgttgaggatttttgcatcaatgttcatcagggatattggcttgtcgtttccttttttttggtgtgttcttatctggttttgatatcaggataatactgacctcataggatgagtttggaagtattacctcctcctctgtttttcagaatagtttgagtaggagtgtattaattctttacatgtttggtaaaattcaacagtaaagccatcagatcctgggtgtttcttccctaggagatttttaatcatggctttgatattattatttgttattggtctgttcaggttttggatttcttcatgattcaactttggtagtttgtatgtgtctaggaatgtatccatttcttctaggctttccaattagcatatagctgttcacagaagcctctaatcatcctttgtatgtctgtaatgtctccttcgtaatctctaatcttatttatttgggtcttctctcttttttcttagtctagctaaaggttcatcaattttgtttaacttttcaaaaaaccaacttttcgttttattgatctttttattgttttctttgttttactttcatctattttggctctgatctttattatttttcttctattaatttttggttttgtttgctcttgcttttctagttctttaagatgcaccattaggttgtttattagaagtttttctactttattgatgtaggcagttatacctataaacttttcttttagtatgcttttgccttatcccataaattttggtatggtgtatttttattatcatttttcaaataaatttaattttcttcttaatttcttcattgacccactggtcattcaggagcatattatttaatttccatgtgtttgtatggtttccaaaattcctcttgtgactgatttctagttttatttcattgtggttagagaaaatacttgatagaatttcagggtttttaaaattttttaagacttttttgtggcctaacatatggtctgttcttgagaattatccatgtgctgaggaggagaatgtgtattctgcaactattggataaaatgttctgtaaatatctattaggttcatttagtctataatgcagattaattctaatgtgtccctggtgattttctgtcttgataatgggcattgaaatctccagctattttttcattgggatctatttctctgttagctctgataacaatttgctttttatatctgggtgctgcaatattgagtgcatatatatttacaattgttgtatcctcttgttgaactgaccctcatcaatatataatgaccttctttatctctttttatagtttttgtcttgaaatctattttgtctcgtgtaagtttaggactccagcccttttttttcccatctgcatggaatatctctttctattcctttatttttagtctatttttattcctttatttttagtcacctatgggtgactataggtgaaattacttgtaggcaacagatcattgggtcttgttttttttttttcttaatccattcagccactctatgtcttttggctggagaatttagtccatttacattcaattttattattgataagtaaggacttactcctgctattttgtcatttgttttctggggttttttgtgccgttttatttctttccttcttgtcttccttttagtgaaggttattttctctgtggtatgtttgaatttcttgctttttactgtttgtgtatcttttgtacttttttttttatttgaggttgccatgagcttgcaaataatatcttataactcattactttttttttttatttttgagacggagtctcactctgtcccccaggctcgagtgcagtggcgtgatctcggctcactgcaagctctgcctcccaggtacatgccattctcctgcctcagcctcctgagtagctgggactacaggtgcccgccaccacgcccagctaattttttgtatttttagtagagatggggtttcaccatgttagccaggatggtctcgctctcctgacctcatgatctgcctgcctcggcctcccaaagtgctgggattacaggataactcattacttttaactgatgactgctcatcaggattgcataaacaaactaagaaacaagtaaagagaaaactaataaaaattctgtgctttaactttgtcctccagcattttaactttttgttgtttttacttgtattttagtcttatttctcaaaaagttgctgtagttattatttttgatggttcatcttttagtctttctactcaagatatgagtgatttacaaacgtaattacagtattataaaatcttgtgtttttctttgtatttactatttctagtgagttttctaccttcacatgatttttctattgctcactaatgttcttgtctttcagactgaagaattctctttatcatttcttggatgacaggtctggtgttgattaaatccctcagcttttgtttatctagaaaagtccttatttctccttcatgtttgagggatattttctctgcatatattattctaggattaaagttttcttccttcagcattgtaaatatgttatgccactctttcctggcctgtatggtttccactgagaagtctgctgtcagatgtattgaagctccattttatgttgttttttcttttctcttgttgcttttaggattttttttttctttatcattgatctttgggagtttgtttattaagtgcttttaggtagtcttctttgggttaaatctgtttgatgttctataaccttcttgtacttgggttttgatatttttctttaggtttgggaagtgctctgttttattccttaaataaactttccatctctctctctgccttctctttaggtccaataactcttagatttgccatttgaaacaattttctagatcttgtaggcatgcttcattcttttttattcttttattttgtctcttctgactgtattttcaaatagcctgtcttcaagctcattaactctttcttctgcttcataaattctgctattaagattctgatgcattcttcagtttgtaaaatgcattttcaactccagaatttcttcttgattctttttaattatttcaatctctttgttaaatgtatctgataggtactgcctggctgcctccaatgctcattcaaggcccaaggtgtcttcagtcaatgtgtggtgaatgctgccaggactgagactcacccttcagggcagtaggctcctctctgacccagggctgaccctgaaatgccatccaagagccaaagcctggaattggtacctaagttgcaaggtacctaagttgcaaggcaaaatccccattacttttcctcctactttccttaagcagaagaagtctctgcccatagccatcacaactggaaatgtgctacgtcacacatgaagctagcacatctctgactctcacccaaggcccatgtcgagtactgcctgggtaccactgctgattattccaggccccagggctctctactcagcaggagatgaatcctgacaggactgggtcattcccttcaatgcagctggttcccttcaagcctagtgtgtgtctagaaatgtcatctgggagctaggtccaggaatgggggcctcagaattctacctggtgccctatcttactggggcagagctggtctctgaattgcaagacaaagtgctcgttaaacttttttctcctctcctcaagtagagaggagtctgtctcagagtggcaagctgtgctttctgaagctgggggagggctaacacactcactcccttggccaccttggctggcgtctcattaagttgcatgcccccaagtccaccggttgtacacccaacatggcaccagaacttgcctaggaatttcagttcttgtggcctagactgcctttcaggtttatgtagaacctcagagcactttcacccacagtggcaaggcttactggatctcaggttctgtccactgggatggttctgaccctccagcttgccctggtctggtctaaatgttccgtctgtgggtgtcggctgagttctgccctgtgttgctttccactgtgatagggcagcactgaattccaaggccaagtcccatgatcgctgttctctccctcccacaatcacacagattctgtctgtgccatgtggccactgccaggagatggggaaggggtggctttggcaaatcaagactgtctctcctaccctcctcagagcctcaagtgactctttcagcaatatgaggttaaaaccatgtactgtggttgcttacctgaattgtggttctcatgaaggtacttttttgtgtggatggttgtccaatctggtgctcctgtgaggaggaggtttggtagaagcttctgtctggccatctggctctgccttcttaatatcagcttctcagcagtcttgtgctgttcctcactcacagctggctgcctccacctgaccctccccttgacaccacaggcaaggacaatggtgagaacgtcctctctcccactgaaatgtttccttgttgcactttgggtttgagaagtgctgtgctcctgggtcctgcccttcttagaaaaccctaagaactgggtaagaagtatttacccctgacagaggatcacctttcactccaaattccttcttcagccagggatggaggaagtcacaaatattatcatctaagctctaatcaaaaattatatcactatgaagattagattgtagagtttggcaagaaatcttggtaaatttaattaatgtccaggtgaattaaatgagtattaaatactaaaaatatgagagctcttcatgctctcagaacaaggccagaaatatggatgttctcagtgttgtacccttgaggcttcagtgatgagattttaacgtacaaaaaaaatcactgcttctcctagtgaacaaggaacatatagatacaggaatggttttgagtaaatccacagtcaatgataatttggaataaccaaggataatcatagcgcattcttaaattatactattaaattatactctgctttctctagccttcttcctgccatagaattcatccaaagcctgattggctgatgactcaggtgtgcccagctgtgcagaaaccatgggaggcatgttggccatctgagacagtatttgtggggcacatagacagttggcacttcacccaagtcacacttctgctgctgggatgtttattacactgatccagtttagccaggccacaagatccaggtagaactcaacaattccatctatgcctatatccagtcaacctccagatgactccttcccagtcctgcttctccttcgtccagccctgcctcacccttgcctcctctcctcctcatgcacaaacaacaggtatttatgttttacaaatatgtgctgatatcactgcaggaggaactggggtttgcgagaaaccaaggactgagtcctttctgatggattatgatgatgggagtaactcatcactcgcaagattcagctttaaccagaaactttgtcagagtgtccagtgtcaaagccttagtagtttgagtctatacataagcaactggaaagtgaccaggggacaagtttagagctgggcaaatgactgaaattgtgaagcctggacttctttgggtttaagatgatgcatgattcctgtgaccagcatatcagccccgttgtccttgaagacagaaaggttgagagagcccagtgcctaagtcaggtgtagtggagagaggaacaaaaagaaacagacacaaaatttcttggagaaaaaggaagctttttggtttatttaagattttagccaaatttttttttcaagatatcacatataatcacacaacaagaattactgtggcttttggtgtagattcatatttggctctgaggttataagaaaataaaaagcaaagtttcactttgattaaagtttgataaaagttgaaattatctagtgtttctgaaatatcactaagaagacctagaatgaatagaatattcccaaaacaaatgacacttcaggagaaaagatggaggagagtaaaaatgaaattacttgataattaaaatgcatctttcttataatgagcccagttacttctttactgtgtttattgataggtggctctcatgaatagggcgcatggcgtcacctgagacacgcttggaactggttcactgggagtctgtctcattgctgtagaaataacctcagtgactgggcgtttattcatttcttcttaatttctattttattttttgatttatgaaactttaatgagcagtttctatgaatctcagcagatcccaattaatacaaatctaccaacttttaatgatgaatgccaacaaatatactacagtaaacatcctactgccgagcttcaatattttctttacttacattgctcagagctagcatttcccagcagtaacacaacacatattcgttcgtttcttatgaaggcaatataagtgtttggtgagtttttctaatgtaaaatgatttccagaattggtcatgagaaaggcagaccctgtgagagcgaagcctgtcctttgcaaagcctgaaggacttggccttttctgaggcctggttaataatccacccgcctgacattccagtggttactgtgagctacaggcaggttcccctagacattttgagtttccaaacaaatattcttcattctgataagaagaaaacattaatcttctgcaatttaccttatcttttagaatagcttgcaaactaataatgaaacaagctaatgaagtaacttttttgtgttttttattatctgttgtttatcaaggcatatcaaaatatcagtcttatcagttactatgttctatgtatttaatgaaattggagattatttaaatactgaatattgtaactcagactaaattattaatgaaacaagtataatgcttgatgacttggttaatgaaaactcaaaaatctgccaactgcagctggacacctttgcctggggatccggtcctctcaccctgggccacccagaatgtagccttgagcctgggggaaaggagagatggttctgaatctgaaacagctgtgttggatcacaagcgtgtaggccaggaaccagaaagagtgtaaaaagcaaagcagcaggtcagaaacaaaattgtgtttgggatgattgtggtgctgggtgcaccaacactcagggcttcagagggatctccaactgcagagtgaaaaattcctcaggggctctctgaattatcagaaggaaagcaaagatcatcagggcgaagcataatattttacatccttcgttttattaattcagcaaatcttgtttgaatgttcactagatcatatactttaagtatattaagtcttacaaactcgtgacaagtagctgttcttatatctgcatcctagatgacagagcagcacagaaaggctgagtaaatcatccaaagtcacacagctaataagtatgagaatgggatgataaattctgcagtgtccgactcacccggcctttcccttctatcagtccgctgcaacctgcaggggagatgctgaatcacatctattctaggttcttaaggagccaatcatcttctgagggggggtttgaaaagtgagcaagtgtttgcatatcaaaaagtgttgttattggtttaagccatgcatgaatttttcttcttttttggtttaatacctaaactggttaccttcggtaatggagaaactaattgggtagcgttatacaaggttgaacacattgatgactgcttacgcttctcagttagttaaaatacaaaaaggttgaaagctaattggctttaaccattatttaatttatttcacacttggcattccctggtagaactgtaaaaggtaaagtgttgttgtgtcttcgtttagttcccggagttctagaaggccaagaaggttccgaagtaattcatgaatagcactgcaggaaaggctgcctctgccctctccctcaatcctgggcataaattctaagaatttcactttcccatggctgtgtggtatttgggccccaggaggtctaccccccatggtggtgctgatggcttcattgatagtctaccaagcttacctttgtcttgcctcctctcacccccagtggtaacactgcagccaatgcttcctctcccaatatttgataaacctactctcctctgtcttttatgtctcccaccccaaatcctattttccttgagagttgtgtttggcgttttctcaaggtctaggaaatgctcctccaggcctgcagttcacactgtacaaatgtctggactcatccaggacagcccagccccatgcagggcttcactacgtggacattaatgtgagcgaactctccccgcaactcccaagtaagaatcagacccaggctccccacatcagaggcaaatttagaatggacattggatgccgtgggtcagcagctgagaatacctagtgagtgtctcagtcagtgggcagcactagatttgcaaaatcactgaaaaaaaaatcagcataatagtaatactaatagttcagtattgcagagctctaaatgataccctgatgttctgcaggagtagattgcattataaaattagagcaatatgtaataacatttattaggacttttaaaattcatctgtaatccaatgatccagcaatgccattgacattattttaaaagaatggatgcacagacctgaacttgagtagtgcagagagctataaaaaggaagtataatcttcttgcatccctcctactcaactttctcctcctgaagaggcttttccccctgaagatggttattgttccaacatcaacaatttctcttcagtcatccaagaaaattctttaagtgtagatacacaatttttaaaatgaacataattgagagcatgctatatactgtattatatacttttaacaaattaataccttttggaaaccctgtagcataaaccttaaacttacaagttctgaaagtactctgattttgttctaatccttacactatatttcctggcgagctgaccttgaaaacattactgaatcattctacatctctatttcctcacccataaaaagggggcactgatgccttacagaatgtaactatggatgagtaatcaataggtattacgtagaaaatatgggccacagcttcagaaacttaaaaaaatgtttaattataattatcatcagtacgtaactctaacttttagtggttatataacctccaattatacaaatatactttaaaaattgaccctgaatttactggtaaccatttaaattgtttcttgtttttattatttttagttttgttattataaacaaggctgccatacacattcacacctgttcactgatattgaagaaattcttacaagaaatatttggcgagaattcccaaaagttaactccctggagttgaattgtgcacgttaactcataatgtctgtggtgcacagatatatgggctggccctggggctgcctcctgagtggggcctcagtttacatttcccagaatgtaagattgcctgcttgtcctcatgctcaccaacaatcgtgctaccaagatcttaaaaatatttgtcaccctaaaaggtaaaaaagcaatcgattttgtctctctacgatttttaacgttgtatttagtctgttttgccctacagacatttttggtatttttataaaatcactgctttcctatttcctttaatatcttgcttagagaaaccttcctgattccctaagaacaatttttatgctttcctctagattaattttgttaagttacccttttctagaaagtgttacatttgctttgttttcaaattcgttttaacagagttttgcacattaccctattaggattctaattttgatcactttatctgagacccctcaccaatatgaatatttaatatttaagtgtgcacgtgttctttcttgcaccgtcattacttttggtgtaaattaactgactttggtatgctgtgcaccctctgtccctttctcattcctggagtccagtcctggagcagctccacgccagcctttctccaggtatgcagagccagagagctcagactgtgtgtggaggcctttcccattgctaattctcagccggggtttttgaacctttccaatgttcgctctcactggagggaacagcatgcttccaagagaataataacaaatgcaatgcttggagaatcggccctggcttcaaccagaaagtctaattgtgttttctttctttccttttattttttccagtcaggcatgatacgaacagaagaggcagattacttcctaaggccacttccttcacacctctcatggaaactcggcagagctgcccaaggcagctcgccatcccacgtactgtacaagagatccacagagccccatgctcctggggccagtgaggtcctggtgacctcaaggacatgggagctggcacatcaacccctgcacagcagcgaccttcgcctgggactgccacaaaagcagcatttctgtggaagacgcaagaaatgtatgtaagggcgaatctttgtgtgtatttagtgatgctgacatttatgtaagctgatggaagcttgtacattttcttcaaagcatgtctgcccacggggtgaaatctatggactgtcgttgctaaactgaagcaatgattccagagagagtcccttatctgtaagttcagcacgggacatctctccatggcagatggatggataatggtaaatgatgtctttttaagaattctttcctgggtagattaaatgacacagtgtgcagaagtgcagaatctaccagacatcttcaaaagaacccaggcatcactactcagtcattctatatttttgaggtttagatttattcaagcccacatagttttcctgctgaggtaattcatttatatgcatgcttatatacattaccacatcaaaagggcagactcagtgtgacatagtagacctgcgatttatcaccaaagctttatcagagtctttttttgtcatgaacatttaggaaatggtttattatttacatttttatgtagaaacctctcagaaattcaagaattgaagttgggtgctttctggaatgtccctcacttccttgagctctctcctcaaacatcactgggtgaaccttcctcaggagtctctggactgccccctctccccctgcccattgtttcctgcgtggttggtttctatgactgcttcacccagcaccctgaatagaggcaggcctgttgcaagtacttagtgaatctcgttgaatgagtgaacgaacaaaaatctcttggcacctacaacaacagaatcagtgcttgttaaaccatcagtgcctttgtgtcctctgaacccctttcgtcctacccctgaaagtcatgtgctgcattcagatgacttgaaaacctcacacccagatgaacttagtgggctcaggtgcaggggaggtagcaggaagaaccatgctgagaacaaacggaggtgagcaggaggctgagagagttgggaatcctgaggttgggtgagtgtttgaaaagggcgtgcatatcggcaacagctgcccgaggctgccgtgaccggcaggtcaggacccagatgcgtggcggaggcttccccaaggtcagagtcaggactctgctgccagggctcacggtgtggttgtggtcagagcaggacaaattccgtatgccagggagaggaagtggcccacacacctggatctcagcaggagagatagcagggccgtcttaaccgctttgacagaccacacaccaagctcttaagcagacgccacagtggaccttgaaaacatcaagcaatgcagaccactgtgagaggactgcgatcctttcgttcctctctgaaggtggtcgccatgactcaggctggtggcacagctaaggcacagctctgtgtgcaaggcagtagagatgacctcagtgtggtgtccacatctgcgcgtgtgtgcataggcatgggagtgtgcgtgtgtgtgtagtgtgtgttgccttgagagacacttcagaattgtaatagtggtggtaagtgaaaggcagttatttcaaaaaggatgctaaactctataacacattctgtatttgaaaagtggaaaaaagttcccatggtttcataataaaactagcgaaagaaagctcaacaaactgcctcttgtaggtggaggatattggtgattgacatcctgctgtttgccaaatatttccgtcccccctggggtatgcaggtgatagtactacactcctgggcctcgagtggccaggggccatgtgaccagcccaggccccggaaaagtgagcagaatcaacagcgctgcttcctactggagcgtgcatcctcagggccctgtgtcacctgctcatggacgcacccccaggtcctcgtgtcacctgtgcatggatgcactgcacccccagggcactgtcaccgatgcatggatgtaccacaggtcctcgtgtcacctgtgcatggatgcactgcacccccagggccctatgtcacctacacacagatgcacccccagggcactgtcaccgatgcatggatgtaccgcagggcctcgtgtcacctatgcacggacacatcctcagtgccctgtgccatctgtgcatcgatatttccatgttgtccctgaggcttttggactttcccttgaactcagggcagtcctgctcttctgtcttggtggaattcacacttacaatgattctttcctattagagtccccagttcagaaaatgggagccttttctgtgttcacttaggcatttttcggtggaaaagggcaaacagaggcaggttgatttgctgaaaaccaatagtgaggttggacctcaggctgattagtgggcctgctgcccttcaggtgatggtgggtgtgcagctggggcctgtgtgttctggggacaacgttgcaagctccatattgaggggcagtcatttgctgaggggttttcagagccgaggcccgtgagatcaccaccccacggagtttctgacccctgcccccaatactgagggcctgtagctgctgagccctgtgctaacatgttgttttcatcctaaagccatttttccaccaggggtaattaagaacaagagttctaggaccacactgtccaaatctgaaagctatttccgacactttcgaaggaaggggtgtgagccagtaatgttcctctcctctgccttcatgacctcatccttagaaccccatgctcagcctggggtacagactgcacgagttacacagagacatctcctagggtggagctcacacctgcgggcattgcataaacattaatggcaaatgagtgctcaataaacattagctggtatcattattattctccaaaagctttatttaattttggaagtatgttagcaaaggaaaatgaaacgtgttggatgtactagtcaaacaaaatagcatctgcttacagtatgctccgtgaatacagtctgcatagattttgtgtgcatgccacctaaatatctgggctttttgaagtccactttcacacgaaacaattctaaccacattttctgaggcatccactaaacctaattgttttcaatgtagtgttaacctaacaattatacatgccaaaaatatttttaaagggattacttcaagaggaaagtgtatgctttgtcttctaatcaaatacataaatatttatggtactttctaggaaattaagctcttcagtgaagtggagctgcctcaagcattttataatctattggaaacagtgtagacaagctagttatgtgtccagacattgaaatcaactttaaacattgtcaagtcgttaaaagtcttcaagcaggaaaacaatgcaagccagccagctcgtgttcttgtaattgtttgttccattgctttgtctttgcagaggaatctgttctacaaatccctatgctcaaagtctctgaacccttttgctaccagatgttaggagttacagccaaagagtgccctctcttgctgttttaaattaggatgaaattatataaagggaaatacagccatgatttccatgatgcctagactacatgaattttacttaaatttagtgtgctactttaatacaagtttctgcatcacaaggttttaaaggtttatgtggtttttatcatgagtgttcatttttgagaccaaatttctctatgacgagttacggccctgattttgtgtgtgacttgtgcttccatttgccctccatgtgtccctccatagacatgccccagcctcccaaggaagacctcttcatcttgccagatgagtataagtcttgcttacggcataagcgctctcttctgaggtcccatagaaatgaagaactgaacgtggagaccttggtggtggtcgacaaaaagatgatgcaaaaccatggccatgaaaatatcaccacctacgtgctcacgatactcaacatggtaggatcatccttccagttgaggccacctgtgtcattgcacttcgtagggtgtgtgtgtgtgtgtgtgtgtgtgtgtgtgtgtttccattttacttgttacctgtggattgatgttccatatatgagaaatattttattggtgataactcatttagttttctatgctccaatgaaaagagccattttcagaacttcatagactaattcagtaggaaaaatcatttgaccttctctataagcctctgtaagcctgtgagatgttttgggcttactggcatctatttactggaaatctctaaggggttgctgagccactgtagtgcagtaaatctgattatcagcattagatgtgtgattttagatggctctatagaaatgcccaactttttagaaatactaatgttcaaatgctaaatataaattattttatctataaaaacaggaaaagtgcaaccttttagaatatcacctcaggtaaaatgtgtttgtgtctcaaattggcagctgtattaatcactgaagagtgatgagaggtatactaagcctcatttcatgtaagtgaaatctaaataacagaagacaaaatattgggttgccaaagtgtgtttttaagaatagttttaatgacaatattttaaaagtatgtctttgcattcttctgcctcaataaacagagtacccctgaatgtgcccatctttccatgatgtcatgtgattactatggctagtgttatttttggtagactgaaccactagatttctgggctcccaggaagctgaggaggcagtgaaatagagccaccttcccgctgcacggggtcaaagcaagcacggccctgttgtcctcagcaagctgctctgacgcgtggaagtgtttgcctctcttctgtagagcttttccaatatttccgcagcgcagtggcaaatcacttcaggttacattccatggtggacgtgctgttcctgctccccaccccaaatgccactgtgatcactcatttccatttccatgatccatcacctctgatatcacctctaattgtgtctttctctcatcatctcattaccatgattttttctttctctttcttgtatcctcttggaatcccataagtgcgagagtttctcttgcacttatggaattccttgccaggagagcttgagaagtgattggcttctgtcatcatcatgattagcttaaaaatcctctttatattctaaggggaacccttaccaacccacagccttgtgatcctttcttaggtgtttgaccgtaagaggtggaccccactcccagctgaagcttcggctttttaccgtgatatgattaatacatctgtctgcctagcaatacaagaaagttaacagtgctctgtcactgaagaacaagggcgttggattctaggcccgctagtaagtaggggggaaaatgccatttatggggctgacatggatttcctgtctttttcaggtatctgctttattcaaagatggaacaataggaggaaacatcaacattgcaattgtaggtctgattcttctagaagatgaacaggtagtttatctttgaaactatctactctttttattcctagaaaaataaatgcaaaataatgcttttttctttaatataattgttctatgggttcttctctctcgagggcaaaatgtatttaatattttgtgtctactgcaaatgagtgtcttttcaatccttttaaatgttttttggattttttgtggggttttttgtgcaaaagtggtaagaaattatcctttaattggcctgtaagaaaatggcatgtaaaagctgccttcagcatataggtgggacacacactaggaatacacagcacaaaatatatcttagccatcgtgagctttcaggatgccagtgggaatgagccctttctgcttcttgctaggagagtataaatgttttgtggtcttgaagttacattgtactgtgtggccctgtgttgctttattcaattatctcccagctcttaaccttcaccatctacagtctgagattttttatttttattgagatttctatggactttcaagcgcatttccctcactgcatgcaaaaacccagattatgctgggtcttggtagcagtgggttaaagatcctttgccttcatttgggacccccgtaaatgcatagaggtggtcccttcacagaaaggatggacatgaacaccttgtggcctaagtaatggggaggcattttaggcacaaaatgttctcatttccatttttccccaagctaatcattgactgggcaaaggagagtgggtactggacaggagccaagagcccagcctcagctccacccttgctgacgttttcagagtctccttttagctacagttttcttatttataaaacaaagaattttttagatgaaacccgagatcattcataagatctaagatgccttcgatgttaaagttctgggatgctgctctttttctgtgcatggtgggggcatgtgtggacagggctatttctagtctgactagtcagggaagatacaacctcattgtcttttgtgtgagtgcgcagttggggagggggttgctgaacatgccgggcttctcaggtgacaggttaattattcctggtattaaaacctcttcaccttggaattcatccaagctgcaaagaataagcgaggttatcgtttgatcgtacacctgtgttaactttaattaatgcagttttcctggaaatcacctgctaaagaacgcaaggcttgcccccgtgtttgtgtgtagcattttgcttgggtatatttgactttctgtaaaaacaacataaacatttcaggagaaaacatattcagtgtctgagagacaaaaatttcaatacgacatcctaacagtgcaagctttaaacaagccagtgtcctgaagctgaggtaattaaacctggtgttgtcccaccagccataggaaactagagcatgccggtgaataaggttcaaataacttggtgcaggctggtctgatgcatgttcttctgtgtctcgaattcttccgttcccaagagttccaatgttctacgctctgttacttcatcgttgcgttatctgaacctaatggagacagaggaggttgaacatggcttgcaaagtctccttttagttgcagtttattttccagaaataaagctttaccaattgacccacctcctctcagaaatatactgcctttgtagaaaagatatttaatttaacactataataataagtattaaaagacttatttattggaaatcccacttgcttaacttggttatgagataaacatatcaccatctagacgtgtttttgtatatgtatgtacaaagccatgtataaatgattctgtggctttacttaattttgaaaagtgtttttgaaagatttttgaaaacaaaaaattcatgcacagaagtaatctttcttgggtcattgaacatgcattcaggatcagccagatacatttcaattgtttatgtatggaaccagagaaacgtgcctaagtgtgtacactggatctgtacgggttttatagaatacgtaaaatacacgcgttagcttatatgccatccagatccagccatgtatttgaaatccaggtcaataatagtttgctgtgatgacaatgcattataacatgttttctcttcattatcatggggtcctcggtccttgtctcttgcacagccaggactggtgataagtcaccacgcagaccacaccttaagtagcttctgccagtggcagtctggattgatggggaaagatgggactcgtcatgaccacgccatcttactgactggtctggatatatgttcctggaagaatgagccctgtgacactttgggtgagaacctccagcagagtgtgaggaccgtgtgtggaatgtgcacccctggccgtgacacagtgttgagtatttttgcccttgttccttgttaataagcagtagcagcttcttagtgaaggtgtaaagactcacttccctgtataaactttagccaaacatagaagtacgcttgcattcatcaagagtgattattgaacaagtaaatgtcttacagattccagagttcctatctcttctaacaaaataaatacatatatattttttgtttcttctactgcttgtgccaatggggtggatagatcgaaggctttctcattatatagtggaaatagtacattgatgagtatctgtggagatactacgaccagattatatttcctgttttttcccttctctctctgtatctcaatcttagcaatgttttagacatttacggggctgggtgtgacttgtagaggcagcactttgtgattctttccggatggtctgtgtaaaacactgtgctactgaccaggattccgctgaacatgtcttctaactctccgtttcttcccaagttcctagggaggaagggtttttgtttataaaaactttcagataaagcccaatttaatagcggttagtcttattgtgcaaaagcaagttaacgtggtgtcccggctgcttgtccttagacagccctcctcacccagttggctcttggctggactccgagaactcaggttgtaggatggttcccactgccctacctccaaagagtggctcattgtgcctaaattgtgtgtacaaacagtgtggtttccttctgaggttctggaattttggcaaactttaggcagtgggtgcctatgtgaccagctcccagagaaaaccctggacactgagtttctaatgagtgtccctggtggacaacattcaccttcattgccacgactcattgctggggaagaaagcacatcctgtgtgactctgcagggcaaggacccttagacgtgtgtgcctgtttcccccgacttctgcccatgtgttttccctttgctgattttgccctgtgtccttttgccatattaaataataaccatgagggtgacaaatgctcgttatgacagatgtgaatcattaaagctgggggtggtcttggggacctcccagcacacccattctctacagcaccttttcacttggtcttttgggaacataggtgtttagaataaggcaaagaccttcctccatctgcaatagattccacgctttattagagcctgccccaggctctaatagagtcacgccccaattagagcctgcaccacgaacgttacatagaaccatgaattgtgttccacaatacagagagtccttgggctccctggaagggagtcccttcccctaccttatcaagtcccctttatacggttgtctaagtgtttcccatttcatattttcccatatgaacataagaactaaatttcactaaggggtagaaaataaatatactatgctttattttattacaacaccgctatgtgttcttttgatctttgtccttcacaggatttgcacccataagtggaatgtgtagtaaatatcgcagctgcacgattaatgaagatacaggtcttggactggccttcaccattgcccatgagtctggacacaagtaagtgcatctccatgggaggatggcatcccgagttttttccttactggatgatttccatggaaatattgactcatcaagtcaagtccatgaagggaattcacatatatccaacgagaatgccattgacagttataaaatgctgtcacttaggacttctgtttctatgtcccacatcgtgcaaattttatttttatttatttactttattttgagacaggctcactctgtcaatcaggctggagtgtagtggcatgacctcagctcactgcaatgtctgcctcctgggctcaagcaatcctcttacctcaccctcccaaatagatggaactacaggcattcaccaccatgcttggctaatttttgtaatttttggagtgacagggtttcgccgtgttgctcaggctgtgcacatttgaaagccacagcaatgcacaagtttccatgtccctgggtctttctccaacactcctgtacacacctgtgcctaagattgaggatagctgtatctgtcccgattcctctgtcccgtgttttgaacgtggtctggtgggctgatctcattccatggttagctgctaacaggggactctaaatgatgaagaacagtgtcaaccctcccattgcttcctgctgttaccctcgcgtttgtgttcttgtatatatttatgtatttacaatttatagagatgctatttttcattggtactccaagcaagagtttggaagagtgggtactgacaagagatcaggcaggcctctaggaactgatttgcctcccttattccacctctgactgcaccattaatggcttggaaataaaagtttcagggagccccacgagcctgggggctcaacacagaggccagtcctaggttggcggtctcagcaatgggcggtgggtcattagtgttttcaccttacatgaaatgcttacaattgtagaatgaacaatttctagcaattatttgtggaaactattattcttaatacaatttctgaggccaataattctgtgagctgctttaccttgaagtatcgtctgttaaataaaaaaatcaagggcccatttcctgcccaagcagctggggacttcctgcaatcaccctgagtaataccagaaccaccaactggaatgcaaatcttttcctgctatgctgcaacaatacttgaaatttctcctagaaaaatttacaaccaggaattataagtttttattttttttaaatttcaacctgattttattggcaaaaggaaaaccaaggcaagtgtttgtgatttgtggttttgcaaagctgacttatccattattggaaaatggactgaggcctcagacttgttcaaagcagtgtgtgtgtgtgtgtgtgtgtgtgcgcgcgcgcacatatacgtgtacatgtatgtttgcgtgtgtatacacatgtgcttgtgtttaatggaattccacgaaggttctgcaccctttagctgtgtgaactgatgacctgaaaaatgaagcttcatatcttattactgatcccttcatcaccacaggtaatgattgactatttcattgcttagaaaattacaccttcactttataaagctttcagttgaatcatagttgtatttttaatagtctgctagagttaaaacttcaaaaactctcattattgtaacaacatgaggctcctgctgtcctctgaaccatacctgaatttaattaaacaatcaaggcaagaaatatttaagtcactgagggcttagccagtgaacgttcgataagcagttgagatatgggaattggcagtgccagccgttgcaggtggtgaacttaactaagttaaactagaggcatccgacacaaggccctcagttgatcttcagtgtcaagcaagtatcagtgttggcatttatttttcttagaagtcaattattactatttcctttcctcactcaaattgggtgtagttggaaaaagattttctccaaacaagaaaaaaatattttttctggaaagtcagaatctagatgtgaataaagaaagaagccagtcgggcgtggtggctcactgtaaacccagcactttgaaaggctgaggtgggaggatcacttgagcccaggagttcaagaccagcctgggcaacatagtaagaccccatttctacaataaatttaaaaaattagccaggcatggtggtgtgcgtctgtagtcccagctacttgggaggctgaggtgggagaatcgcctgagcccaggaagtcgaggctgcagtcagttgagattgcaccactgcactccagcctgggtggcagaatgagaccctgtataaaaaaaaaataaaaataagccctgcatgtggatgaaggagagtcccattgctaatataggattaactgccagaaagtatcagatctttcttgaacacctgacttcttcaagttctctgagacagagaacctggagcttgtcaacgaaaaacctgctgaccatgttgagaaaatagaaaatatatgtatctatcatgtgctaaatgccaaaatgagtggcaataatagtaatagtagtaacggtaatgataatagtagtgtctgctcttcatggagcactttctgtaaaattcacctagcaatttcacatacagctcaaaccatggaaaccacccaggacagttccttctgtcgccttcactgacttaggggagactatgtggaatattcagcaaatgtgtatgaatggagtcggggaatgagtgacgcagggcgtgagcaagcaacaggtgaggagtaaacgtttcaaatgaattgttagctgtgaccaccacttcaaatgagaaaggctgtgatgtgtaagactcaatgataaaactccgtgtatcttagttgaactaaactgaagacaaacacatttgttcagttcatgtatttagtgagttttatttttggaagaaggaatgataagtttgatgcatggagcaaacatcagagcatcaacggtctgcttttatcaatgagctccaagcagagtcaaatttttgagttctgtacgtcaagaattaaaaagcaattctgaatttattatgacttttactattaaaaaacgtgtaaaacatactgcttcgaaggtaaattttactttttcagttctgtttacattcggaggacattatttgggatggaggagtacttctccatgcctgcaactcataggtttctaacctttaactcaaataaagatttcagttagtgtccatccaatctgtcctcctaagttccactttttaaaaaaatctcaaaatatcatgtagtttatgctagggaatgtgacctaaaaatagaaattactaagaacaggtgtttggatttgtgttggaaagagaggaggagagactggaaccagaactgagatatgtgttctcctgtagtacatgggattgaatcaggatttgtattaagctggtggtacaaggagagtttcctggttatgttaaatcacttgacacaggacatgtggtttgctaaggcaggtgctgaagcattggcacagatgcaccaagggctgaactgcgcatttgggagaatatgtcatctgtgcatgaatccatctgaaaaattcccatttgctaagggaagtcatgtcatttgatgggtagggctctgggactcagattccagatcagcacagtgctaccacagtctgatagtgaccagggagggtgcccttaacagctcttacctaggtttccgatctgcaaaaacaatagagcactatatgctccgtagctcatatatgcaagtgtaatttaggttgcattatttgagctgtacattccacttatataaaataggcttaaatagccaagttgcattatcacttgagaccattgaggtgctataaaacaaatatattaactgtgtgcagaagtattcattattcatcagtctgtctcttgcatttccccaagtttatggacccagtcactgggcacaatttgcattctgagagcaaggcattgtgtaggagtctacaaaaagactagtgatctatgcccttccaaagtttaagagaaaagaataaatagatatgccatgcaagatatcaagtaatgagagctgtcggtattgcaagagaccacacagggacaatcagggaggtcttaaaagaagcagcattgggccgtgtgtggtggctcactcctgttaatcccagcattttgggagcccaaggtgggtggatcatgaggtcaggagttccagaccagcctggccaagatggcgaaaccccatctctactaaaaatacaaaaattagccgagtgtggtggcaggttcctgtaatcccagctactcaggaggctgaggcagagtaacctcaggaagtagaacttgaactcaggaagtagaggttgcagtgagccgagatcacgccaccgcactccagcctgggcaacagagagagcctccatctcaaaaaaaaaaaaaaaaaaagcagcattggtgtcactattggtatcactagtagttagcttgaaaataccattcagctcaaccacagtcactggagatgcccctttcagtatttgatgatgacatgtgcctccaccccatttgtggctgtgctttgtcaccagtctgggcctcttccagtgcatcagggaggcatgtggtgatttttaaagacttgaagaatattggagaaagccagcccctctaaccatcatctggactggggattgtcaggctgctctctgggtagctgtggtaggtcagagcatcagttcttaccaattttatttgttgtcattcctcttaggatttcttgtctgtttctgtgtccaacaagtatttgaaatccattaatatttggccagaccttcccatacacatgcatgcacatatgcataccaaccatgaatggcacttaggtgttatatgatttgaccaagaccacatttggatcctggaagggaatagaagttttgaattttcctttctgatgtgcacagtcccaggcattctgtacagttcatgaggaaggttttactatcccattttatatataaagaaactgaggctgggggggtcaagtaatttgcccaatatcaagcagcttgtgaatgacagagccaagaccctgactgaggtccctgcacctccacagcccatgctgtctcccattttcttctctgcccatttccctcagttccccgcaactgctgtcttcagctcagccttctatctttcatggagggtgagctgtgcttctccagatgcctgcatgaagcctgcgtcagggctctgggcagctcagtcttacctgtggtcgccatcattatgccaaaggtagactttgccatccagataacattggcccatggttcctttaagaatgtctcatgtccttaaccactactgtctgaacagcctgaaataagtgatacagcctctacaaacacttggctggttattcagcattctcagtatatcattaataataaacaaatacttcccaatagtaattgaatcactcaaaaaatattgtagaagatgataaaagcatgacattgaaatataattcccaaattcaatttaatctgaaattagatttccgtctgggtatttgagttagtgttacagcagaaaaggttgtccttccttcacttaacaaacacgaatagaaacctgttaggtactgtcaagtccactggcagtggggctgtgagcatggataagaggcgtctctgtcttttagaaacttataaactagtaaggggaaaaagataaaatatatttatgactttagcaaatgggatgataaccattttaaagtactatggtgcacaggagcaagatatattctctggtctgcataatttgaatagtagttatagttcttggttgccacatagcaaccttatcttcaaaatgtgttctattcattcttctgtgactttattaatggtggtattaaatgtaatcactgtgtgctacttttttatgctgatctgctggcattcattgcattacaaatgtgggcattgtactgattggagacacaaattgtgaaatagtggtgctgagattttggtgggaatcagaatcacctggggatgtgttccaatacacccaaatgccagctcctaaccctcgacccacaaaattagaactataccactgcaggcttgggtagctacattgtgctctgtatctctcagatgttgatgcatcagagtttgagacttgatactagaaaaaaatcattgaaaatactttaaatgtaaaagttgaagaccaagatttccccagacttgggacattgtggactttgaattccttagaaaggtaggcagacacggtagcaagtttatcgagggcaatttctggaccgtaatgtgtcttcttcattagcagctcaagggccagccagcggagggtagtttggtatttcgtgttcctccttttctccctaaggcagcctcccatttaggatttcagcctgaatctttttcacagccatgacacatttcctctgccatgtggttaccctggccttgattaattgcctttaatagaacttcagagaatgggtggaggctaaaatgactacatctacatcacccttggtactgatcaagaattttgcagaaattcagcagtatttgcacgccagatttccttggataccgccttcaatcacgttcaggttacactattacatgaatcccagctaggctgtgacatcaaagtgtcaaggtttcagccttgactcggtaaccctggatgtagtctttctccagtcctcggtcttgctgtctttatattaaagctaccttgtagagctgtgttgagttttaaattagaatataggttacaagcgtaccataaaagctgtaaaatggtgcgtgcttataaatgttaattactatatttactagtaatatattactaaatagctctaagcaaagcagttaaatagacaaatgtgtcttcagcctaggcaacaagtacagattctcttgacaccttttggagctgactttcccctacactggtgtcttcctgtccctgctgccttctgtccactccttatggaattcttggcagcataatgtcccacataaatagaaaccaccatgtccttctttgctttccctctctcttgccttcccccttttctctgcatctcaccacatgagaccctgtgctctgggaatccatacaatggctgggtgccagacattaatggcaatagtggcttagctctgcaagaatgtatttaccttaatgagaggtcttcagagccacaagagctcccaaggaagtatgttgtgttcttctgggatagttgaaaatgggatcattgaaatgagccttgagagcactcaaggccctcctacagctttcacaggttaagaagaagagacttgctgatgacggaggtagcagccctggaaaatgtgattctcacaggtgcacggctccattttctcaggtgttattaagggagtgttaattggcattgtaggatctcaacacctctgatggcccccattaagggttcctatagctgctgtagcttgagatgtacctgtactctgagccaggtgtggatctccaaagtggtgtggttttcacatgaaggtaacctgtgcttcttcaaacgacacccataaatacatgaagccatagtcacctgttgggtttctgtggagctactctctccaaatagacagacagattcaggtcaagcacagcccgcccatcacagcctccagcagtgcagccctaatagtttgagatggaacatccccaggtaggggtagagacagaatgtcagcccaccattagttgcagtagctgtttgtagttctcaaattgcagtaagcatcaaactcgcctggggagtttgtttggacagctcaaacgcctggatctctcttttctgagtcaacaattcctgggtagaagcctggcatctacatttctaacgaacacccatggaaactctaacgatcctgctgagcagaaaagagtgtggagaaaaagaagctacatagagcagtgttagcctaatcaagaagatcccaagtccctccaccccattcaatacgcaggcatctggacatttctatgatattggtgtacactttgaggcaatttggtggatggtccattcttcagaaactgtcttggaatacgtgaatattcttaaccaattggcagttgtgacttttatttttgcctgcctagcatataggggtgagggagtctcacagtcttgacttgtaattgttagagggtatcagataatttaaactgtttttgttctgaaagaaccatctctctctctctctctctcatagctttggcatgattcatgatggagaagggaacatgtgcaaaaagtccgagggcaacatcatgtcccctacattggcaggacgcaatggagtcttctcctggtcaccctgcagccgccagtatctacacaaatttctaaggtaggaactctttaagctggtcttgtgatctttcggggcctttgatgctcactgcctggtcagccagatcctgtgcaagcagccccaggctgtgcttcctgatgtggttccctttgaaggtgtcttgagacattcagttgaccgaagagtttgctaaaaatctccttagagcatggaggcctgttggcttaatctgacattgattcaaagggaatcaatgacttgagactaaaagggagccataagacacttaccaaaatatttgtcactaacatttaagttttacaattctcacttccataattaggaatcttcaggaagtgaatagaaagatcgtacatgtacacatctgtatacacaataataaagcataactttttttggtttttcttctttctctttattttttctttcttttccttccttccttttctttctttctttttcttcctttctctctcactttctttctttttactaaatgcattcctcattaggtgaagaaacttgagtatataaactttaacctagctctaatattctgtaatcttcaataatatttttagaaattttctctaagcactaatttatttaggagataaaacattggggaggtagggtttgatccttgaaaaatagtagatttgaaaatttcagagaaatgaggaactttatgaaacgttcttagaactgctagtttatatgcttgttccctaaatctctttggctttgagtttgaagtttggtttaaatcttaagccaaaactttatttctgacattacagtccagtgtgaattggaaagtctctgctccacacagtcattcagagacccaggtttcttccatcctgtgacctttcctcttccaggacctagttccccactgcagccatccggggactgaggacagagagagcacaggagggtgtgcgggacaagggtggtgttcctggaggaactcatatgactgcccagaagtgcaaggggcattgagaaatgtcctctacccatgtgctcaggtgacagagagccatctgtgccacatgatgaaccccaaatcctattgcagaaaagtaaataaaaatatttttaaaaatttaaaaaagcaaataaaaattttaaaatgaagaacagagggaagggcacaaatgtatagattctaaggaactagctagttgtgataggaaagtttgaaatttgacaagaagaattatatttctattattaaaaagtagggcaaatactaatacttccaacaaaagcaaagggttttttttttaagtaacagctttaatgagctaaaattaatacacaaaaactacacatatttaacgtatacagtaagatgagtttagacgtttgcatgcaccaatgaaataatctccagggagattccagcaggtttggtggaagaaaaaaatagcttagcagcacccaagaagtccccaggctaggaaacgagattatctgccttccaagtctttgtaatgtacatgtctttgcagtcaaaactaggaactagttattccaaactgagaactaagaacaaagttcccctatcctattagatcctgtagactcttcagttctcaaccggcctctctggttcctttcactgaccttacttctttgtgtcctaccttttttttgttttctttcttccttttttattcatatatttaattaatagagctctttttttctgttgcacaaattaagtcttcttatttctaagacactatttgagtagcaggatcacaccagtacttctgttggttttactccagtgtactttctggtggtctgttgccccagggctcacctggggctggattgcccctatggctgcgtcttccttcattctctagggatcctggcttcccatcttcccagccaggattttgatcatcagcctccaggggctgtgttcctctagcttcctcctttttggtgttcctcctccaaggactaaagtatgttaacacattaaggaacaactgtgtttcatagtttatgccacccagcataagtggcaacagtttggacgatatgtgtatcttggtaatataaacctgtattctgggaatatacacttgatcattttttaaaaaaaaattatattaccaaaaaaagacaatgttaaagctattctacaactgacatgatgcataggagtacatttagcatttgtttttccctgcatggtattctcagagtcaagctggggattgttagcattgtttttagctgtttcttgcagctgttcacatttttctctctgtgtgtgtgtagaaattctactctgggtaacaaggaagattattcagtttaggctcaccatgctgttatttgcattaacaaggaaaattcggagttttctatattccagatcctttctatagttttctagattcagaattttttaaacctctttttcatcttaatcgttatgaggaagatacagtaacactttttctattttgaaatatcctctgacaactgaaaaaatcaggggattataatttgggtgtgtagtgagaacacccaagttattaaagtccaaaaaaagttttgaaactgccaagaaatataggcagactcatggaaagaagataattacatgctcggggaataattattttgaggacgttgaaaatagaatgccatcttgaagacataatatagtcctaagaatgattattaaggtactggaattaaaagccattttctttctatgatactggaacacctgaactataagttgaagtgtgctgatgtgtttttgtgtgcatccagcaaaacactactgtagcatttcaatgataaacatttattttcagggactttaccaatttcttttgaccacatgagtataaataaataggtaaggttttacgtgcttacagatttgttttcttgaatggtgaaattttccaagaaagtctcttgttgttaaattcactattaagattcattttactcgaaaaccagttgcaaattggacacttctatagtgtgttaaatcttgatttttcactgacttaatgaatctgagactgtcttgtttgattgtttgctgactttctgatttccaagtaatcaaaatactgttatattctccaccaattaggtggctctttggatatgatcccaacaatgagcaaggataaatggctaccttttaagatgaatctgttctccttattagtagtctagcatttgatagtgggaaaaaatgtaagggaactcaattggcctgaagttttcagcacaactcttctctattcttggtagagttatgaaggcttgatagttttttggagtgaattcatcaacctagtcaataaagtcatgtgtcattttccattaaccgacacagacctcatcacattactcatgtctgcatccaggaggcctgtgacttagggaaattttagctcattattttaaatttcatgacaacagggactcatcttcagttactttttaaaaatttaaatcatgccctgcagatcagtgaaaatgccagctctctgaccacgtgaatctgaacacatcaaagcatgagaaaggtgaccatcatcgcagggaacttggagtgtaagcggcgccgtaccccatactacttctgttgatgggaaaatgagatctgacctgacagcccattaagtgtgtttttgtgcataatggaaataatacatttcgagtcacacactgctctgtgatacaaagctcatcttaaatcatggccagttgttgtctctgcagtgccagggtgactctaagactagagggcaggcactttcctgcggaggagagaaggaccgagggaatcagttcatgtcttgttcacgcatgtctgggaaggtctttggtgggtaatataaccttttctgagggcctcagtcttcttaactgaaaaatgatgggatataactaaaagatctctcaagctctttaacattttttgattcaccacttagagtgggaaagggattttgaaatgttgtaatgatacttttgaccttccttaatgtgttcattaacattatttttgttttggtacgaaatatatacagaaaagtacaaaattataagagtgcctacagctcaatgaattttggcatgatgaacgcaatagtgtaactaacttctatgcagatcaagatacagagtgtggtagggactttagaagctgcttctccccactccaagggcttccgctcttccccaaaggtaaccaccatcctgacatggaaccctgtgtattggaatcaggagttatgcacccttgtgcagttatgagattcatccttgttgctgcatctaaatatagcattagtctacttagttatgttgcatataatttatatactaaatatataaatatactaaaacttattcattcattctgttggtgatagacatttgagtttccaatttttggcgattacaaggaacagcactgtgaatattctcttggtttgcatatgtgtcttgagtgtacataggaatggaattttcagagtcataaatgtataagcacaggtgcaatagacagtactaatcagctttcctaagtagctgtgtgaagttacactcccagaagcatttgtgaaactttcaaaatggtttcaaatccttcccaacacttggtcacgttgatatttttcattttaggtatctggtgggtgtgtagtttcatatcaatgtattaattaataagattgaatacattttatatgtttaatggccacttgaataaccttttcctttttagtaaagtgctataatcttttgtgcatgtaaaaaaaatagaccctgttttttttcttctctcttggtgagagtattgtatacattctgagtataaacattttgtcccattctggaatatacgtattataaaatcttctctgactctgtgactttttatttacacttttaatggtgccttttgctaaacagaaatttttatttttttaatggaatccaaattattaatgtgtctttagggttggtgcttttgtacactgctggaaaaaaagaaaaaaaaaaaagctctacttgtcccaaagttgcaaaggtgttcttccacatgatctcctacaagttttattgtttgcttatcacatgtagaccacttaatttttgtatatggcatgcaaaaagtcaacattcattttatccatgtggttattgtggtcgattgattataaaatggttgcaatgattttcctttctgcacccacacttttggtggttggaccattttgcattctcactggaggtaaatgagagttcctgtttctccacattctcatcagtgtttgacattgtcagtgttttggattttcactattctaagaggtgtgtagtggtgtctcactgatgtttgcctttgcaattccctaatgacatatgatgttgagatctttttatatgcttatttgccatctatatattctttgattaggtgtctgttcagatttttgtccactttttgttattcttgttgttattcttactgtttcttgttcttggattgtaagtgttatttatatgctttgtgtaacagccctttattggctatgtcttttacaaatatattctcccactctgtgtcttgtcttctcattttcttgacatttatttcacagagcagacattttttattttaatgaagtacagcttgtcaattatttctttcattgattatgcctttgatgttgtatcaaaaaagccattgtcatatccaaggtcacctagattttctcctatgttattttctagaagttctgtagttgtgcattttatatttagctgtatgatccattgtgagttagtttttgtatggggtataagatctgcctttggccgggcgcggtggctcacggctgtaatcccagcactttgggaggccgaggcgggcggatcacgaggtcaggagatcgagaccatcccggctaacacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaagatctgcctttagattcattttttagatttatttatttattttattttttgaaatggagtctcactctgttacccggactggagtgcagtggtatgatctcggctcactgtgacctctgccttccgggttcaagcgattctcctgcctcagcctcctgagtagctgggattacagatgcacaccaccatgcctggctaatatttttgtatttttagtagagacaggaattcatcatgttagccaggctggtctcgaactcccgacctcaactgatccaccttcctcagcctccctaagtgctgggattacaggtgtgagccaccgcgcccggcagattaatttttttacgtgtagatgaccaattgtttcagtatgatcagtttaaaaggctatcttttctccattccattgcctttgctcctttgtcaaagatcagttgactatatttatgtgggtggattattggcctttctatactgttccactgatctatttgtccattctttgtaactttatagtaagtcttgaagttaggtattgtcagtctttgttctcttccttcagtattgctctggttattttaagtgttttgcctctccatataaactttggaatcagtttgtttatatcctcaaaataacttcctttagttttgattgacattgcaatgaagctatagattaaaatgggaagaactaatctcctgacaagattgagtcttctgatctatggacatgaaatatctctctatttagtttttctttgatttctttcatcagttttgtagatttttctcatgtaggctttgcacatattttgctacatttatatctgtttcatttttggttgctaatataaatgacatgtttctaattttcaataaattctgtttggttgtcactggcatatagaaaagcaattgacttttgcatattaagcttttatcctgcaactttgccgtaacttattagttccaggagttgcttggtggattctttcaaatttctacctagacaatcatgtcatctatgaacaaagatagttttatttattcttttccagtctgtatgccttttatgtaatattcttgctttattgcactaggtagcacttccaatacaatgttgaaagggagtggtaagaggagtcattcttatttgttcctgattttagtggagaagctttaagtttcgcaccattaattataatgttaactatattttttgtagatggaagttctcctctattcctagtttgctgggatttttttttttttatcatgaatgagtgttaaattttatcaaatggtttttttcttcatctgttgatatgatcgtgtggtttttcttctttagcctattgatgtaatagattacattaattgactttagaatattgaacagaccttgcagacctaggattaatcccacttggtcatagtatatagttcttctcatgcattgttggatccaatttgctaacattttgttgagaatttttgtatcgatgtttatgagagataagaaaagctttcttttcttgtactatgtttgtctggttttggtattaggataatgctgacctcatcttaaaatttagaaagtattccctctgctccaatttattggaagagattgtagagaattggtataagttcttccctaatctctggtataattcacagagaacccatctgggctatatgttgctttttatgcacggagtcctgagctctgaagcagtggaacgtgggactgggggtcctagaaatgagccagaaatcttccagtcaaggtggacaaccactcagagccaagtttggaggatgatctgccattgctcattgtattgtgattctaggtttttgtttttttggttttctcagggaagggcctattgaaatttgtaggagggatttagttgctatttgaaaacacaaaaatgtttaaatacactttcccaaatgcataaattataccaaagaacatcctggaagagaagaggataatctatttatggaaaaagaaattattacttgttctttagccatctaccaatgatttcagcaaggttaattttctgcttgacttgggggtcatcagaaatcatcctgagcacagagcattgctggtggaaatccagtgatccaggaagaacctctacaatctcgaagataatatacatgtcccctagcctagagggaaaaagaatgaaaagcaaagaaacaaagaaagttccagtctttgaaatagagtatgttttatttttataatgcccatcttttggttgattctgccaagaagtgtgcataaaagatgtccatcataagagcttctcatgttgaacactggttgtaattattcagttgcacttttcctcatgataagtttaagaaatttaataagtacaaatcgtctccctggaacaggtacaatgtataataaacaatttcagaaaatggagtctctgtatttaaatataattaagataagtattatattgtaactcaggagaaaaaaagttctcctctttgtatacacaatatatgttgtaaaattacatgggggagaaaggcataattagttgtaagtcctttggttactctacgggcagttactagtagctcatctcctctttgtttcagcaccgctcaagctatctgccttgctgatcagccaaagcctgtgaaggaatacaagtatcctgagaaattgccaggagaattatatgatgcaaacacacagtgcaagtggcagttcggagagaaagccaagctctgcatgctggactttaaaaaggcaagtgattattggcacatgctcaatgcaacatgattcataagactgttttatttagtgtaactgatgttgatatattctgcatttattgggtacctaccaaatgtcaaatcctgtatgttaaggctggtcctgtataacgggaaacacatgtttcactggcaaagaagacgacaggagatactgttgtgggtatcagttttcatttgagaaccgacttggcctgttaggttggatctttctttctgatttatcgtgtgggagctcagcaataacttttagtcagtgtaagttggcaaattaatactctgcatttttttaaatgattttaaaaaaacgaagtccccctcctctctcccaatataagcatactttactataaagcagcagcttacctagggctactgattaataaatttccctcaaacaaggtatttatagagttgtctctcatagaaggtaatacctactccgtcaaccccaggaactttaccagagtgatttagtaacagaaattgctcatgtaacacagagacatatgctcttgctagaaagggaaaatcgagatttaggaacctgctctatcaaacacaggaaaagctacccataaattaaataaaagtaactatttttaaggtttcttttattctagtttataataaaatcaagaagaaattagagaaaaatataatcctccagaaacttccaaacatttcaaaatgcattgggaatactcccaacttaaatctaacgtgataatcatctttcttctaaagtcaagcagagctcccccaaagatcaattccagctatgtgccagaactggatccttatctcttcagctggggagtcccagactggaacaagatctgtaaatccgtcagcagcagcagacattctcaatactgccttttcttatgggcagaagatgtgaattccctgagaaattttttttttagtgttactcttctgtttgttaaggaaaatggacataaaactaatgggtttttttcaaagataggatcttctagattgtgcttctggtttccatggtagttagctttgtgaccacggactgtgtcattcatggtgccctgttgtcatttggaaaacataggcaatgaaaagttagatgcaaggtgcatttttattattgaggacatatttacatggagagaaacacattcattttacatgtacaatttgaattttaacaaatgtattctcacatgttactggcatcttaatcaagacacgttttatttgcataagccagaaccttccctgtgccccctccttcaacccctccctgactccagtaacaattattctcatttctatcataattgctaaatgttgcctgctcttgaatgttataattaccttgctccatatagtaacattaaaagtaaattgtataatatttcaccattaataagtatgatgttagctgctggtttttatacagatactctttatcaaactgaggaggaagttcatctctaatcccaattcgttcagagattttatcacacaattgtgttgaatattgtcaaatctttccctacgtctattgatatagttatattgtttcctcctttgttctattaatgtggtgaattattttgattgatctttagttttttccattggactttgaatgtcaagtcaatctgccttcctgggataacctcacttggtcgtaatctattgttcatttttataatctgctgagttgatttgctgatatttgctcatgatttttacatttgtgttcttgattgatattattgggaaatttctttctcataatttattttcaagaattgattatcagagttgtgctgacctaataaaatcagttgacagtatcccttcctcttctgttttctggaagagtttgtaaaagattggtgttgtttcttccttaaatgttgattagaattcaccagtgagctctgtctatggaaaggtttttgtaattactgattcaactacactaatagataaagggttattcagaagacactcctaactagactgatcaatttcattggaaaaagtaaagaaatcattaaaagtgacactaaaggagatattttttcaatgaatggttatgaattcctttaattactgtaagatctataatgatatatcccctttcattcctcataatgataatatgtatttttaaatctttttttcttatcagtctagttaggagtttatcatattaatcctttcaaaagcatcaatattgggcttaatgttaatttgtaaaatttgtttgttggattcttttctatttcactaagttctgtcttgtctttattatattccaaggctagtatgcctgtctttttcgtgccctttgaagtagcagcttgaatcattgactttaaacctttcttattttcctaatataaccatttaatatatttagagctattaatgtctttctaagcacattagctgtatcctgaaaatgtttacatactgggtttttaatattattaagcaaaaatattttctaatttaactggtaatttcattaaccaacatattacgtagaaatatattaaatattatttaattgccaaataattctccagataacttattagttttgatttctaatttcataattttgttcagagaatatactctacatgtacttttgaaatgtattgacacatatttcatagcttagcctatgatctgtcttggtgaacattctgtggagacttgacatgaatataaattctgcagtggttgggtagaatattcaagaaataactgttttttaaataatatttcttacatcttctgcatcatccatcatatttcctacttgttccaccagttttacaaagatgagtgttaaaatctccagcaattattacgtatgtttctatttctcatgttagtactattagtttctggggttttttttgttttgttttgttttgtttttttttttgagatggagtcttgctctgtcacccaggctggagtgcagtggcacgatcttggctcactgcaagctctgcctcccgggttcacgccattctcctgcctcagcctccggagtagctgggactacaggtgcccacaaccacgcctggctaatttttttgtatttttagtagagacggggtttcaccatgttagccaggatggtctcgatctgacatcatgataatttctgttttatatattctgaagcttcataattcggtgcacatacatttaggatggctatgtcttctgactcttttctcgttgtaaaataccctcctttattgttgggtaatattactttgcttgatttctacttatttgatactaatatagccacatcagctcacttaggattgctctttgcatgatcactttttccattcttttgctttcaatttatgtgtgtgtttatataaaatgtgtctgctgtaaacatccttttgcctagtattgcttttctgttcattgaaacaaactctgaccttttaccagcatgtttagtctatttatattgaatgtaaaaattatatagtagatttcaatctactgttttactatttgttttctattagtctcatttctattttgtttctctgttccctttcttctgccttcttttagattaaactattttttaaattcagtattttaccttgacttgctttttaactgtacttccttatgttaattgatagtggttgctttagagattaccgcatgcatccctaatttagagtctatgtagaattaactttgtgcccacttcgtgcaaaatgcaaggtccttacaacaaataaatccatgcatccctcttccttgcactatcattgacatatatttcatttctctgcaaattaaatgcaacaaaatgcaatgttgtagtttttgtttaaaaatagctgcttttaaataagacaagaaattaaaccatcttttatatttattgtttagtatctatgttttcctataggtctgtttcaaagtggtatcatttccctaaggcctaaagaacttcctttagcatttattctagcacgtatctgctagccacaaattatctccaattttctttatctgaaaatgtcatgaattcatcctcagttttgaagatgaaaagtgtttggataaatcagtgaaatatacctttggcttattgtaagttttagttccagaattccattttttatagtttctgtttatcttctgcattttcccatttattcatttatctctacttttccttgaatagtatattattttatgttatagatacttctattatattatgttattacatataaggtgagtccttttgatccccgaagactttgctttattcttcattagggctcatcgctttcagttttctctgggccctgtggtgtagccggtactctcgtgtgtggttcttccccatgaggcatggacttctgggctttccactgaatgcccaggatgctcattgaggtctctctactctgtgtgagccaaaactctagtttctcccagccctatgcatcctctgtcttgaagccctcatcagctttcagcctgcagctgtggtcctctgctaggacacctggaatctcctatgtggcagctgctcaccccttaccgttaggacctgcagcaaaacctaagacagacacctggggcccccagcccaatgcaacttttttctatatgagctgactctcaactagctgctgaacaggcctctactctgacctctgcatcctccagtcagtgagactgctatcatccacctggtatccacctcccaacagcggggtctgcaaagtgctcccaggcagagaggtgggcaaatgcggcgttcattctccttgcatgttttccttctctcgagcatcacagtactgtgttgactattgtcaagacctgaaacaattggtccatatatgtggtgtatataacttcatagttttgtggcagttttgttttgttttgcagaaaagtgaatttgataccagttacttcatagtggacggtgggagaagtaaagtatcttttaaaattgaaaaaacagtacatctattaaaatcacataatgtcagatcattccttatgatatataaaattgttctttaacacaaactttatgtattttcttttttcttttatttacttatttatgttttgatggagtcttgctctatcgcccaggttggagtgtagtagcaccatcccagctctcagcttactggaacctctccctcccaggctcaagcaattctcatgctgagtagctagggttacaggtgcatgccaccatgcctggctaattttttgtattttttgttgagacagtgtttcaccatgttggccaggctagtctggaattcctgacctcaagcaatccgcctgccttggcctcccaaagtgctgggattacagctgtgagccaccgcacccagctttgtattttcttttaaaaattagaagctatttgtgtggccagtatctctcagacaccaaatctcaaaattacatatggtgtggcaattagagatttttaaaaattttctatgtgaattgaaacatctcagaacaatttaaactataaaacttattttttttaatgaacacctgctcaatttttatttaaaagggcctattttgttcagatgaaatgtagagatcaggaagtttcttaatgggaggatataaaacaagaaataacaataagaagcaaatggcccagtgcccagaccagccctgggcacagtagagtcactcagaaatatgctaatctagatgatggatggatgatattttaggaagggatgaatctcttttaaatagctaacattatttcctttgaaaagtgaatagacaatgtaaatgcatatgcatcctttttttgtatatgtgaatgtatatttgatgtgtatgtatgtttacatacttatgtataatatgtgacacatatatgacaatggctttttctgtcactgatgtagagtgataatcaggattagtgataaaagcatctcactgcttgaagaataaataatgacaatgccctgtatatctgactgtaacatcaattgtaactgcattctttttttccataagtcattggggtacaggtggtatttggtgacatgagtaagttctttagtggtgatttgtgagattttggtgtacccatcacccaagcagtatacactgcaccatatttgtagccttttatccctcggccccctccctctcttcagtccccaaagttcattgtatcattcttaggcctttgtgttctcatagctttgctcccatatatcagtgagaacatacaatatttgattttccattcctgagctacttcacttggaataatagtctccagtctcatcgctcactgcaaatgctgttaattgattcctttttatggctgagtagtattccattacatatatatatatatatgtggtatatatatatgtggtatatatatatatgtggtgtatatatatgtatgtggtatatatatatggtatatatatgtgtggtatatatatgtgtggtatatatatgtggtatatatatgtggtgtgtatatatatatatatgtggtgtgtatgtgtatatatatatatatatatatatatatatatatatatatatatatcacagtttctttgtccacttgttgattgatgggcatttgggttggtttcacaattttgcaattgtaaattgtgctgctataaacatgtatgtgcaagtatcttttttgaataatgacttattttcctctgggtagatacccagtagtgggattgctggatcaaatggtagttctacttttagttctttaaggaatctccacacttttttccatagtggctttactggtttacattcccaccagcagtgtagaagcgttccctgtttaccacatccacacacaaacatctactgttttttgattttttagttatggccattcttgcaggagtaagtggtattgcattgtgattttgatttgcatttccctgatcattagtgatgttgagcagtttttcatatgtttgttggccatttgtatatcttcttttgagaattgtctattcatgtccttagcccattttttttttcttactgatttgtttgagttcattgtagatcctggatattagtcttttgtcagacgtatagattgttaagattttctctcacactgtggattgtctgtttactctgctgactgtttcttttgccacgtgaaagctctttagtttaattaggtcccagctatttatctttgtttttattgcatttgcttttgggttcttggtcatgaaattctttttttttttctatttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaaccgtccccagagtgtgatattccccttcctgtgtccatgtgatctcattgttcaattcccacctatgagtgagaatatgcggtgtttggttttttgttcttgcgatagtttactgagaatgacgatttccaatttcatccatgtccctacaaaggacatgaactcatcattttttatggctgcatagtattccatggtgtatatgtgccacatattcttaatccagtctatcattgttggacatttgggttggttccaagtctttgctattgtgaataatgccgcaataaacatactttgacaaactgagaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggtcatgaaattcttttctaagccagtgtctagaagggtttgtccaatgttatcttctagaatttttatagtttcaggtcttaggtttgagtctgtaatccgactcaagttgaagagtgtagtacagacaatttgaggaagtgaatctggtagtgtgccattcacaatattgaagcaccacaatgcagtttcagcccagccatctgaaaatgttggttttacctggggtgttatgttgtggtgttaaaccttaaccaagttggtattactgaaattggtttttgtgaacataactcttaaattatggactagaataaaaagagagaggcttcattaaagatagtataccttagctacaaagataaagcaagagtaaatactctgcgtaggttttgactcttttctgcccaagttaggtatttgttattaaaaacattttgtcttcatcgtgtacctatcatgctttatcatcattgctttggtggcctgaccctgcaatctgaaacataagccgccagaattgctttgaaatttgatcacctcagcatcctaggtactgttgttaaattgggagtaaccccaaaacccagcaagtcttacattccaactgcctggactctagaaccgtgatttaataggatctttgttccaagaagactctgaagtttcattaaggatataatgacctacaacaatagtgctttaataaaaccatggtatgttatgtaccataaagttagcagttaagtcaaagtgataaagttggacaggacaattggtttttggctgctcatttgtagtttacttttctttttttaactttttctatttaatgtttatggatacagaatggttgcacatatttatggggtgcttgtaatacatcgatactgaaacagaagagttccattttcccccttgcaggacatgagacaggggtgtggctcgctccttctgtcacccctctgctcaaacccctagtgggagcacgcagacaggcaggtacagagactgtggggagcactcttgggctccggccccacggcagcctctaggagtgggtgtctgcaactcccaaagcccaagtgagcatgtgttacggtgtgctccttcagcttctccatctgtggatggcttgtgttaaccagttcaatagaccctgtgccttattccaagggcagagggccagtgtgacagctttctgtatcctaagctctttcccagtgtactggaaaaactgggtcacccctgtggcctcaaagatgagtgcgaggttttattgagtagtggaggtggctctcagcaaggtggatggggaatcagaagagcaggatggagtgggaaggtggtcttcccctggagtcaggctgcccagtggccagacccttctctggctgcccccagctgaattccccttagcatccagacatccctcctctcttcctctgccacgtcattcatctttccaccgtcactggtctgccggtctgctggtgtctgctggtctgttcctctgcttctcttgaccacgttcagccactgtgtgtgcccattaaggtctcaggtttccacgggcacaggatcgggggcgtggcaggccagagtagtcttggaaaatgcgacatttgggcatgaaaacaggagtgtctgttctcacttaggtctgtggtacaggcctgagtgtggagccctctccagggacccccccttctctactcagcaactccctgccccctcccatatcaatacaggcgtacaatgtgtaatattcaaagcagagaaactgggatatccttcaccttaaatgttcatcatttatttgtgtaaagaacatcacactcttctagttatcttgaaatatacaataaattgttgttaactatcgtcaccctatggccctactaaacattaggtgttattccttttatctaactgtatttttgaacccattaaccaactcctctttattcctcccatccccctccactacacttctcagcctccggtaactatcattccaccactacaaaatccattttttcacttccacgtgtgaatgagaatgtacaatatttttattttgtcatcgcaactctttaagacactatagtttttattcgtttgtatgggacagagtgtcatgtttattaaatggcagacaagtacatctacaggataccaaggtcccaaattatgttttaagtgttgaaagacaataccgtgggttatatgatcgtcagtttcttctaactttgtgatttattccagccttgaggactggagttggggattgagcaggtcccaaaatgaggctgaaaaacacagatggcatgagccgaatcacagactgaattagagagccacatgacttggcagtgagctgtcaccagcatcctatatttgaaggctttatactttaaaaagttgaaagcccaaacctttaacaatatcatcatcagtatttattctgcaaaatgctccccaaaactaaaacctaagaatattctgaagttactctgaatggtagtctgaatcatggtcatcttaagtcatctttggctttttatgatcacgatttcctgattcttgctaatgttattgtacgtaaagctttcctggtcctctgtcactggttttcacaggagcaaatgactacatgttccatgtgcccagaaagcatttattgaaagacgagtagcaagcactgtaccagataatgataaggaacatagtaaaataatttaactttttttttttttttttttttgagatggagtctcactctgtcacccagtctagagtacagtggtgccatctcggctcactgcgacctctaacttccaggttcacgccattctcctgactcagcctcccgagtagctgggactacaggcacccgccaccacgcctggctaattttttatatttttagtagagacgggtttcactgtgttagccaggatgatctcgatctcctgacctcgtgatccgcccgcctcggcctcccaaagtgctgggattacaggtgtgagccaccgcgcccggccaataatttaacattttaaaacacactttaccttgtattattttgagtagccttagaaacagccctgtgaattaggaccctagatccctaagatcacagcagccacacggcagagccctgaacgcagacggagacctgtgccattgtctcctcaagcccttaagcgagaaaggaaaggtgcagtgccctagtgcctttacttcaggtgccaggccctgagctgaacacattacctataaccactgcatttagtccccaggacaagtccacgattagacgttgctgtcctcatgtgcacagtgaggactcaggggtcctgcctgcccacatctgcttgcaaaattcaccctggagctgcttatctacctgggaatcccaaactctactggaccattgtggccatctcccagatcacccaaccacacaagcagcttctgctttcaccctcattcattcagtatgaaggaatctgctttcacactcattcattcattccttaggtatgcatgctcagcctcctgaagcaggaggtctctacgccccatcggtccaggaggcctctgtgagccgcccaggggctgctcaatctctctccctagtctcccgttctgacctatcatattgccacccagacatcgagccggtgtgcacaggctgtggttttaagggagtttatttttatcctggcattctatcaagttgtcattcctgcaagcaaatagagctggccagttgtctgtttggagaattacattcaggacccttgaattcatgggttccttgggttctgcatacattttttttaatctctaaactccgttctggccaagaacagaggcccctgacaccatatagtaatgaacgtaattaaagcctgtctgaaagagaacatacccgggtgctcgcagcagtcttcatgggagcagccataggagcatcactgtttgttccctgctgacaaagacctcagccaggcaaagccctggccattaacacaacacacttatcacaatggcgaggatcccaggggactcgaaagatcatgacatttcattgcacagtgattgtaaccatatgagattttaaaccacagcgcaatatgaaagcaattgatatctgaattaaaacactgaacgtttacttgttaacatttcaagctccaaaatctggtttattagtgaaggagatatagccagggaaaatacgaagctgtgtctttaataagcaccttaacttctaagtatataatgaaatacatgcaggagatttaagaactggtgttaaaacccttcatgagatgactcacacaatgcagaaaaccttcctttaacatggtggaaatatggagtgagatcaccaggcagcaaaatgccatcttcccagctgcactacgtcgatgtgtttcactgccttgcattttcttcatgacatgaatcacccagtagatgcatccatttaatttcttgggggaataatgcagcacttgtttaaatgttctgaacacttgtgcagacaatttaagaaatgttttcagcatgtccagttgagtctaccgccagcattccagaaggttccatcatttcacaagtcctactgtttgcccttcattgagacattcctttggactcagtaaaaacaattccttgcactcggagagtcttttatagtttacaaatctttttcattggggcatctctttctgtatgcgccaaatggtgatttacagcaaattccttctttaccctatgaagaccaagaggcaaagaaggtcatgttcacaatggaacctcttgcctggcaagatgcctcacatattttaagccttaatcacagatttggggatggtggatgcatggttaaatggatggatggatggatggatggatggatggatggatggacaagtgaacaagcatcctaaacatccttaatttaaaaataagaattcagacttggacagattcaggaaggtggggttgagaaggatacattatgaaatattaagtttagtttttttattttaactttttatagttttctgcaatgtctgaattaagcatattttacattttaatttagaaaatataattttgttaaaaagataatatataaataaaacaaataaagtataagagatggaattaatttgaaccaagtctagagcatgagtctccttacaccttactctattatatgctatcatattgctaagtaggcattcgcttgtaaattatatctgttgttttcaccttaaatctctcagtgatatttttattatagatgaattgacaatatgatgtaatcctaatgaccttttacaaaatttctttaggacatctgtaaagccctgtggtgccatcgtattggaaggaaatgtgagactaaatttatgccagcagcagaaggcacaatttgtgggcatgacatggtaagaagctaactgtaggtacagcatcgtattcagatgctagtctttcaacccatgcatctttgctcctcttgcataggtatttttaaaacatgtatttctcatatacatatgcatacccatgctcctatcaaacactgtgtttattttatattgataatgtgaagaggaatccttttctcacttttgtgaaaataaaattgatgagctacctggaattcatagacatagaaatcagacaacaggtgatgacagattcagtctattgaggggaaacattaagccattgaccaccatttatcatggaaaggaccagcattaaacagtgctgtgaaagccacagaacatcggtttgaagaccctggagcacatcattttcacctattgttgcctctgtgagaagagagagagctatggtagagaaaagaagaagtatacaagatgttgcagcaatgtggacgtagttggaggccattcattatcctaggcaaactaatgcaggaacagaaaaccaaatactgcatgttgttacttataagcaggagctaaacactgagtacacatggacacaaagatgggaaccatagaccccggggactacttaaggggggatggtgggagggggcaagggttgaaacactatcccatattgtgcttgctgcatgggtgatgaggttattcgaatgccaaactttagtgacacgtaatctacccatgtaacaaatctgcacatgtacccctgaacctaaaacaaaagtcggaaaaaaaagaaatatacaagataacaagtttattactaaatggtaaagaatgacaatttcattattaaaactttaaaaaattataatactccatactaatattttaattcttttgatttaacttataattacattttttaaatataaaagactattaataaagatagatcctggacccacattatcactataactatttttgctttttatgtatctgagtttttagtggcattagtgaatatgaaatgatatttaggcattgatctagtatggtgtttgaacatgcctaaatatcattgttctattatgtttaaataccaaagaaaatatatcacatcttatacatattcgaatgtgactacagacagaaaggttttaaaatgttaacaacaatgctaacacacgttttcaggttaaattattgcagtgccaactgaagaaatgaacagaaataagataaacttattgagaatagcccccagccaccattcattctggacacattgctaatatgctttttttttcagttcctcgaagggcgtgaaattgatcattgaattcttctaattcattgaattctactagtgatccagtgatccagttgatttaatccataatatgtaatggtaatagcaatgctttcagtttcttttctgttttttgagacagagtcttgctctgtcacccaggttggagtgcagtggtgcgatctcagctaactgcaacctccgcctcccaggttcaagcaattctcctgcctcagcctcctgagtagctgggattataggcgcccgccaccacacccagctaatttttgtatttttagtagagacggggtttcaccatgttggtcaggctggtctcaaaccccttgacctcgtgatccacctgcctgagcctcccaaagtgctgggattacaggtgtgagccaccacatccggccaactgctttcagtttcttgaaagaaaatgagtataatgagatatggcatggaaattctaattgtcaaaggacatcaggtaatttacttgagtgttaagctgcagataatcatgacttttctgctgtcattgattaaaatggattattcaggtgatcatttgcaaaattatgcctgtttcttaaaagaccaacagcctttctgatgttgcctttgagctattgcctgcatgaaacacaaggtggtcctccaggcatcctgctttctgtgtggtcaggtgctacttttccctgggtaatgtagttgtgatgctttttcacaataacctgtacattctggttacattttatttatctcaaaggcaccattaaattgatttccattgatatttgacattattttcccttgtatttcaaatatagctttttcctttgtaccaaaaaaaaacaaaaaggctatgctgagatagagtaggttcctaaaaattacacagctgaaccatggtccaaagcaataaagttctgtccagggtcacctggctgttcagtggccagtgtgggactctgtaagccaaagcaaataactgaggcaaatctcaatgaatgtagaggtttacctttccaaagttggggatgtgctctgggagggggcgggacaaaaatcacaggaggacctgtgatccctgctctttccaaagaggactttaatgacttcagtatataaagaggaaagagaccgggcgcagtggctcacgactgtaatctcagcactttggaaagctgaggtgggcagatcacgacgaggtcaagagatcgagaccatcctggccaacacggtgaaaccctgtctctactaaagatacaaaacttagctgggcgttgtggcgcatgcctgtagtcccagctgctcgggaggctgaggcaggagaataacttgaacccggagacggaggttgcagtgagctgagatcatgccactgcaatccagcctgggcaacagaaggagacttggtttcaaaaaaaaaaaaggaaagaggagcaaaggaagcaggaaagaagaaagaggggagagtagacaaataaggccagcagttgcattctttggaagcttcagtcaacactcactgaatccacattttacatgtgagtggaggattgaagattcgtgagtataaagaaaacatagagtagaggaagcaggcaaatatgcatttgcctggggtgagtggagagatgaattttagtcttgtctttgccctgtatctgtgaagataattaattcacatggtcatggtgaaattaattcattaattcacatggtcatggtgaaattaattcattaattcacatggtcatggcgaaattcaacagagctctgttttagggtaaagatttgggggcccacaaagaacttccttgtgagtaatttgtgagggagtccacccatggagacacgtggccttccatcttcgcatctctctatttagaatcaaaatgggaggcggtttttgcacgactcagttctcaagcttaacttttccttttggtatagtgagtgtgaaggtccaagattttattttcctttcatacgttgtattttctcaggctgctgacaaagatatacctgaggctggataatttataaaggaaagaggtttatggactcacagttctacatgactggggaggcctcgcaatcatggtggaaggcaaaggagaagcaaagtcataccttacatggtggcaggcaagagggagcttgtgtaggggaactctcatgtataaaactatcagatcccatgagacttattcactgtcatgagaacagcatgggaaagacccgcccccatgattcaattacctcctaccaggtccctcccgtgacacatgggaactgtgggagctacatttcagatgaaatttgggtagggacacagccaaaccatataagacatccaagtctcacgtaaacagtcccttttgatattagttgtgtgtctgtgtgtcgttggtttgcatgtacccctgaggtttatcagtttagatgtgtgtgtggccagcggtcagtatcccactgttgttcttcttgatggcacctcgtctcctctctctgctactgagggtgctgctgaggctccacagtggttgcataaggtggtaacatagactgatatttatttcatttttaatgccaaattctaagcttagtacatttcatcctcaaaacagccctacaggtgagcctagtgcagtccccattggacattccagagttcttctgggaaagagaccctgggttcctctgtggtcaccccaggagaaatccagggcaaggggtggggaccacagctgaaatgcgtatctgatggattctagctcttcggtcactggggacctctcttgtgaaatcaaaccagctgtcactgtgtgattctatcaggtccagtgctaggcacttggcctagtccttacattgaaccctccctctgaactcattctggtagtttctatcatcgctaatttcagaagaggacaccgggctcagagcacatgggtgccttccccaggtcacgcagctcgcagagcagatctatgatgcccatttgatgactcagtgctttttttcctgctttaatacactgctcccctgcatctactgcgtttaggtgtgacgtgcttattttgtgaacagtaatcgccacaggcgtagggactgtgttgcggcatcttactctctaagataaagcctttttcataagtcatcgtatctgtcaataaaatacaaaactgtgataaagtcagtcctaagaaacctaattggtatttccgtggaaatctatatatatatttaacacagcattcttaattttgacctgatggctccaccggtctgttgtgtgcctaaaattagatctaatactgtgtgtgtgtgtgtgtgtgtgtgtgtgtgtgtgtgtgtgtgtctctacatgcacttatatttcccccaacctccttagcagaagatacagtgctttctcatcagattctcaaaatttttttgttttaatactttttaaaagtaggaaaatcatttaaggatactctaacagaaataacaaaagatgtaaaaaccaaagttacttttgcactgtcttaataaatgcatcttttggtgtttcctttgccattacttttgattgcaaaaactgcaattgcttttgcatcagcctaatacaaggaattgcaacagtcattatcacagcaaaagactggaaataatgcaaatgtccatcagtagaggactggttggataaacaccccatggaatattatgtatctgtaaaaatgcgatgagggacatgtctatatacttctgtggaatgatgaacagaacatattgttaagtggaaacgtaggatggaaaaaattctgtgtaatatgctgtcatttatcaaagaaaaggaaatactaatcaatagctatttgcttacattaaaaaggataaaccctaaatgctgaaaaagcttgtaaatattttagataacttaaaatgctgttaaataatccctaaacatcaaaggcagaatgaaacattttgaatgtatcaagttgttagcttaaccagaatcctaacagaagaattatttcaagagactttaaactccagtattagactgtacattccaagtgggatagattcagtggagaaaaaagatgctacaaataattttaaactgttttcagtaatcacgttattattgatggatttattttgctaggataaaggaagtactaactgtgcttatattgttaagaaccaagatttttaatatataaaagagatacaaatataaaatcaaagaagctaagtaacatttatagtcctaaatttaaaattaatacatttctaagaactaatgaagtattttttctttaaaattaaaatttttaaagatacactcacacaaaagctctatttaccaactcagtaacaataaccacccttcaaacagattaagaggctgtagcctcttaatctagttttctcaataaaaggagccagaactttttgtataaatggatgattccaggcctataacaagtgtaaacagtgtagtagaggttcctcttcaaagagacttttctccccatctaattaggaataaatactaacttcccttagaagcaaaatttattcaagacccgtgctagcattcttagatatctgctagccgtaataaagaaatcaatgtactttgtgttcttagctcccacattttagcctgaatatttgccctggcatgcttatactggtccaagcaagcattaggtcatagcctgttcctcttccttatttgaaggtgtttttacctttgtcagcattccacaagttacttcttccttcctttgttctcctctgcctttgcctcttttaagaagttctaagttggccgggcgcggtggctcacgcctgtaatcccagcactttgggaggccgaggcgggtggatcacgaggtcaggagatcgagaccatcctggctaacacggtgaaaccccgtctctactaaaaatacaaaaaattagccgggcgcggtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaaagaagttctaagttgctaaccaattgggataaatagagaacgttaggttccgttccagtcaatggaaaccagacactgcagtaaggtggatgtgtcaggttataaatgaccttgtatcctttgttcggtgtactctggtggcaaaactgctggcgtgtataccctttctgcagaaagtaaactagccttgctgagagatcctttgtctcagtgttgatttttttaacaccaagcagcagttcccaacacaaggaatgtacaagatgagcctcggataccttgctgagtcagaaagctagaagcctgccaaagattcctggctcctgtcaagaggaaactcaagaaacatttccaaaagaaacatatgacattagcatatttttctttatcatttagagaaaagcatcgtggttttcctgtacgatctcaaactcagggtactgagatatttggtgaaggttgttttttcttaaaagaagtaatccagccagtcatgaaaaagaaaaaagaattagaatatcattagccttgcaacactcaaagatgtaaaggatctgggaaatgattgttaatggctgctaaaagtattaggtgggaagctgatggggacctttgcaagtcagcctatattccctgaacactgaagcatcctaacaccaatgctctgggcctcaccaggcattctgtgtgcatatacatgaagccatcaatggtgcaatcttgccaaaaatccaactctgaacctaaccaatgccttagatccaattgcctgattatagcagatctagagaacccaggggacgtgttcaatggcaccacagagatggagctggcaagatccagaatatgggaaactcccaacaaacagatccattattttatcacgtgaattcaggaaaaacagaacgtcaagggagagtttgaatgtggagagagacatgagaagcatgtcagctgaatgcaataaacgaaccgtgttttgattgtgattctatgttaactgagagaaaataaaataccaaattggaattttgaatactcactagacatttgatgatattaaggaatgattgtaggtttctaggtatgataatggtgttgtggttatgttttttaaagttcttaatttggagaacccttagtgaaagagcttcgaagaaatgatttcaagtctgggagtcagtgttgggagagagaaagtggacaagcatttatgtgaaatgagactggacgtgagttattaaatgttgaggcaggactgcaggtttcaagggctcctgtactatttcctctacttgtgtatatctttaaatctttcattaaaaaataagctttttacaaaaacaaaacagtgaaagctattaccatgtcaatacgcctttctgagtctatgaactttgccaggtaacaacagcaaatcaacaacgatgttatgatgcacattgagtttgctcacagattcctggtaaaaacagtgcttctttgataaacatccttgcttttgagacagcgctcctgtcttccactaacctgacctcattctggggcttcgaatcctgttcttcatcttcaaaccaagagagattttcccagaaatattttcagttattcaacctgttgaaattccatttttatgtttcatgtctcctgcattagaaagctatgaccagatggtttttaaaaaggggggaaaagaaaacgacaacaactagcacacacctggcatctccttcctctctgacaaccggtgcaacctcactcctgtccccacacctgtaggatgctgtccaagagcaggagcctattccaggcaatgggcttctccttgagcctgagacagtggactttgttctacaccgggtgggagggcaggcagggatggaagagatgatgttgttttgcttaaagaaaagaaatgaatggatgaggctttactcttcagaatttcttgtttttaaatggaattgttcttacttaaatagcattaaatggggccatttgaactgccatagtatgtgccaacactggtcagatatcagtagtttgatatgtgttaccctaatacctcaactaataatagaagtattactttcctcctatgaaagtagcctttttttttttctgtcagtacaaatctagtggctctaatcttggagataaaaagggacttgacttcaggtctccccagcccacagaccaagctcttctcactccactggggccaggacaagagacaaacatcttccttcttcctcgcaacagacagtctggacagtctggacctttaaaatcttagaagttcataccaaaccacccagggaaccaccgctgttggacacggtgttaaatagtgcatagcactgatgtgtggtgcagtgaatttgccatgcggaatttagcatgaattaaaatgaatgagcacttgtctggagaaaggggaagagatagcatctccagccttcgtggggacagatgaaattccacatggattgcttcatcaccctggaagctgcgtgacctctaacatggcatcagttaatcgtcccaaggctccgagcccaggtgctttggggggaaagcacagactatgggcctgaaatgacaaggtgttgagccatgtggagcctccagctgtgctttcctacctgagactctctctgttctgaacatgagatgtgaaaagcaccttgttttcaggacaggtcagagttcaccgacttgggagttgaacagccagactaagtattcagataacactccttcattaaaagtgtcaagtttccgggagatcagacatttgaaaatgatttttctattcattttccctgtatgtgaatttataggaggatgctaggttgggtaaggaaaaaaaaaacaacattgaatgtactgtatttatattaggtgctgcttgagtgtagggggaggctaatgtctgcatagtttacaaaattccccactgctcagccttatagcagtgatgagatgaacccatctatccatctgtgtgagtcaagtcaacttatttatgttgaaaattttagtggtgccggggaggacagtgtgtgaaatatggtgatgaaggccccaagcccacccatggccactggtcggactggtcttcttggtccccatgctccaggacctgcggagggggagtatctcataggagtcgcctctgcaccaaccccaagtaagtatgccttgacctccttcctcacaaacgactgatttccatgccatgaaccctccaagcagtatgcctgtgtctcagctctttttttttttttttttttttgagatggagtctcgctctgtcacccaggctggagtgcagtggtgtgatcttggctcactgcaacctccgcctcccggattcaagctattctcctgcctcagcctcccaagtagctgggactataggtgccaccaccacgccctcctaatttttgtatttctagtagagacacggttttaccatgttggtcaggctggtctcgaactcctgaccttaggtaatccacccgccgtgacctcccaaagtgctgggattacaggtatgagccatcgcgcccggcctcagctcttaatagcaagcctgtactgtacatataatcgtaagaagcactgaataggaaaggtatttcactcaagcatttcttaattacctctctgtgctataacttaagatgcttataactacctgaccacagcaaaaaaataacagcagcaacagtgatattcaggaattgaattttaaccacatttacttgacataccaaggatctgcttaaaacaaataaataaatcataagaaaagtgtatagaatacaaataaataagatcagtaagaacaatggttttacgtggaaaaaagcaaatttgggggttttccatcaaatatatttaccttcacaacaggaggtttaactgccagcttctgtaagaagtaagaatgaatgtgagaagcatcaccagtgtgcggaagtgaagaggctttaatttttaattttttaaatttaacttttatttcaagttcaggggtagagtataggtttgttacataagcaaacttgtgtcacgggtgtgtgttgtgcagattatttcatcgcccaggtattaaacctagtattcattagttattttttgcagtcctctccttcctcccaccctccaccttccaacaggccacagtgtgtattgtttccctttatatgtccatgtgttctcatcattcagctctcacttataagtgagaacatgcggtatttggttttctgtccctgcgttagcttattaaggataaaggtctccaggctccatccatgttcctgcaaacaacatgatctcttccttttttatggctgcatggtattccatggtgtgtatgtaccacattttcattatctggtctaacattgatgggcgtttaggttgactccatgtcttcgctattgtgaaggtgctgcacaatgaacattcatgtgcgtgtgtctttatggtagaatgatttatattcctttggatatatactcagtaatgggattgctgggtcaaatgatatttctttttgtaggtttttgagtaattgccacactgtcttccacaatggttgaattaacttacactcctaccaaagtgtataagtgttccttttcctccataacctcgccagcacctgttatcttttagcattttaatagtagccattctgactggtgtttttcacatctccctttgcccttaagcttgtttaagatgtgtcacttggcttgttgtttcagtcccatctttaaagcatgagctcacctcaccccctacgccacgctgtaccccttgcgctgcccgcattaccagtgtgtacatgcaaattctctggggtgagctgtcagtgccaaccagcaaaggtgactggttctttagtcttggtctttgggtcctggccttgtcaccagaagactggtggtggaaagaaattttggtcttgaaagcaaagtcattgaacttccctctgagttccacattctctcaaatgtgctatcctgggaaagtgtggtcctcctcaatcagcccctccctgtgcagggtgaggacagccctgcccaccctgcctcaccactgcagaggcactgggcccagagaggagcaaagacaggccagcctgccctgctgctcttgtaaaggattcactcaatagaaaagggagtgcaaccttaccattcgtgtgtaagaatgtgttctagaccacttagaaatccacttttccagctgggcgtggtggcttctacctgtaatcccagtactttgggaggttgaggtgcacggacaacagggtcaagagatcaagaccatcctagccaacatggtgaaacctcgtctttactaaaaatacaaaaattagctgggtgtggtggcgtgtgcctatagtcccagctactcgagaggctgaggcaggagaatcacttgaacccaggagacagcggttgcagcgagccgagatcacactactacactccagcctgggtgacagagcgagactccatctcaaaaaaaaaaaaaaaaaaagaatccacttttttcctaattacccattctaacactcttagcttcatctctccaataagcctaattttaaagaatttagtagctactaaaatataaaaattctaacttcaaaatacacattccaggccatcgcatggagggaagttctgtgagggctccactcgcactctgaagctctgcaacagtcagaaatgtccccgggacagtgttgacttccgtgctgctcagtgtgccgagcacaacagcagacgattcagagggcggcactacaagtggaagccttacactcaagtagaaggtaaatctcaaactgctttcgggtaatagcctcatgctttactacctttactttttaaagaagtacatgattgagagtgtggtgcacaaataaaccagacgtcgctctgggaggtgagggtcgcatattctcttctggaggttagttttattttgccagccccaccatcacgacctcttatctaaacttcaccagcggtgaggtcagaaatcaacacaccagatagaaagcgtgtgcataatacaatgaaactcatcaaagaagtgataaaaaacacaaagtagatcctgcatggaaattgaatcagtatgtttttgaattaagaattacagtagttgttgctataagcaagttacccattgaatacttataattgtcaaagaatgaaaaagaaatttcagtatattttagaaaatggaacaattttgaagcatagtatgttcagaaagtcttgatctataactatacaccaagaagtttatttgtggcatgtataagactttactccccagtgggaaagaaataagtgttgttttcatgattaaaataacttaaagtcagtagctcaagtggcataattaaggagaaattcaaagaaaacctaatcatctcattgcttgaaactgggaacattgcccgaaaaaatgacagaagccctttggatgtacataagtgggacgtcccatctgacattcccattcatcatctcagtgcatacagtgttttcacagtgtcaggttcatgcagttagaaaattctgaaaggaaattacaagcaatttcccggaagcatgtttggttgtccctttactcctaaatctgtacaaatgtagccagtatgatacaggccactagggaggagagaaaggtagaatgaactttgaaaccgtggttcaaaaatgtgtgtgtattcctcctgactgccaatcttcagtgaataagctcattaatcatggaagcacacagtaatcatggacgcacacactaaatttgattcttagaattattcagttgggcctcttatcttgaatgataaggaaaatatctgtagatgagtctcaggcctataaaaatttctaagacagatgaaattttcatcattaattgtccctccccttttttttttaccaagaagagaacaaaaggggcaaaatggtttgaaaaaaagttcatattaaatataaaccaaaaaccttgaaatggattatttaggaaggaagtaaacttcctatttctctaggtaccaatattttaaaacagtttattgtatttgtggaaaacattgttctcgagacttcatctaagttattccttttattagtttaatttttatgtattttaccaaatgcgttaagaaattcagtgatgtttttgattcttttattacattttatctgtaagaattttgtgtgttactacaaaatggcagtttttttttttggatttctacaagatagtagttaatgatactagtgaaatagtaaagcattaatgttgtagccaacaaatatttattgaatgcctactatgtgccaaacactgtataaaaatcaaaggtcttaaaggacactgtagagtaaaatttaacattgaagcaataaataaatttaaagaaacaaaacaaaacataatgaggcaaccattaaaaatgccattgtaatgtattattgtgtgggagttattttatgggggaagaaagaaagtctatctaaaattcagagcaaaaatgatcagagcttaagtatttttcttatttgtgtttgtgtgtgtatttctttttaagatcaggacttatgcaaactctactgtatcgcagaaggatttgatttcttcttttctttgtcaaataaagtcaaagatgggactccatgctcggaggatagccgtaatgtttgtatagatgggatatgtgaggtaatcatgatccttcattcattcaacaaatgattccggacagtctgctttgtgtcaagcatcctgtagaggctagaaagactggacatatgagacaagcctttccctctaagttgcagcccagtggggagaaagccagaagaacacattgatgacatgctgctttgctgcagtggaagtgtgtgcagagcataaggagagggaggggcccgttctgtcttagatatgggtctgggacattcgtggggctcctaggagaagggaacatccacatccaagctagatctgaaagggtgagttggaagagggatgtcaggaaaatagagaggggacgtggtggtgccagatgcatgggttgctagccactgattcagtcatcagaacgcccagagggaaagtgggggactgggggatgctgtgggaagggttggggtaagaagagggtctccaaggccgactccaaggctggataaggagttgggatttttatcctgtgtccatgtagatagagcaggcattgagtctgggaacagtggagccacaggatttggttgcggtttgtgggcagtagtgtggagagtcagtgaagcaggggtgggtgagagcctgggccacttcgcagctcggacagaggcctcagcaacatagagcagctacactttcactgaggagggcgggcagacagggatgcaggagacaagctggggaagtgttggtggctaaaggaacttaagtgactgatgttacccttaccctgattggcagagggaaggggtggaaaaaaatgttatcataaaccaagtgaaggtgttagcagatcaaacacattgcatgtagacaatggggtttcaaatgaagaagtttttcaatctgcatatcctacggagtccaaaaacatcttttctagttctcgcttcccctaaattattgaccatggtaaagttgaatcatccactgagatccttagtgtaatcattttgaatacatgagggttaggctggatgattccattaagatctctttcattgtacctcagctgtacagtcctcaattttgtctaattgttaattgatgtgttcactattttattgtattttggtattcttaatgatatagtgtcataatcccttatttgtaactctgaaatccaaaaacctgtgaaaatgtgggggacctgaatttgtttggtggcaaagcctgccctgaactgatgtgagactactgattggttttatttatctcacttactgtaaatctgtagggttttactatagaaacattaattagttaattatgggatgccaccctaagcccttgtgggattctcatatgcatttcatacgtcaccttttagacataggtctaaaattttaattttagaaaggtagtatctattacctttataaaattaaaaaacactgtaagttgtgaaatacatctggccctatggatttcaagccaagaattgtagttattttgcttctgaatggattttttttgtacatatagagcctattctctttgttagaaagtgtaatacaaacaaacatcagagtaattttaaagagctcctaaaattctaaggaagtgaataaacatgccctttatgtaattactactgaggagaatttctgtgtgtcatctgctccttctctgtcattgcatgagacaattaaagcccacaatggcatattttgttagaaccttgtgtagacacattgcttgtcattgtactaagccctttaggtcagtgtgaaattcacccatcgctccaacatgacaacctacaggtttaatttggggccacttgtgtaacaatactaaagaggacaggttacggttcacggtttaaaagcttcctacatttttgaagggtaacactgtagccccgctgtgcacatattaggtatccaataaatatttgttaactaccctatgttggtgaaattttcaactctagtggggaggaggtttcttgcatgagattggtgacagtattgctgtgttgtcctttctttcatgaatgacatgtgacctcatgggccctccagagagttggatgtgacaatgtccttggatctgatgctgttgaagacgtctgtggggtgtgtaacgggaataactcagcctgcacgattcacaggggtctctacaccaagcaccaccacaccaaccgtgagtactttagagctgcctgcaagccttgggcaaagaagattgtaactggggcttcttagcagagcttgaggtgacagtgaaaacagcaggacttccttccgctgcctcgcttcctgcctcagctggcgctttgcttctcgagcctcttgctttgattggaagtggttgctgagttatttgcaataaaattgttcttaggaaaagtgaccatcacaggggctctgctccaattgataaaaagcagccgggtgtagttctaaggcaactgatcaccagaacacgtcttcacccagttccaaatgtggattctcaggttttgtttaccgaggactggggttgcttagagattttgcccctgctttctggaatgaaaagctgtatcttccccatttcctttatctagagtattatcacatggtcaccattccttctggagcccggagtatccgcatctatgaaatgaacgtctctacctcctacatttctgtgcgcaatgccctcagaaggtactacctgaatgggcactggaccgtggactggcccggccggtacaaattttcgggcactactttcgactacagacggtcctataatgagcccgagaacttaatcgctactggaccaaccaacgagacactgattgtggaggtaaagtccagcctcttgattttggggcttggattttgggggtgttctggtgtctgtgtaagttaatggctgttggcataattttaagaagaatgtaaacagttataaaaagagtgatccatccatagccggaatgaggcagcaggcttgtttttatcatcattcactttttggtgtatgattacgtttgtatttaagtgctcacctgtgttcccatttgggggttttagcagtaggtgtttgcagaagtcttcttctgtcctgtaagctcgatggctgtgagatgcggccactcttgggggagggaggtggggtctgacttcgcctgtgtctggggtgggatcagcatttctgctgcgttctgtggcaataggagaggagagcccagaggtgaagccccttgctgtgtgatgacctacctgtgtcacagcattgaccttggcgggccacagctccgcagtcacatcaacccagtgtccagtgcgggggtcaccccctgaaccgagcagttctgtttactcatgaatgcagaggctcacaaaatatagtcagattctgacaacaccatcctcgcatgcgactgtgcagatggcagtggtgggcagtggatgttctaactccccaccttgttatgtttctgtgcacagttgaaagaaggttcttggttcaaaagttgccccatccacctacaccttgctgtggaggtacagccacctggatacccccacctgttccctgggacaggccgccctatcccatcctcttgcgtcttcctgggagatgcctccccaggcattcggggtgtggtttagatggagcagctgctgcatctccacaggtcctacttccatctcctgtcctgcccctgaactctttcatcctatccctttataaacaaatttatcttgaattctttccttgatcaatttatcttgaattctttccatgatctttccttgatcacgtctcccaccatctaaggcttttagctttaacaatcagagagaaagatgcctccgggttgaaaataagtggggcttgttaggaaactgttctccacggaagaagagttgcagagcctcagaatgtcagggctggagagtatctcaatggccttgcagtgcaaccccctgtcctgggcttatacctgtcccacaacatcagcaccactgagactggagctgtgtcatcaagcagagggtggagcatggggccaggacactcaggggagggtgaggatctttttctacatgggcatcatatcagcatgcaatgcctgtcaggtgcaggcatgggatttatgtcaacaggttatggtgagttttccagaaaagtcttccaactaagattcaaggatctaatacatttatgagagaaatggtggctggtccatatgattgggtttcaagctaggaaatgtagagtccaaacccattccatgccctaaactatgactcagtgatcttctttactaataaaacaccttttcctgcggacttaatgggtacctgcccgtaggcaaaagtccccttcatctctccccatagaaagtgctctaacttaactttggtcaggcatggatcatacctattgctgttgaagtgtcctgcgttatttgaattcaccaggaagcatgacgatgctttgtaggtatctctttctgatttgctcagatgcagggatttgcaggggatccctcagatgcagggatttgctcagatgcaggggatcccaaagaaacaccaatgagatagccaaatgcttttgttaggatgtatcagattatcacatatacccccaaaatatgtgtatctgttatgtatcaataaaaaatgataacttagaaatgctttttctaagttgcaaaagtgtttgaagttttacatgcgggcatacactaactgtaaggagaaggtacagtctagacatttttttagatgagcttgaatctagatgggagggttcagaaattttatgtaaagtttggatgatagtctgaatgtattttatcatcataacaaacttcttgttgattgattattgttttaagtagtctaaatcccgttagcatgtacttgctggttttgcattaatttgttttattttttcccctttcttattttgtagctgctgtttcagggaaggaacccgggtgttgcctgggaatactccatgcctcgcttggggaccgagaagcagccccctgcccagcccagctacacttgggccatcgtgcgctctgagtgctccgtgtcctgcggagggggtaggtgccttccagtgctgctcctggaggcagcatgtcagccttcagccactgcgtacattgcactggcctttcttgaatcctaatgagcagcccggggcttctccctgccagtagcagtgacattcccaaggtggggagtggtggtcctgagtgtcacttgtcggcccgagctgccttctccagtctatctgcttcagtgtgtgactctgaggaagtcagtagatgcattgcttcctactttccatctaatttaaggttttttagaggatgattttgttaattgagatgagtcaaatgaaagtcacggtaattatgagatacatcatgttgacggtgagaaacagacactaccatggaaaatacactgacctagagtgggttttttaatctaactaatcttgttcaaaacgtttcctggaaagagctttgcctgcaagtcagatagtcagatttgtccagaaaataaaagaatattttgaaagttccaatgaaaacatcaagaaaaaaacatgtcaaaaagaactgcacatgtcaattgagtgccttgtcgccttcatactgtaaacaatggaagctcacatttatatcggtaaagctacttccacttaaaggaagtttttagccagagccaatatgtactgactgtctgatataaacagtgatgagtaaatatttgcaagtttaaaacaacatagtaaattctatctgatatgtataaaatacacaagtttccatctggccaaatggatttcagctttatgcaatctaggttttcataactaagaagttaatttagacaatattatgtttaagtaaaagaaaatggttcataaatgagaactggcataaagttaagaaggtagtgaatgaacaaaaataaataaaaataaatttacatgttctcaatagttgctctaaataaataaggtgaagaaactaaaggaaaactgaaagattaacaaaaagtttaaatagtcctaaaagttaacactatgtgcttgacatatgttcattcttcccagtatgaactaaggatgaaatagttaaattatggatgctggtaaagctaatgactgaatgaaatactgtcttaggaaaaacatgactaccttctgcacagaaggatagcaagcatgttgctctaatagtgaccagagagaaatatgaaggaaatctcacactagtgatatggcccaagtcagccaccagtttactttatttagaaagcagtggaacagaaggacattgtatgctcttctctctgtgtgacgtgggacattcctaaccatatgtatttttcctttcttttccctctgatcttaaaaccataaccatgtttttatggattatgttgaatgcacttgattttacctctccctatttaggatcttctaataaatagtagttggttaggataataatagaatcagaaaacttcatatttgtttaaggaaagtatgaatttttgaactctttcttgtacattttcatttggtaaaaaatgtataatgaattccatggaaacatctgtagagaatggccagtcgatgattctgtttcaatataccagattcactggtgtctttcctttgagcatcaagcattcaggggaactcagtgttctcagctgctaacaggctagttgtttcagtatcctgaaacactgaatggatgattagtgtatttgcaagtcacctaactatccctaaggaataattgagagtttctgggggaaatcaacccaaaatccattcccaaatcacttttctaaagagctgcattatagagctagtgagttctgtttgtttttaatttcagtggaaaacggggattctcaattcaacagcgggatggagtacaggatgtctgtatttcccacattctgtaggataatgctctgcagccttccttgtaaaaacctgacctcttcataggacagaagactcagaacctaatcaaggcatgctgtcactgcccatgtgtgtatcattaggaaggggaacacttgcaaatggtatcctgcagggtttgaactatagtcgatcctcctctgttttcgtagatggataaaaccacagcctttctctcctgttctctctctttccttccctagtatccccagaattactttctatagaagcaagatgaaagcaagaagcacgttattgccatgtattgagcacctactatgtgctttcacatatattatcttgtcaaaaccttcgacagggtaagggtagaaagaccacaggtttgaggcagccatatcagattcaagtcttggcttcatcaggccatgctccttagaaattttgaacaagcctttcatgtctgtgaagtttaaagattgtatgaataccaatgcctggaagcaatccttattatcatctcagaggttacaggtaacttggttcaaacaggtttactgactcccattcttatgtcaccccaccacagccaaactgcaacttagcacattactgatgttcacattctttaacaaagattattctgccagggaagcacaacgtgttcttcgaacttcctgtcttcctttcataatacagcttctacctggcaatgggcgttgcagtccattgaacataagattgaaatatcagcaatgaggagacgaccttacacgtaggcggtgctcatgtttcatggccattcagggtgaaggctgatcttcttcagttctggtattcaattttcccttgatctatgtttggaggacttgtcaaatttcccccaatagtcttaactaagatagttattcactgaatgttaattacagtgactgcttctgagataagggcttttatttcccaagatctcattactcaattttaagtggttattttgattaagcactttttcagaatttactgtctctgccttgtaaactttaggagtttcaggatttgatgctatccgatgacatagatcctttggaactaaatcctcaattactttaagtttattaaatgcttcattaggtgtatcccattggaggcttctaaatttcaaaagttaaatcagatgatttaaattatgtggtatctgacaatagcatgttttaactgcttggatgattgatattggagggtgaaaatccaaaatgaatctcattctcagtttttcaattttgtgagataataattaactttgccaatgagcaataacctttgattattgttctcatttcttagagggtgaggtcaatgcatcacctgaaaattcttgacctgattcccaaaggaaaagggaaagtatagatggtattttcctcttatctgcatattgtataatttttaagacttctacttgcatagacctcctgatgttctgaatttgaaacgtttaaatcatctttttcttagctctctctttgagaatttaagggtctacgaggggcagttatggaattcatgaatgggaagaagacagctggaaaatttctcccacctcttgcttcattccagaaacattactttgcatcaaaagaggacggataaatctttttgatttaaagagatctcatttccttatctcttacaatgggcccatctctctgtaggaaataaggttttcacacagccaggtaatgccttttatctcccttttgacagcttcttcttcccttttgacagtttcttttttctctcctctcacttttatgacataactgcattttttaatttcaatgttcctgcttcgtcatgctctaactggactctcagtgagcatctggggcattggtaatgggacataaaactcaaatagggaaacagcatgccaagaatattgcccagaaccagtttatcttattgtgtctgtctctgagacagagactttttggtgtggtaatgacttcactagacttttgtttaccttgtcaaaacatcagttttttctcaaaattatatacgctgtcatcttttaaagtcagtatctacaattcacttggcccaatgtattccaaatcactaatcttcaacctctgacttatttccaaataaaaatacttattaaaatttgacctgtgtcttaaattgtccaacatgtatgctgtaatgtctggggatgatgtgtttttattcaaatggaaatattcatccaattcacagcaaaaatttctcagacaaatcttaaactggcttgaaaaccatcctctcttacatttttttcaataatattctcttcaccatccacagatatttctagggcttaaggtttaattcatttagggattaggtttgaaaaaaatgattgaaatcgcttgcaaacttgccttactttgctgatatcaaaccatccatttatccattcattcattcatcatcagtcagcatatgcttgggtgtttggatctgaaccttaaacatcttaaagccacctgaggaaatacaagagacttttgcttgatttcttctctatctgaattgagcaatgaaatgccaaagtcggtgttgctttacatgaaaactatttagtgcctctttagtgtcatagctagttgaggtattgtacatttgtgcatcttaatcggggaatcgagtacttcgatccagtgattttttcttaaatgtgcgagccgctatgctgagttcggagtgtataaggacagatggtatatacttggccctgtcctccaaatcatttgcagtctggagcaaggagttacccatatgcccatgtgtgacaatgcaagatgatagactgcgttgtgttccaagaactgtgagaattcagagagatctccaggcctgtgggcaggaagagtctcagctcagctgcagttgggacgcctgtcttcctctgagttccattgctgggatggctttaaagagcagcagtgggctttggttcctactgctcatctgattggctaacatttctccatctttttcacaggaactgcttcaaatgagatcttccccatcctcactttgtgtgctagaatgttctgaatcccagagtgggtgtgtctctttctcttttaaacttcagctaaagggttgggtcccagagttcaacttgaaatgattctggtttcttcttccctgcctttggtcacctttgagctgatctactaaaaacgtctcccgttctttattctttatctaagtccctataaattacaaaatatattacccccccgccccccgatcccaacccctttcttcccaaaaaagcagagagaaaaacaaaggtttgtttcccagagagtggggtgtattcctcaggggcctgggctgtgtgatgtcacccaggcccatttcatcaagtgtgctcagaggtccagggtaaaacaaggaagcccacatcttcccaaaaagcaggaattctttcccattcccagagtctgtgcagttccagcaagcctccactcatcaggggtgccggggtccctcccacgttcccactacgtggccatggcctgttcttctccaccttcgctgtgcaggtcacttgtacccacaggtcttaacgtctgcaaatttggagccctaaaaatgggcgattactgcctatatccagatgggctgcatttccctttgccattgacaagtcaaggctgtcagggaaatcagctagtgaagccagcccctgtgaagcagggaatctgcctctggtaagacatgtgaaggtgcctcagcctccaagctctagtaaatgttgggataacatgtgtccacagcaattgtgcagggccagcctgtcacttaaatacactgggaaccattcagaatttggactgcatccaggaatacacctttgagctatcttccctcttccgagttcaaggtcctgtaatgcgcatgcatgaggcatcaataatatatctagcacatgtgatagaaacaatgcatgcttcttttgagagctcatgcgttcatttatggaacaccgtctggttttccatgtaattttgcttacagaattcgtttgattttttttctttttctttataaaaggaggataaagcttttggcaacagctggaattcattctatagttcacattatggaaaagtcagcaattttttgatgaaatcatgatctttcagacttaagactcttcttctagacagcctggcaaacatgaggatttttaagcggtttccaaagacctggccagagttggtttctgaaaaaagatgaaagcagcgcccaagcacattgctcatcaaactcaccaccccatgggcagggtttgtctttccacagctaatggattgttctctccaagtttcttacattaccttttgaagcttatgcccttcctttctcttatctattaatatagatcatttagaaaattggcctgcgtgattctggcattcaaatagattctgtgatttttctttctgacaaagttaagtgattgtaagtactgctgagaagttgcttcatggacgtgccattagtcagagaaataatacctgagtctccataaatgttcggagaagtaatatctgagcttaattgccaaggaggctctccattccatcacgtgagatgcatctgaaaacataatcatccaaaatctggtataacaatagaccttggaaagcctcaataccagtggacatatggctgtctgtacatatttttacattctcagaatattcagacatttggaattagtcaatggaataaacatttaaattcacttttgtgtcttactgtttatatggcttggtatattagggtcctccagagaaacaaccaaaaggacgtatctgtctatctgctcatctatctatgtagagaaaaagagactgattgggagagattggcttacataattcactgaatgcaagctaaagaaacaggataaccagagaggtgtcttccagtctgagtctgaggtgatggctgaaggagaatgctgtgagtcctggagcctgaaggcctaggaccaggagtgctgatgtcaaatataagaacttaatactttaggtctaagtagactaatccaagatcttgagcaagcaaattacatgtgtattgtcataaaaagtctctgattaaggacccaagaaaaaccctttgaaaacagacagagtatgcaagaactggagtgtagtttcttttgcttaatttttagttcttgcagtttttcctacatgtgaggcggacatgtaagaagtagatgtcttattactggataatggaaacacggattggcacggtgttctgaacatgagatgggagagtgcccttgactccctgcatgagacccgtgaagggggtgactcgtttactcagccaccctgctcaatcccttatgagaaggagcacacaagcagatgggtataggaaccagagtgaatgaacgttggaactggctggtggctcctgcgtggcggaagcaggctttgcacgggccctgcagtagcatccaagtgtgttacaatactctctcagctctgccatccaggaaagggtgtctgcgacccctggagccccagagggcctgtgttacaatcagtgctcttttagcatttgtagactgctaagtattaaccagctcagtggagggtcaggtgacagccttttacaccctgccctcttggtacccgagttcttgtccagcgtccaggaataatcatgtcacaggaacaaattgaagggtggtgaacatggaggactttactgagttgtgaaagtgactctagtgggaaagggaactggaaagggggtggagtgggaagataatcttcccctggagtctggctgtccccagccaaactcctctccaaccatccctggctgaactcctttccaaccatagtctccaatgtccagctacttttctcctctcgatgttcacatgcttctctcttccgtgtatgtgtgtgtccactgagtctgaggtttggggttcttatgggcacaggatagggggcaaggtgagccaaaaggcaacattcttgcaagaaaacaggaagagttctcactttgcgctgtgggtccaggcttaagggtggagccctcaccaggaacctgccatcttctacccagtatttccctgcctcctgttcatatcaaatagacaacagaaaagcaagagtttgagagaggatttagggagaaatcctataggggaactgttctgataggagccatgcagaaaataagggacaaaatcaaagatatggaagaagaaatctcaatgtccctggccagcctatgacctcagattttcaggttctccaaccaagcaaagaccttctgatctcatgtgtttcccaatagtgctggattaaccatgaaaaatggtttcttaaagcataactcaaacctactctttagtaacccaaccatgtgacacctgtgtgatccctgagagctcaggtatgagtgttggggcccaggcccaggagcaggaccctggtgtgatggatggtgtggtggagagggtgctgtttgggactgacttctattctgccttctgctaagaaaggtacttgaactggttcatcaccctgtctgtctcttctctctgtgtgtgtgtgtgtgtgtgtgtgtgtgcgcgcactcctggagaggcacagagatgtgtgttttaaaggggcttctaaggtctctccagtttgatattctgtggtctatgtcagtcaacaatatataagatgaatcaaagtaaaaccaaatgtcagctgcctggtagtccctgactccttcctccctccattcgtccctttaggcctttggattcagagtcctcggggcagtcaggggaagaagaggccatagcagtggtggacagagagtgtaggcagataagaaagttcagagcagtcggggcctcctccccagtgtccttgagccaagcctgcccggggcgtcagcaagacaggatatccaccttcatgaaggctcaaatttgcaagttttgggcatgtttttcattgcgaatgtcataaataaatggaaagtaaagaacacaaatcattcctgagacacccctccttgaaagacatcactgtaagcatcttggtgcacccattcggtctctccctccatgcacagctctgcaaatgcataccttcctagtgatcagctttttctatgtcactatgtcatctgtatccttcatttgcagagagtttctccttaggtatgagcatgaacagcccacttctaatgtggcagctcacattcttgagcaattatgaatatatccaagtgctattcctactttcaacagactataaacaaataatgcttctatactccaaagaaagttccttagaaattacaaatattggcttcatttttatggagagtgtttcaaatggggtggtttctaaaagtctaaaaccttttctgttgggaaaaccctgactacaaatatgtgtgcatgtgacacacacacagagatttttagttttctgtggcacagagactgaagggagatggagttgtaaagattctgatttcactttcatgaacctgggtgcctaccaggggtaagatcactgtttcagaaatcttgtggaagagtaactgagatgctctctgcatcgtaggaccccaggccagcagattcagcatcacttgggaactcctgagaaatgcagattctcgggcccccagcccagacctactgaatcaaaagccctgggcatggggccaagtactcggtgctttttttttcttttttttgagacagagtctcactctgtcacccaggctggagtgcagtggcgcgacctcggctcactgcaacctcccgggttcccgccattctcctgccgcagcctcccgagtagctgggactacaggcggccgccaccacgcccggctactttttgtatttttagtagagacggggtttcaccgtgttagccaggatggtcttgatctcctgacttcgtgatccgcccgcctcggcctcccaaagtgctgggattgcaggcgtgagccaccgtgcctggccgtcggtgcttttaatactacatccccgtgtctacaatgcacaggaaagtcgctttccattgtgttttcaccaggggacttctctccaaacacatcctgtgcaaaggacactcaccagtccttggcttgtactccagggagcccccagagagatttctggaatctctggcattcagaagtcacaatgagaaaatgattgccctggggggaaaactgcattttaaggaaaacaataattccactgaatgcagcagttaattttaaagtggcatttcagggattgggatagggaaaggcccacctttacgacctttgaaaggtgagtgtagacgccttagtgcatgggggtgaaaactgaagacaagggcttccctggagaactcccaggatgcaagcctgaggatcattagcggaccgcccccctcatatgactttaatcatggtaattttgtaaaaagaggaaaacaatttctgttaacagaatcccaaaccctactgatctttatagattaaagtcaaaactttaccctcagaagcaaattgaaagccaaacccatgatggaatatgctgcaataggttccatatgtttttgtctccatcagcctaggtctctgcgtgtacaccaggcagtttccgtccccctatgcaggaaaggccatgccatatgtaagcatcagcttgctcccaccaccttctctcaagggtcccctgttactcatcttttcttgtctttttgccccagaggggatgcttctctctaaatgaaattctccactggtgctctttatcccattatccacatttcttatcatcaaatataccctctttttcattccatgtcattcttccctctccttcccaaccattcctttttcttaaatgtgctcatgcctccataatcttaaactcttctttctcctacttctcttcttccttctttgcttttcagtgtgaagcctgtgaatgcaaaatatctaagacaggtcttggtcaattagaaagtttattttgccaagattaaggacactcctatgacacagcctcagaaagtcctgagacatgtgtccaaggtggtcagtggtgcagtttacttttgtacatttttagggagacatgagacattaatcaatatgtgtaagatgtacattggtacagtccggtaaggcgggacaactcagagtgggagcttccaggttacaagtagatacaagacaacaggttgcattcttttgtgtccttgatcagccttccactgaatacactatttagtctggctcagcacttctgcatttttacataaacaataggggtgaggaagcaatcagatatgcgtttgtctcaggtgagcctcagagggatgactgacagaaggggaggcaggtttgccctaagcagttcccagcttgacttctccctttagcttagtaattttgaggtcccaagatttattttcctttcacaaggttttcatcaatgcaacccgcacttcctgcttgcgttcccacccagggaccaccaactcatccctagtgcctcagtttcatctctgcaacccacatcttcgaagattctccaatccagaccccacctggtcaccacatccacaggctctttctcagcacttcctccctggcctccctgcagccttcgacagctggtcactgctcccttgaaacttctttcctctggacttccaagacctgtttattcccatgaatgcggatgtctaacaagatcagggccctcctttctttgtattctcccttagagtgatggtttatcgaatgcttttccccaccatcactacccaggaaagagcttgtgtcttttcgcgtgaatctctgcctctatctctgttctctcgtcagtcctacacctacggtggcctgaagggcacctttgcttggtttgccccattgtagcgaattcacactgtcttggcaacaggggtcatttcccagttacctcaaagacttctctgggctttttacattcaggcttgatttttttcaagttacccaagaatctctgatcattcatcttgctctccctgtttctagtcctttcttttccccacttccaataatcagttatcagatccatcttaacacctattctcttgagcttcctagatacataatcataccacataagctttcccgttgtcataactttcatgcgccctatattcttttaattttgtcaaattgtgtcagccagcatctccaaaataattttaacttataataattttttttatttctgaccttaatgggaatatttctaatgtttcccataatgctagcttctaggtttaaataaacatacaagtacctatatttatatatgtagatacagatatacacacataaacacacaaactcatacaaatattcagatatattgatgtgagtaaatatccatctgttgtctgtttcattaatatttttataaaaaatagagggtaaatttatgaaatgctgaactttattacatttatggagtttatgtttgtcctttaatccattacatggtgaaatatattaacatattttcttgacattgaaccatccttacattcctgctatgaatcattatctggtgatttatttctttctaatatgctacttgatcctgccttctcttaatttatttagtatttctcacattaatactcctaagtattattgagctgtagttttcttttgtgtgctaaaatatactacattaatttctataagtgtattttttatgctctggaacaatttaatagctttggtgttaactatctcctagcatttggtaaaatatatttgaagcagctgaatctgctgctttttgaaggagttagatctttgatacatttttatattattatgtatggtaattggactacttagattgtttatcccttctggaattagtttttctaattaagaaaaccatctttttaaatgtattatttaaaatttaattttatatatttgaaaagagtatcccattagattattttcatttcttctacatgtaaatattttcttattctcatttcttatcttgcatgtttgtacttactacttatattcttcatgaagtcaatgtatcagtgacagtttcaccaaaaaaatagaaacctttctaggtatttcaccaagaaaatagaaacctttctaggtatttcaagcaagaagttatttaacacagaggatttgttgtttacaaaataaatagagagattgaaagagtaaaggccagacatctgtagctctcagagttactccggattttgaaaagtcagaaagttgcagaaaattttagagatcattggtgatgattacagataatccagcactggagcaagtgattcccaggaaaatgcttgaagatggccacagacctttgcatctgccaaagcccatccttacatccactgcttccagagatgggagcatgtggcttctcactcctccaccttccaaatctcatgctagtgcctctgattagtgggatctaactgaaagcttcacagatatgagagttagaaaatgtactcctgatttttagaacctgtgatacagaggagagtgtgaaagaagaaggtatgcaaagttgtatgttattatgttcaacatattgacctctgtttctaatatattgacttttgtttctatatcagatccctctttctgctttcttgggctatcctttatttctaacatcctaattaaaaatatctggttcacttatttttattcttactcatatattgacataagtatttaaggccatgaattgtcctctgaatactgctttagctacattccacagtttatcttttgtagcattttcatcattattttcttaagtaagtttttttggaacctgctacctgatcttctttttgctctatttctgttaattgctaaaactttcaaaggaacactttacattcctcttttatttcctaattatatacttaccttatgtgcttttcatccatcagcattctcaactgaagattctactgtccctcataagaagcatttggaaacccatggcagtattttagttgtcatgataattgggagagcgatgctactgacatttactgggcaggatccagggaagctaaaagtcttgcaatatgcactgctgtgctgcataacaaggaatgttgttgcctaaaatgctagtaatgtctcattaaggaaaacaaaagatttctaaagtcacagctaagacataactggccaaggcaaaacttgcacctgcattggataaacacagtgtttttcattgagttttaaatttttttactacattgttactaaattatcacatgacttactagatccagacttccctgttatccaattaacaggtaaatttctgggacttggacttgggactttgcccacactgaggcagctcaagagtgaagctaaacaaatgtctccaataagaaagaaaactaaggacattaataaagccaacttctgtttctatttcaaagcaaaacagattccttatttgcttagttaagagaccgtaccttgtgcagaatcatcaatgatcataaaggcatgactctttgttcagacttgaacagaaggtttgaatttcacatgtttttaatttcaaaacaggaaaccaaactgaagccattatttatagaatcacacctcctaaaaagccgtaagagtttggttaagaattaaaaaatggactttaaacttgaaaagtaagtgtaaggaaaggaacagattaattttcatttgtattcattagacttctaacagttttagaaaaatagtgtggttattcagtatgtttcttatttaaatcgggttatcataactattacacttaaggaagtccgtaagattttctgcagaacatttttaaacaaacatttgtttctttttctaatttaatagtctctcagccctagttagcaagtggaaagtaggtccataaaacatcttcatattgcatctcaacattaatgcatgagtcagtcattgaaattgtgccccagtttgcccttaagtaatacataaagaaaagaatatcccctattttgataatgtttggggggataagtattagttaatccactactaacttgtccaagcttatataacagaattatccagtggctcaaaaactacttaataagtgaagtgacaaactaatccatgcatgctactgaaattataacaatgaataacacatgcactctgcccccaagaaatctgttccaacagatgacacacaaatgttaacagaaccttataattagagtcaccatgtaatgcattactgggatgcaaactgggatgtaatgcaaattgcgacgtaatgcaaactgcaacgtaatgcaaacggcaatgtaatgcaaacaactgggatgctttgagaggaaatgatgttactgctatcatttttcagggcaaatgtgcataaagctgagctagccggacatgagctgtttttattcacagcacttctgacaccaaattggtggggtttttccacactaacaaccagttctccaattctctagatgctggcagcttggtgtcctacaattcagttcagttctgatactgactacctggaattagcatcagactccagaggattaagagctcaattccccaagactttcctcccctcagatgccagtttccagtcttgagtctcatgggtacccacaacttgcctacaaagtcaggggttcccacaggctttccctttcaggtttgctaatctgctaaaatggctcataaaactcaagaagccacttgattgacgatcatgggtttactacaaaggttacaagtgacaaagagttacataggtcttgagatctcgaagggtcccgagcacaggagcgtttgaccccttggagttgggatgtgcacccccaccatgtggatgtgtttaccaactaccaatctctctgaactccgtcattaaagaggttgaatgacatcggaatgattgattgaatcatccgccgttagtgattagccaagtctcaagcctctctcccctctctggatgttggtgaggtcggggagtggggactgaaaattccatattccagagatcacaggggtcttaggagctgtgtgtactaatgacacctgggtaaactcaaatagaaatcaatggtggcttctaagactgcccagagcagacttacacttctcaaagtgtagtccttggtccagcatcagcagtagcaactgagcctttgttagaaatgcaaattctaagacccagccacggacctgctgcagctgaaatccagaagcacagcctggcactccgtgttttaatgaatgagcccttccagggtgccctgataccaactcaagcttgagaaccggtgagccaaggaatccagagaagcaggtgtttgagtttgattgaaagggatgagaagaaacctgctggcgaagcccacaggcatggctgtagaggacagcactccaggtggagagaacagcaggtggatggtcctggggagtcagaggacataggagaggttgcagggcagggtcacagcatcacaggcctagaagggcaaggctgggaagtccagagctgaaacacagaaaaaataggcttttaatctgggagtggcaggaatgtgtgcatgcatatgtatatgtatatgtatatatatatataattttttttagtatttattgatcattcttgggtgtgtatgtatatttttaaaaggcaatgccatttttaaaaggacattcatttgttggaaaacagaagctgatccagaacagagtgctgctctcccctcctgagggcaggagccgttgtgaggccttggctatgaggcatttggggcacattgttgcccacccctcggtacccgtgtccatgctgggtgtgacgtggtggctcacagagatggtccactgctatctcagggacactgacagcgataattttctgggacatcacttcctttcacagtgacttccactctgcggccatttgggttatcgtgcacagctactgtgaatcctgtacacacctgtgcatgtctctggcctgctgagtcccacctgagctgcaactgagccttgtccagcatcactgatggggcaggatcctgtgaccactcaggcttctgcagattccacttctgctctcatctccaacacaaggacacatctgttgaatcgaggttcaggcagctgagcatcataattctagaagcccaccctgtttactgtaaaaagtatctgagacaggtctcaatcgagtttattttgccaaggttaaggataggccaggagaaaggaatacagaatcccagaaacacagtatgtggtttgtgcctttctccaaagatgatttattttgagagcttcaatatttaaaggggagaagtgggctagaggggaaagagtaaggttatggtcccactactgaatccacaggttgcaagggaaaaggagcaggcagggaatcatcaattgagtattcatctcactcagtaaatcggcactgtacacaagataaggtgaacatgcagtagctaccagtggggatgtttaaccttgtatctgcagctttcttgttaggaacaaaaggaaaggcagctttttacataactcagctttcagcttcatttttccttttggtgtagtgaattggaatcttgagtttttattttcttttagcattactctcaccccgctgtgtcatcccctttcaaaggctgccctgagcagctccctcccccgacctccacttctcctgcctggggggactttggacactcaaaggccaatcccaaatccatctttgattttcctaaattgatcttttagaacagatgttgaatctacagacttaccagagtgctggaaatatttacttgtattgcctttctgttgccccaagggattgaggtccatcttcaatggacgcctccttggccctcttgcttttagtctgtagtggtttaaatcttgtactttcatagaaatattcttcttcaagaggctgaatatgttaaaataattttcttacatttccagagtttaaatcttgtactttcatagaaatattcttcttcaagaggctcaatatgttaaaataattttcttacatttccagagtttaaatcttgttctttcatagaaatattcttcttcaagaggctcaatatgttaaaataattttcttacatttctagagtatatatcaaagtcatttttaaataacctattcctgatcagagatcactaaaatcagagaaataattgcaaaattcaccttaagggagcaccatgtgcaaaccacttacctgggttaaatatataattctgccaagttagcagagagatgactggttttaccaaactgtgagggtcctatgtaaccactctttctgctttatcaatgctcaaagggctaaacctcaggaaatgggtggtttggggcttagagccatgagctccgacagtggctcctgctttggaacttaggagagctgccctcctctttacacttgagaaaactgatactgtacggagtgcaactttcccttctgaagggccccactccttttgactaagaagccccaaaatgtccaactggttttcagtgtatattttagagactttcaattttccttaagtcaggaagggtttgacttctgtggaactggcatgagggatttttgtgcctcgtgtctacagtctgtccctttgctcctctgagacaatctctttgttgtatttccttatgagcaaactctgagttgtccgagtccatctgagttgtacacggcttgggctgcagaggagtgagaacaggtgttccacccaatccacaggacttcttcatcggtatttccaaggggagtgataaaatcactcttagatctgaatatattgtgtgttaatattaaatcaacactggctggttctatttattttatcccctactgcatcaactcgtttgagatagggtttccctctatcatacaggctggagtgcagtgaagtgccatttcgtcccactgcagcctctaccttccaggctcgagtgatctcccctcagcctcctgagtacgcgggactacaggtgcatgccgccatgcctggctaatctttgtattttttgtagagatggggtttcgccacattgcccaggctggtctcaaactcctggactcaagcgattcacatgcctaagcctgtcaacgtgctgggattacaagtgcgagccaccatgcctggccctgcattcactctttaatatcattcctcaaagtgtcttttagttatagcctcttttttttttttttttttgtcagagtcttgctctgccaccaggctggagtgcagtggcacaatctctgctcactgcaacctccaactacctggttccagcgattcttctgcctcagcctcctgatagctgggaatacaggcacgtgccaccacgcccagctaatttttgtatttttagtagagacggagtttcaccatgttggccaggatggcctcaatcccctgacctcgtgatccacccgcctcggccgcccaaagtatctcttttttattgtggcaaaatatatgtgaaatttgctattctcaccatttttgaatgtacattttactactattaagtacattcacattgatgtacaatcatcaccaccatcatctccagaactttttcatcttctcaaatggaaactttctgtccattagacattagctcccaactccccctcctccaagaccctggccagcatcattctactttctatctcaatgaattgactattcctggtacctcacttaagttaaaatccctttgggataaatttaattaattgaaatattgaacaaatataggaatgttcacaaagtcttaaatagatagaggctgagaatcaaacaaacttctatttccattgacttccttctatacaacacctaagtcatgattgttaaagttagcctttcagatttagctctgtgcattctctggtgacaaactgcttgttagtttgttgtctatgtttcctgctgatttattactgtttcttgttgtcatctcaagtggaaatgtggaacaggtgtatttaatattggtgtttctgctgaaaatccactggtgttttcaactatggaaagagtagaaaagaagcaggtacatttcagcaaatgtatgatgacatcaatcgcaaaacaaatgttgactttaaagatgttaatataaaaatatggagggaaaatatgtgcatcttagaatgaatgaaattcacgaattacaacttatgaagacaggtcagaaaagtggagtattaatagttggccagttggtcattaacacaaacacatgccagtatggctaagattctttgaaagagattttattagctcatcatctgccttttactgtggggcatgcatgtgagtctttattctacatttcatccttgcctgcaggacagatgaccgtgagagagggctgctacagagacctgaagtttcaagtaaatatgtccttctgcaatcccaagacacgacctgtcacggggctggtgccttgcaaagtatctgcctgtcctcccaggtaagaagcatcgcgttcatcaaagcaggtttcccagtttgcagacgtgctcagcgagtcttgcagctcctgatttcgagagagaagtgctgattgccatcatgtcactcataacagtggagaagcaaaggggacaagagctgcctggacaagggacctagagagtgtgtttaggcgggaagtggtctggaaattcttgtgactgtaagtggacattcttagaatggcgtcctgtttgttgtatttgtgctttaattggttgcaggctggcaggagtgataacacgctatggtgataatgatgcattctctctgctgtcctgtccactagtgtgtgcttttcttgctgaatgaaacttgctggaagaacccatcacaaggcctgccagtggggaaggaaccctggattcctcagtgccttgcaaacatacagctgtgaggactggagccacagaaagccagggctcttgtcatccactctaccctcactgctactgcccctaggagttcctaaacccaagctcgggttctctgaggcaggaggtggggaagggccccttgaggcagccatggtcctgctgcactgtcaggagccatcacgtctgggcaaggccttcatccctctggtcttcattttcttcatctttacatgggacatgtcacagaaggttgtgaaaaccaaggcaggatttttctcaggctctttgctggactcccagcaggggtgcctctctacttggcctcctgaactcagccccttgtgggagggagcatgtgagcaagtgagtacaggatccagctggtcactctgaagacacaggagcaagctctgtgcagagcccacagccagaccaggcgtgttgcctggaggggaacacagtggcacccaggcaagggtgcccgtgaccccaaatccccagagggggtgttaatgtgctaattagctcttttagttccatcatccacagcccaatggacggaggtgtgttcgcagctcagtcagcccctgaccctgtagtggggggcagctgccctccaccagcgggggcaaagggccagcctttctggtacccacactcagtgggccccgagctcttgtccaccatccaagaagaatgaggtcatgcttgaccactgaaggatggtgagggcggagaattttatcaagcgataaaaatagctctcagcagagagggtagctggagaggggatgagaatggcaggtcatcttctcccaaagtcagcaggtctcctcccccaagtcaggccatctcccctctaccaactgagcctggggtctttagaggcacaggatgggggccggccaggccatatgtactattggaaagggcaacatttgattgcttaaaaggcattattgagaaagaaccaatcggaagagagcaggcaaacaggaatggaagttctcgctctggtctgtgggtttcagattctttttggcttgaagctggggtttcacaggggacctgcccctgtctgcctaggatttctctgcctcctgcctctattaaaaaccacctgagatcacatatttacagaatgaaattctaactccaactagatctttcaaatagctcaaggcactcaaagacttaatacaagataatctaatacattttgataaagatccacagtagctggcaaattgatcccaagtttgctgaactatggatcaaaagcatgaagctgggtactctccccgaggcaataaaatacaggaaggtgggaggcaccgtctctttttgtaggtgttacccctggtctctctctcagtaaagagaaggaggtcacttaccaatatttgaagggccaggacccctcttgcaatcacagtaaggaggacacctccttgggaagatcttgtcctcccagcacacctgcccctgatgtgatcggggacctgtcaccttataaagccaccagccctgcctcagccacagttcctgaaccaccactccccacaatctgctatcaagagagaatttacacaagaaattaagtgcttaagatgcagcacactgaggcatgggacaccctctgggggaccttcccagtgtcagccagggcctgtggagttgatggacacacacgacgatgctccatggccctcacctgtccctgagccaaccctgtgggccactgcaggagagctggctgctggcctttcccacccagacaggcctccagcctatgctgagctccatgacaagagcacagcccactcatcaggggctccctctgtgcctggaatgacacaccaaatgcagacacaccctcatcgtttaggaaataaaccccatggctggctgaggcagaatgtagcatggcacagttgtcagcaaaagtgatcttcctgtccgaaggaaatggaggccccttgctgagttgtgtcaaagacaaacaaagccaaacactaggtaaggtggtcaggacagattttagtcagtgatccctgctgcaatagggaaaagattgtggcctgaagtgaactcaccttcgatcagcagagggactgggcattttacagggagaatagaagagcgggaaggggctgaaccagggagagctggggaggtgaagaactgcaaaaagcgtgaagaagggttggtccttgtggaatctcggtttgccaactggcggtcatagaagtgaggctcccaccttcccacagagcctgggagacaggggtcctatctgcaggtgtcagccagaacaaacaggaaattctttgggaagccttgagatttctcagacaggcactttaagaggggctggggttatcttagggatgtagccttgagctgttagaaaccatgttggtgtttgttcatgactttataagccaaggtgaggccttgtggtaaagtgggctcagaggaacctggctagagtttggccaaggacagaacattgtcaactgctgcaccaacttgacctcacaccccctgctccccggacagtggggtctgcttgtgttccagttggtgttgacatcactgtaaccttgattgaaggtccttgccttgacatatggaagttgggagcatcacttcctgtgctgaattcctctttccatactgtgtttagtccaggtttcttaagggagaagcatctgtgattcctcaaggcaccgagttaccagtgctatgaagtggggaaaccagtaaattagacttaaagaagtgtgtgtgtgtgtgtgtgtgtgtgtgtgtgtgtgtgtgtgtgactttcacatgcaggagggactagtgttactagttccatgtggaagtaaatccatcaggatgttaaatctcagggtaattggaaatgttgagtgcttgaatgctatttctcaagctagtcatgttagtggatcaagcatacccttgcagtctagtcagccctggtctactctgtgaagcccatctagagagaatgctagagaaaactcaccccaacacaggaacaagctaccaatgtctgggctcctaattgtgtgctttgaggtatcacataattcagatatgaagtgatagttgggacacccctgaagaggcccctttgcatctgcaaaccccacaggaccaggcatagaaagcaggagagctggtgaccccagggcagcagagagaagcaaaagcaacggcagagtggagcaactaagtcctttccctaggacgggcctccgccctaccgcatggggagaatgctggcagctgcttcagttctttcttggaaagagcagaagagttcatttaaatcacagttgcccattgttgcaatctgcttgttggttgtttgttttctttcttgccgcctcccccatactgcccaaagggacgtcctacttgacactcactgcaagaggaaacctgggattttggggatggccccagtgggaagggagctctcctcctcctggggctactcttcctggtgttacccatacttcttcttcaaccaaacctcaggtagaacatgctcaacagattatgtggcgctcgtttactgtcactcttagtggtttgctgtttctatatcatctcaccctgttttaaatctatcaaaacatcactttccaagcgagaccataatacaattattgaatttcagtaatggaaatctaagcagtcttatgttgtcaggcaaaattgcccttaccaccaaccattatccaagaatgacatcctcacctcttgtattcacttagataaatctttgttcctggtgcagaattttcatactaaatatgtgggaaaatctctttggaattgaaactggaggagctcccttttccccctcgcagggtgtgcgatgagggcgtggcttacttctttggtggcccactgctcaaacctctagggggagcgggcagatgggcaggttgtggggctccgaccccacagcaacgtctaagggtgaatgtttacagctcctgaactcccagtgggcatgtgttacggtgtgctcttctaagtttgtcgtccctgggcagcttgtgttaatcagctcaattagaccctttgccttatcccgaggacagagggctttctgtatcctgggttatcgccttggtgtgctggaaaaattggatcacacatgggcttggagaatgagtacaaggttttattgagtggcggtagctctcagcgaggtgaatggggagccagaaaggggatggaatgggtaggtggtctttcccctggagttgggctgctccacagctgagttctcctccgaccgtcccagacaaactctggttgatggcctgccggcatctgctggtgcctgtcagcgtgcccctctgccgatgtgtttctctcgatgtcaaatcacttgtgtgttcttccaccaatatgtttcgctcgacgtccagctgcttgtctatgtgctggctagggcctcagggtttttataggcccaggatgggggcatagtgggccagggtggtcttgcaaaatgcaacatttggccacgaaaacagaaatgtctgtcctcacctaggtccatgggcacaggcccgagagtggagccctcaccagggaccgcccccttctcctcccagcacttccctgccccgctcccatatcagaatcagatctttgctttgtccactaatacatcccaatggatgagaatcgtgcctggctcacgtgggaccttaataggtgttcgtaggagacacggatgaaccatggtcccattaggccaggaagagacacttcaggcttgcggtgtggccttggggaagtggctgcacctctttatgcctcagtttgcctggctgtgagatgacaaaaagaaaatgtgtgcagtcacatcccaagattataagctctgtgaccccactctcccttggggctgttctgtagagaagcttgacagatcctgtctggattgccaccattgagaaataggcactactcagacatcacaaagcttctggaatcaactgttccttaatacatctaaaccacatttgtatgttcccacgtatctcccatgtaaagtatctgcctcacgtcagcctccttcaggagctcccctgggaggaccccaagataggagcatttgcggtatccttgactcaccgtacgtagcactgcagacgaaggtctcatcagacgctcggtcaccacagctactgcaactgcgactgctactgctgtggtcagtttgtcaacattaaatccacccgtgggatccttccaacgcacctacctctctgttccttgactgtccatcaaatggtctcccctgattcggtctctcacgcctgccatcaacaataactgcccagaggtatccctcaaggtccatttctccttcccgtctttgttaatagaagccgctgccccatacactgcatacatccacctgcacagggatcccgactggacactatttctgtcctcccaggctaaggtctggcccatgggatgtgagcctatgccctccatgctaagccctcaagaggcagctgctccttcctctttctctgcccacctctgtggctgcagcaggtcctggccttagtgagcagctgcagcccctcaggcaggggtcaccttctaggggagtagagggccaagacggaggtagtcgagcctggtgacctggagaaggactgcgctccccgaccccacaactgcccaccagctcagactcgcacaaagggaaccgctccctcccttgttaagccatgcctgctgggtctagttggtgcagctcagccacattctgagctcatacacacctcacctgtgacctctcggtccttaacacccctctccagacaggccatgcctcttgtcatgcagctcctatgcttcaagatccacactgaagttgtccttctgtctcactgcatggctgatcgtcccaccgctcactgcccaggaccccggagcccccacccaggccagaggctgtggcagtgctggaaccctcccctcaccagcacctgagctgccttgcttcaccctcgctcccctatactaccctggtcacctcagcctggatacccccaactcttgacccactgtgcacatggagctcagcagtaaatgctacccccaaaatcccatgttatcactctaaaagtgtggtcacccaaggatggtacacaatccttacacctgcccctgggtcatttgctccccacctcccaggacattgagttcacatcacctgcaatctcctccatctccctgccccacactctccacctgggacctcagactaaagagaaggaagcaatgaccagcccttcctcttgccagaatctccctgtgcctccaaccccgctgctctgccctccctcccatcacaaagggcagatggtcccgagcctctagaggagcctttggaagttactattttttccatataagtgacccatttcgcccagtggttcctgttgtttttctggctgggtctcctctgcctccacctctctacgcttggtctttctggtattgagagatttggagctgaagacatccctgcgttctgctgtgtcctatcttctacacttgactctctcaaacacggtttaatacacacatgctgtcaagagcactgtgtgctggaagaaaaggtgcagttcagcagcagagggccagtctaggggaagctggagctgatgtgtcctacagcaagtagaaacatgagactgaggctgccccaaatccacttcagtcaaccctggagccctccatccgatggcaccctttgacatgtggacctcctattttggaatgttcatattgccctctgaaaggggaaactttgagacaatacagaagcctctctgtgaacccaatgccatgctttcctgcctgggagaatcttaaggagaaccaagtggatctccccgtccatcgcccacaaatagccagggcctgatcgcacatggagcttagtaaatttctgtctcacaggagaaacaagatctccaggctcccttcccacaactctcctgcactggaattctttctatggagtggtctggttgccatgggttatgtccatgggccagagtcagacaaaggcgctgggcggcattgcaccttgtcaaaggtgcagccgtgacactgcctgcctccctgggctcgaccctgccttccccacttcgggcatgatccaggtctcctgtctcctaggataaggtgaggattccacgtaaatgctctcaggtgtgataaacactcactaaatcttggctatgattattgttgctgtaaaaggagaaagaaattcacaacagttatgaatttagtctataaagcaaaactatccatggcaaaaacacagaataatggacctacatggcatatgtcaacccttggggattgttgtttcattgtatgattttaacaattgagttgggaacatagattttaatttaaaatgttgctttacttttcttctgaaatgcaaaatatatttctattatgtcctggatactaacaattttttgttcctgattaaatgttcaggaaacccatgttccgtttctctgaggatggagtgtgcatctttcttactgaattctgcctccctgagaggcttccctggcctctaggctgcaggtactccgagctctgtcctcagcagcctggcaaagctggagccacagccccgagggaataagccgcactctccttccccacagttcgtgctctgtctgacactaagtggggctcagtggggtgtgatctgatgtttcatgttcaacttgaaggagggttccacaaggattgaggggtggaacctgtaaaacatcttaatccacagccttatcacttttaacttaaatgaaaaaggaaacctgctgtgctggctggagccccagcctcctcctcagcacccagaggccgtcctgcagccttgcaggctcctgcaattgcattgccagatgggatcccctaagtcctaaatctctgcagggggcagggtgttgggtgtctagaagtcttcttgctggagattctcttaaaatggctgtgcagcctcggccagcaggagtatcctggagaaataacaggcatcagcaattcccagtggctcctccaggaccggggagctgtgcagcctgtggctcccgctccttccgctcctcccgctcctccctcacacggaggctcctccctgcgcgggcactgcccagacaagcagcctacggccctcccgcggctgccccgcccccatctgcattctagcatgaatcaggcctttttatcacttgcttttgaaacatggatgataaatcacacaaatatttattccctttatacttctcagtttatctaaatggagtggctcttcgggtcattcatcttaactctcgttttctaagcattaacactaatcacacacctgccaggacaggggattgaagatacaagaggaaatgctttccagatggtaaatggagacttcccctctgttttcaggactcttctagggatgccaagtaagagtctagataacgccgagtaagagtctggatcacatatcgtgatcaaatgctttgttttctctgtagccccgtctccacttgatatttggatggcttattcttcttgcttatacaaacccattagtggaataattccttttacaaccaagatacatgggtccgtagctctgcctgctggttgcacactctagaaatgaaagataaggctcagcagggcagctttatttccactgctctcctatagaaacacttgcaatgaaaaggggggagcaatttccttttctgtagttgcttatctcttttcgatctgaggccgtgaaaatactaatcacccagtaatgcacccgttaccaagggaatgaaaagaaatctggttgcttaggtggtgtttgtgtaggagagggttttgctcacaggaatgctggagaagtgaacatctcggttcatttaattatctaagtagctgagcgttcccaagcagcaggatgggcttcctgggagtgagacctgcgcagcctccagtgctccctgctcagaggagcctcctgtgtagttttattctcggctgttgctgatatgaaattccaaaggatttttttttttttttttttgagatggagtcttgctctgtcacccaggctggagtgcagtggcgcaatctcggctcactgcaagcgccgcctcccgagttcacaccattctcctgcctcaacctcctgagtagctgggactacaggcacccgccactacgcctggctaattttttttttgtatttttagtagagatggggtttcactgtgttagccaggatggtctcgatctcctgacctggtgatccgcctgcctcggcctcccaaagtgctgggattacaggcgtgagccactgcccccggccccaaaggatttttaacaaggggcctggcacatttgttttgcactggggcccacgaacggcacagtcagggtggcaggcagccccacttctgtgtcaacatggctttctggaatatttggggattgtattagaatgcttggtgttttagcaaatctactatgcattcattacttgagttcaagaagccattctatactgttgtcagatcatgggtgtgagcctccaaggtccgcaggcagtggctctctgcagttactttctttgtgcttctggaatgagagccagttttactcaactttggagtacttgcagggggaagaagtaaccatgaggggcccttccagagtcattagagctttgttctgtagatcccaaggtttgccctctctgctgagagagagcccagtggggtggacacgggactgtgtgtctcacccacagaagccaccgtgctgaggcccacctgatcgtctttgggtacctgtttgccctccactgtgccctttgcaaagacatctaaccaatctcagtctaatcagggaaaccagaagtgctatggcccctccagaatgagtgctgggcctggcccagtgactcacgcctgtaatcccagcactttggggcaagtggacggcttgagctcaggagttcgagaccagcctgcctgggcaacatggtgaaacttcagctctaccaaaaatacaaaaaacttagctgatgtggtggcacacgcctgtgctctcaactacttgggagggagaggtgggaggatcacttgagcccaggaggcagaggttgccctgatggcaccactgcactccagcctgggccacagagtgaaaacctgtctcaataaataaataaatgtatgaaataaaagataaacactgttagggagctgttcagctacagtgtgacgtcaccagatcaggtaggaatgccgtggcttgaaactgtctgatcacctcaatgtgctgattctgaggtataaaagatgacaccttactgtgtctcccctggggaaaatgtgactttgcaccaaaacaatgagcttgaaatgtatttaagcaggtacagacattggcctgcatacgtctctaatgaaagtcaagtgataactatagacaaacacaataaaccgtaagccagactaattgaacttatttcatgaaacactgaaaaggaacatagaaaccattgcagaagcagtggggatacaacattaactttctgaatttgaatatgtcattgtacatctagaaatgtgccttaagtagtcctgtaaggtattttgtactttgagtttttatattttgtttgcttgattttcattgtgttgtatgtgtatgtgttttgttttatttacttatttttaaagacctttttttccagcagtttttgcttcatttcatggcaacattaagcagaaagtagaacattcccatatatttcctaggcccacactcgtccacccttccccaccatcaacattccccaccggcgtgctccatttgtaaaaatttgtgagcccacatggacacatccctatcacccaagtccatagtttacatgggcgctcactcttagtgtcatacatgctgtgggtctggacaaatgtattctgacatcaatccaccatgatagtataatataggggagcttcactgccctgcagatcctccatgctctgcctgttcatcctccctcccgaccaacccctggcaaccgctgccctatttactgtctccacagtgttgccttttccagaatgtcatatagttggaatcatacagcatgcaacctcttcagattggcttctttcacttagtcacatgcgtgtaagtttcctccatgtctttttgtagctcattttttcttagcattggataacattttattgtctggatgcaccaggtttatttatccagtcacctgcttaaggacatcttggttgctttacttttagtacatttttagtattttatatgtgtgtgcatgtgtgtatatgtgtatatatatacatatatacatatatatacacatatatatgcatacacacacatgcacacacagatatatatatatacacatatatgtatatcatccatataagaaagggcagaaagataccttgtgaactaaagaatacttctggttttcaggaaacttagctggttatttaggttaaatcattaaatttttcatttctgttttctgggactcagtgtggttggctctaaaattcactaagatttcccacactcagcgtaactgtcccctaataattaaaaccgtggcacatgcttcaaatattttggaatgagaatgcaaaacaaactggtggatagatagaatagatagcttgcattacaaatctctatctatgtccatgcaattactgcaaatgtgctcataagtgcttcctgaaatatttgctgaaaagtgcaagcttcattcagaatcaaggttctggggttggagggaagaacacaatatattgtttttagatacaattaggcaccattgctctattctctgacccatcaataatttagaattgtggttctatatttccaaatgtatggaagcttcagggtacatttttttctgttatttaaagtgttcttatattgaaatcaaaggaagttttaaagttatcttatttttggcatttttgagacttcctttatggcttaacaatgggagtttgttataaatatttcccgtgagaatcaaggaatgtgttctgaatagggttattcatatgacaactagatcaaattccatagttatttatttaaatctgttatgttcttatgtttgtctactttctctgcttctgagagaagtctattaaaatttcacattatgattgattgtttttccattttttctcttagttttactttacaattgactttaaaattccactttgtattgttagatagttatagtttctgcataaattgttcttttgttattaagtaatgaccatccttatttctgatcttgctttccaatttatgatttattttgtctgaaattaacactacgggcaccagctccatttattattattttttgactcggcttacatttcttaattatttttatttttaaatgtttgtgtcattgggtttacctatgtctttagtaaataatattctgctgaattttaattttatcaaatgaagaatctattttttttttttttaagacggcgtcgtactctgtcacccaggctggagtgcagtggtgcaatcagctcaccgcaaccaacatcacccaggttcaagcaattctcctgtctcagcctcccgagtagctgggattacaggcatgcaccatcatgctcagctgatttttgtatttttagtagagaaggggttttgccatgttggtcaggctggtcttgaactcctgacctcaggtgatccacccatcttggcctcccaaactgctgggattacaggtgtgagccacagtgcccggccaaacctatcttttcttttaacataagctgaatctcttcttatggagtgtggttatatttggatttaggtccaccaatttattgtatgtcttctacttaccatgtcttcttttcttcatcttaccgtttcatgtctctgctcatttctaacgaatctgtagaattgtctttattctcttctatttctactactgctggaagtgatatattcttctataagaccaccactttctgatttaaaatagataagacagacccgagtgtaaattactgtaacttgctagatatccaggattactcacacaagattatcttaaaactctgaggaataaggaatttatacaaagagcgaagtgagcttaaactgaagattaaatctttttgcagacctatgatgcagagttcctagattttctgtgcacattcttcaaggggtgttggaaagcagcaggccgagagccaggcgctacgcagcagacacactagcatggacagtctctggggaggctgggccagcgagcaggagagaaggcatcgctgattcacacagtggggctgcttgcatttggagtggggtcagccaggactgttgagcccagaaacaggacccagcacaactggccccggaaagagaacatctccctcagagtgtgaccactagcctcgtttttctcttttttcttgccaaaaacaagaaacaaaacaaaatgaaggaaaatgaaaaaaaaaatcttcattaaccctgtgtttattaagaataaatatgttttagtgtcacgatttctttcaagatactcaccgaggcctcgttttcgaaagcactgcactctgttaaagaaaacatggcgaaacattgcagtcttttaaaccatgctttgattctgaaaatcgcagatgctaaatgtgttggacatgaaacctatgaagatgtcactaatttagaatttgtgattttcaatgacagagttggattgaaatctcccccttacgctgtctcccagcatgaggtttgctaaggtaatttaaaagaatagtcaaatgtcagtggaaggacagatgcttcagccgcatcacagaagaaaaccaggcttcctccccattcaccaagacagcttttatcagggagataatatatactacagcatgtgttcagttactcggcagatacttactgagtgacagacagcccaacacctgccacggactacatggtttggaaatggcccctgagctatagggccaacgtgctagagaggggcgcttgctcaccaggctgaccagtgaacgcacagaatcatttcaaggtttgaaatgattgcagtcatcataaaggaagaccacagtctcctagaatgcatgggtttgtctggatccaatgcaaggcaagaatccatgcaagaattcctctctcagctccagccacccacattgtcccagagtctgattttacttttacgccaaatgaaattccaataattagggctttttcattgttttgatgcatttatgatatatttccttaatttacaaagactaagctgggtgtggcggctcacccctgtaattctagcactgtagaagggtgaggccggaggatcgcttgagataggagtttgaaaccagcctgggcaacacagtaagaccccatctacacaaatagtaataattttaaaaattagccaggtgtgatagcatgcacctatagtcctagctactcaggaggctgaggcaggaggattgtttgcacctgggaggtcaagggtgcagtgagctatgatcatgccactgtcctccagcctaagtaacagaacaagactctgtcttaaaaaaaagaaaaaaaagactaaagagaagtaaagagaagaatctgtttaaattgttaaaattgaacatttaaactaaatgtaggtttttgtttctgacatctattatttcagtgaacttattacttagtgaccacgtgaacattgtttaaacccttcattgtattgtactttaaagccatctatgagaagtcacagctccctgccccagccactcacccatctccaacctcaatgacccggtgccaagaattccagtgactttggttctccattctggtattctgatatttggaaataacatgcatgatagccggtttctatttattgattttaaagattatcctattatccattgcaggtgaggacttggcctttttgtggcaccttttatcagttttatatcactcagctctcttaccaccaaattcgtgtccctccgtcctgcttatgtgattagagcccatggttactcattgtcatcactccttattattgttgctagctaagcagagctccctgattctatcttcttacatgtataaaatgttatttgtctagaagctaatgattgcctgacttttgtttgcttaggtttgttatataaattccaaaagatatatcaacttcatggattcatttaacaaatataattgagtgtctactatgtgtcaggcccttgggacaccttagtgaataaacagacaaagctccctgtcctggaggagcatgtgtttaagttgggggtgacagagtcaacaatagatacagtgtttatttagaccatatgcttagactttatgtttatttctctttttgtttatttatagatgtttataaacataatgtattttaaatgatagcacattttagaaagtgataagtgtcatggataaaaatgaaaaaaagggggaaaaaaccaataaaaaaccaaccaaacaaacaaaaaaaacaaaacgaagggagaaagggagattagaattccaaaagaagggggtgcaggttgtaggtagactgaatagaaagtgccatttgaacaaaggttaggaggaggtgagcatgtgaaatgtccacgctctatttcccccacacaggccaatctctccatccctttttccctgcactcctcattcccagtgctgccctccttgttccagcccaggcctgtcaccctgctggagcttcctgtgtgtctctgccatgctgaacaccctgtttgtggatgccaggcattgtctgtctgtgggaaacacagaagcaatcttctgactgcctccaaggcttctcagctaacaaagagttagagaacaggattctggggtggaagtcactttccccaggagttttagcgtaatgtccttgactcccatccactgtggctactgagaagtccattgttcctctaatccccagtccttcatttggaaactgtctttttttcattttcctctcccctttctggaagctttagggacttttacttattcctggtctcttacgtgctttaatggcttggtattttcactcatttgctgagtccacagtggttcttttcaatttggggaaaaaagattttattaatactctccttcatttgtttatgctcttgccttctgaactctaacacagtagacaaatgttatgatgttcttgtgttttcttttcagatgtccatctctttgtctttttatcttggaagtttttttgaattttatcttccaggttttctgctttttgttttgcttttgtttgtttgcttgttttatacctgattaccctccttcatattttcaaatgctcattttattttttggtctttgtttcttctcttttaaggcatcctgctctacttgtttctctataaagatactagagttgtttattttccttccctccctcccttccttccttccttctttcttttcttttctttctttatttctctttttctttctttctttctttttccttccttccttctttccttctttctttttttctttcattttgttctttcttttctttctctactcttctctttgtcttctgtaaagtatttttatctgtagagtatttttcctccacaatccttccagtgtctgagtggtagattttgctccttttttgtgtgtgttgatatcttccataaatatctaataatcctgaactgaatcctgaatcctgaatcctgaatccaggcacgttaagactgagtcaccaagactttacttagatgttctcagtgttgagagactccttcatcaatggctgggcaggaagccttttatttctgccttgccacctcccaaattatttcctccaggttcatccatttctctagagaaggatcctgtggcggagtgaaggacaatggaggggtgtgtgtgtttcaatttattattgctaattattacaatgaacatcttatgactacttagttgtaagttgtgtgtcttatgactacttagttggaggtgtgtttgtattccaggggtgcatcaacatgtgtgcctagtactctgaagcacagagacaaggttgggaaagtgtcttggaatttcccgtttaaacacctctggctgaggttggtatccccaagtcagtctctgcaatgggaacctccttcctggccttccttagaattggggatggtggtggagaggtttagtacatgctaaacctatctgttgagtaacggaattctattgttgcttaaagcgccacctaattagtcataagacattcattataacaattagcaataataaattgaagttaaagcaattgaaatatggaaaaaatgatataagcctataattaaatatattgagaagaaaataaagtaaattacctctaggggaacctactcatcccacgttgctcagaactgttctggttttacaactggaaatcccaagtctgggaaccctctcaggcccaagcaaaccagcgcagctgtttgctctaccctatctcttcatgtttgataaacatactgaattatagtagaaaatgttaatccagttattttccttctagccagcaatattcaccattggatgctaaataatgacagttctttaaaaagagaagcagaaatgtccagggaatacaactggagtgtcagtgcagaaatgatagtaattactggggaggagagcatcacatgaagccaagaaagctgaagctttaaggctcttctaatcgcaagttcctaattttgaaaatactcttcttacaaggggtagccctaagttacataagctccaggcctcacaaaacctccaggatccactcagataatagataatagcgcttatgatgatgataaaaggtttttaaaacttttgtattaaaacatgtattttaacacttcgttccttatatcaaaataaatctcattttgatcaaaatcaaatttaaagtaatcaaaatgtttgaagagaatatgagtaaatatttcataatattagagtattaaaaactttataagtatatcatgtaaacaagaatctattaagggaaacttcattgcataacacaaatataatgtgtaacagcaacaaatcagtgtgtctggcaagatgctacaacaaaatcccatgattgctacacagagcgtgaaggttatgccctgaggaccaaacagtttatctcccaaaccaggccataaattttgtatttaaaacatgtgtagatgcagagactggggagttggccactggggattgtagagtgagaaaaataccagggacatgcttaatccactaccctattgggtggtttataggcaatgaatgtaaatgactccatatgaaagtgtatttcacagactcttatttttaccttattaatttttcgtgtgtgtatgtgtgtattaggaaaatatgtaaatacagacacatatctgtgtgtgataaaagtgaataatgtgtgtttgagtgggtgtatacaaaatacagaaaacgaaggccctcatgatgagtgtaataacgtgacaagttactgcattatgatgatgagtgtgataatgcattggtttgctcagaacagtagtatatgctcacccgttgagcctttgttggctagcagcctccgaccctcatgagtggctggtttgggagataaactgtttggtccttgatgcataactgtcacgctctgggtagtgatcatggccgttcattgtagcatcttgccagacacattgatttgtggctgttacacattatatttgtgttctgtaatggagtttcccttaatagattcttgtttacatgacacatttagaaagtttttaatactctaatattatgaaatatttactcatattctcttcaaacattttgattactttgaatttgattttgaccaaaatgagatttattttgacataaggaatgaagtgtaaggttcccagttattcttccaatgcctaccaatctgtaccaacaacatttattgaaaaattcattttctctgcattgagttggaaggccagccctctcctcacttaaatccacatgcggttcacaaagcctgactgtccttccccgcccttccctgtggcgctggcttctcctccccactgtttcatccctgcagtggttcctaaagcttactccccaacagggaaagcccacctctcaacacttgtctttcttagaaggtttagggctcttcctgaatgtttttcccagaagaaatatatattcttgttgtcaagtttaaaaataaaaaataatctttctgaaattttggttgggattacattgtattattagataaatttaggcaaagttgaaaactcaaaaacttggaagctacctatcagaaaccattttaaaaaatttttactttagtcactgtttttttcaagaacagtttatagatttatttatgtaggggaatataagtgtagttattttttccttaataatgtttaataatttttattaatatcggaaataaaattttatattttatttagtattatttttatagagtaaaacattcattgtgtaatcagatcctaaaattttatatttttacattttttcaaacaataatcatatattttaatatcataagtcaatactgataattttggcttccctctctagtgtgtatatctcttatttacccctgcccttagtttaaaggcaatgacatatatttctagaacaatactacaatgtattttttcctgtccctgatctcagttagaatgtttctgcattttcacaattaagtgctggctcttatttgatatgtatcacatattacattgtaattttttatctgattatggaaacattcacttatttccatcttctcagcatgactaaatttttgctcatggcttttctcctacataactattctatagtggccttggagaaattgtaagaaaagaagttgacaaatgtgttttttaaagtttgtgacaatctgtacacaacacaaggaagagacccatgcccctccccccacctcccccccagaaagcccacaggactctgtcacctcaagctctgtgtctaccaatccttggtgactttttcttttatcaagaagattggccttgtccagtcacacaggatcctgggctcaataggcaaaaggtgtaaactcacgagaccccaggatcacagagtcacagaggatgctgagtgttgactgatgctctgtgtctttatgtacatgacactgtgttagctccatcagtgaagaacacttgaacccatgcacatttccatcactcaaaagaagtgagcagtcatgactttatatttgtgaagaaaagtgcacctcaatctataaccttaggtgaatgaagcttggggtgtgtgagtaattaaaccatccttgcactcctgtaatgagccccagttgatctttatgtattctttactggtctggtggctttaatagtattttctttataattttttatacatttcataagattggtctatgatattatttgtgtgttacctttcaaaagatgtcttatattgtttaatctaagtttacttcttatttgaattatttaacttttttaatgtttacttttcttttatagcttttgctatatgactgtcttcttttttgtaccctttggttatttagaaaacacaccatatatttctaatactactatagttgcctctacaatttaaaatcattgcttatgccactctttcttgattgattaatgttacaaattaaactaaagccataaagaccttcacaggcaaaataaagctattggcacatttctacctctttcattttctagtcctctcatttcagttcaagctccaacctttgttataattgcttgcagtttccttatttcagtttcactttaatattttatattgtgtacctctaacctttcaatagtaatgcatgtaaattctgttttacaatcttcaccacagttgttcaggttgaattgtctatgtaagtggatccagtggccttgccagtccttctgtgccatagctttctgattctcaagtttgatggtataatctccctgctcagagagtgagcatctcaggagtgttgttcagaaggatgattgctcctggatttcctggctgcttgctgcttctctgttgctccatgccagctcgttaatagaattctgtcttgttttctccacttggtgtcttcattgaattctcactctcttatgttacctgacagtgtaatcatgttttgtgaaattgatttgcttaagtcggtcttcttccagaatatttttaaaattttaatgccatatacccttttcacatatgtgtttttgtagggaggggtttgtaatttttctgtaggttccatgtgaggtttcttttttcccaactcattctgaccagggaatttccatacaagtcatttatagaccaaaaatggagctgatctccctgctgcaggccttgttcctctggcgcacttattctgagtgctttatggaaccaataccaatggcttgtaacaagaatagtgcttttgttttggttcttttgagatgttcacagtttgtcagcctttacttgatttggggaaaaggaatctgtactacctcacttgcaccatctctcccaaaatgaccaccatgatgtttaagataaaaaagaagtttcagagagatgtgtttttttaaaaaaaataaagctatcaaagagtggtccacacccatcaaataattgtatggccttatagataccaaagacattaactcagaatctggtgtgttgaccaacagaagcgttatttctctctgaaaaccatgctgcctttccacctgcagtgaaggatgcttgtgaaaggtttcttcagcactggcagtggccacactctcccagtggccactgtgcccacatctgggatgcgcctttagtctacctctgaatggtgggtctcacaatgttccaaactcgggtgcagccccgactgcctgtctgtgctgggatcctggctccacgacgtgctcctgcaagccttgggcacatttgttagtatttctgcacctgtttattaatctctgaaatgtgcacaataatcaaagctaccacacagatttgttgtgagaattaaaaatttcatgcaggtaaagcacctcattaaatactagctattagtattataggaactctgtaaactagagggatttggacattggattaatcagcagggatcatctgactgtagatggttcagagacttgcaatagatgttgatttctttaagacaatgagatttttcaatgtctgttcaaggccacttaatgccttttaactcataatacacaacaaaccatatattagatatctgcattcaactctccagtaatatcagcatttcagatgccttcacttcttcttcttcttcagtagaaccttttctttacttcaaataattgaatttccccagtgctttcctgagtttgtgaatgctaatgcaattctctgttgcgacttgtgcgtatgtagactttgcatcatagtggcatctcaaggaagacatcacaacactgcctaaactacccagatgctgctcctctgttctacatatgacccttcggaatgaatcattataaatgctacatgggttggctgctttcccatttaaatgggatgaactagagaatgaggtctttaaatacagcctttctctacccccaactcattgtaacaatactgagcatatgtgaaaccactgaaatctaaaatagagtattttctgatgtctgtatttatatacataaataccacagaatgattaggcctttttgcagcatagaccaataaattatgccaatgataatacagctaatttcattatacagtacagtatattcctcctcatattcccttagttttctggaccaatgtttttaagagcaatagataaatatgacattttcaacatgattcatttgataagttttgtgatgtaatggctaaagctttacatttggaagttggaagttgattccaaagaatgaaacagtaattgttgtttaactaattatttagctgactaaatatctaacaatattatttaaatattttaaagagtttttagccaggtgaggtggctcacgcctgtaatcccagcactttgggaggctgaggtgggcagatcacaagatcaggagatggagaccatcctggctaacacggtgaaaccccgtctctactaaaaatacaaaaaattacccaggtgcggtggcgagcacctgtagtcccagctacttgggaggctgaggcaggagaatgatgcaaacccaggaggtggagtttgcagtgagccgagatagtgccactgcactccagcctgggcgatggagcaagactccgtctcaaaaaaaaaaaaaaaaaaaaaaaaaagagtttttataaccctttagtatgtgctaacatatagaacctacttgatgggaaaaagattcaaccaatgagtacctaagacttagtaagaaaatcagaaataacaatctgaaggtatcttgaagaagaatgaaggcatcagaaaggtagtttcaaggaacaggagccaggaggttacataaatattgttctacctactcaatatattcatttcctggagctgattaatcttctcaaagtgccacagtgtgaagtccttcctgcagagaatggaattgttccagacttatcaagaaagatgactccaatgtcaaatgttagccatatactcttggcagacccctggcccagcagcatctattggccagaaaaactgtctgcagcgtgtgatgccttcacacctgagtctcatcgtggtagctatttgaaagcttaaaagataaaacttacagattcttacaaatcattgtaaaaattcaaatcctatgtggaaatgacagtattcctgagtctgctgtcatttcaactcttcacttttcaattctttgcctagacccatctacagaggcttatacctcatatgcctcatcattcagttgccattgactgctttcaccaatttctttaaaagcaaggaaattcgactcccagttttgtttagcatgagcaaggtaaccactaagaaagcgacgtagagagttcttggatccaatgatgtgaccaagatattcttactgcctgagagtaaagaatgtccctgaggctccgggcgggatattgatgttgatttcacggacggtgtcagcttgcttgcggatttgatttgtgtaaaatatggattcaatctgcttctttggtttctttcttaaaacccattagatttatggtgattcctggtgaccccgtcactgaagactttacataaaacctttgtggatggtcctaactggccagtcctgctcggcccagaccctcacagcccacgcactggtggagctcaggagccttaggaactgtgcggctgcaggtcagcctcaaagcatccaggttcgctgcaggaggacacctggaaaaaaatctcagaaaaacggctcaagagcctggagaagatcatttctaagtattagtctcagagtgaacatccaagaaaccctgacgcgaaaatgccagaaaagcccgaaactagaggaggaaggaggccatcattttaaaatccttgtcataaaaggaaggagtcgtcacagcggggagggttcacgtctgtaatagaatgggaaactgacagtgttcccaagaaaacgaagagccgaagaacggaagcccatacacagttgctagtgaatcctccgtgatttaaattgcatttcacaccttgagaaatgaattaaaccatctcccgtgggaaggtcattcatttcaaaagaaagaaaaatgaacctatgttactcatgaaatgtttaaattcatgttagacacgtaggctttccctagaatgccacgtaaaaggctccggtgagaggcaggaaaagatatttcagatgttatagataatctgtatgtgcataatgactaagggaaacctgtttggaacgactgaggctctgaataacttgacactgattcaatactgaatcattcaggaattttcggaaaacttctccgagtagataatcagccagaaagtagaaatacacaacttttaccaggagtaatgaattctttacttatctgggtataaaatagataggcatcacataaattgccgttgtccagttaaaatattcaagcccacaaaattactaaatgtatacattttttctaggtcattttagagctaaggaacattaaattacaaactcacgtcagatttttctccagctgacaagccagccttgtagaaattgtatttatctgggagcaatgcagcatggtggataagaacccaggctcactgggctcccttcctgatcctgccactccagctgtatgatgctgaccatcaacgacctctgtggctgcagacagggtcctcggtgtctctagcctcagcttcctcgttcatgaaatgaaattctaacagcagtgccccatagggttgttaagtgggctaatgcatgtgaatgggttacttggtgtgtatgtgtgctttaaaaggaaccagaactggtcatgagagtccaggccctggagctgggcttcctgggtgtaaattccatctcacaccacttatgtcacctttctgcacttcacttttaggaaataatagcatctgtccacatcattggtttgcagggaaaattaaaccactcaacagataatagaaaaaaaagcttagtgccctgcctagcatttggtttgtcctccaggggcactgattctgcgtggctgttaataaccaaattcatacactacatgtaaggtgcgactggtttgctttcttacttactgcaatatttgaagccgtctgcataagcttcatttcacccctttaagatttgcaaatattttgttagaacttcaggctttaatatgtgggcttgttgttgtttgttgttattgctgttgtttcattgttaacattcccaacaatggggtcatttgtcctaatctcctagtaatccatgatagctaggctcaacataggtatcaaactccaacaggtctatcttgtaaggtgtcttgggtgctgtaaaaacactagttgctttctggtttttacagatatgtccagttcgattatttataagtagaattggttaaatcagcaggtggcaacctatggcctgtgagccaagtgcagcctgccatacctgattgtgtaaataaggtttcatcagaacagtcaggcctattcatgtacatggggtttccagtggttttctcactgatgcagcagggatgagtcctcacagcagagatctccaccggcctgaaatatttactatctggccctttaataagatacttgccaacttttgggctagatgaaagcatcctccagcaaaatgagtgtcttaatcaaaagtgctgtctctacatcacctttcaatcagggcaaaatagcagtgttaatggcatggcagccaagaatttccaagcagttcagaaaacctaaacctagtttcagtctacggtcatctcattattagcatgcaagtatctttcattgacttagatgatgtattgtttagtacatttatcttctcagcgatttaggaaacatatttcctttctcaagaaaatggcttgtcttcaggatagcaaaatctcctgaggtaaagaagcaagtcagatctgaaatcatcaaatctgtgtaacccacaagcttgtgttcttgcagctggctttcaccgaaactgtatgaggaagacatttcctagtcagctgttaaaatgtctaaacgaagtcagtggtctcacgatcacagtccatgaactttgtggcagaagggccacttctcccctgggaatgttaataaggtgttgcctaggccgggcgtggtggctcatgcgtgtaatcccagcactttgggaggccgagatgggtggatcacctgaggtcaggagtttgaggctagcctgaccaacatggtaaaaccctgtctctactaaaaatacaaaaattagctggacgtggtggtgcatacctgtaatcccagctactcaggaggctgagatgggaacttgaaccagggaggcagaggttgcagtgagctgagaccgagcctttgtactccagcctaggcaacgagagcgaaactccatctcaaagaaaaaaaaggtgttgcacaaaatagaggcgctaaaattcttgtttccatgctgcagtgggcttcagcagcttctcttgggagttaatcaagtttttaatatcatttttctgtttgaaatgaaggatttgtaagaggcactggcagtcttttctttccccttgtaaactttcactgtgtaggacctgaaaggcctgttcttcccgctgtgaccatttgctttcattctctccccagacgaggtggagaacacctgtgcgggctcttcgggcgtcactgagatggcgttcactttcttttcgttaggtataaataaatccatccagtacagttaccaccacttgggagcattgttttctgcattctttcaacctccccattcttctaattttagaaattctaaaatttctcaatagttctcataagagtaaatattccaaaatcacatagttccatgtgatgaccatatcatgacatcatttttaccaatgccggaaaatcactgagaggcaatacaacaaaattaatgtctgtgtctctgtgattttttttttaattcgtatttaccagtcaggtctttgttgattttcagaagggatgtatataataagtataaaataatactgctataggaaaacatggctttccctcttgtacacaggctgagggactgaatgtctggaatcctgtggaccacatgtgaatgagctccctttcccaggtgagggttgaggaggagaagaggcaggggacaggatgaggaagagacaaaggaatgaaatcatgataaccacagccagcccttcccgagcacttcctgtctgctagtcctcccagcctgcccagcactgcatagaaaagctactgtgaccatctcccctttgcggaggagagaatggagacattggtgtcccgtgatttcctgaaggccgtccagctggcaaggttggagctgaggttggaacccaggcatcctgaccgcagagccacggcttccccacccccccacccccacaccacaaggccttagacacagaaaggctgtcctcgggcagtcagccagccagggtcatggaccagggcaagacttcacaaagaactttgatttgtgttgccctgttggtgcctggctataactttatggatttctacatccacaggcaaaagcaaatctgctgaaacacaggtacattatggtgagcccaaaaggaaacttctagtgatgttactatatttaggaaataacatagctctgtatatgtgaattgaggagggtgacgttcattgtcaactggtcaacaaatgtttagtattttgcatgtgctcagtcctgtgagtttcacagaggcattgatgaaatgtcaaattataaagcataaattctgtggacagacagaatggccctctctaatggaaatgaggctctggtcatagtcaagccaccagcctctcactcttgcagcctcaggagacttgagtagaaatttctacctacagtctagcttcctctagtgtcttattcattctgcagtcgcagtgatctttctaaaacacaaacctgggccagacgcagtggctcacgcctgtaatcccagccctttaagaggctgaatggtgtggatcacctgacgtcaggagtttgagaccagcctggccaacatgaagaaattccatctctactaaaaatacaaaaaattagccgggcatggaggtgcacgcctgtaatcccagctacttgggaggctgaggcaggagaatggcttgaaccctgggaggcagaggttgcagtgaactgagattgtgccattgcactccagcctgtgtgacagagtgggactccagctcaaataataataataataataataataataattttaaaaataaaaaataaatataaaataaaatacaaacccagtatagacacttctccaagtccagccttccatggctctccattgtcatttgcttggtgcccaaatgccgtcgtgtggcctccgtgaccctccaggacctgccactgcctcctccagtgtcttcacgggccctgtcctaacagccctcattcctgccacactgaaggcctccttgccctgctgtcaccataacctttcactgttgacttcctgcacagcctatcttaacgttcaccccttcttgggacacatttgtttgtcatccctcttcatagccattgttaatgtccagggaggcccttgatcgggtatggcagggtgcacaggcttgtggtgcctggcccatgggccccacgtggtgtctgtgacagggataacaggcattccctcattcccttcaacatagtgaatgctgtggatggagggcaaggcacaggcagtgcatctcatgggaatggaagccacagtgaccctgtgagtctaggggacccagtggaggacacagagatggagggcaccttggcaggccatttcctggcctgggtgcaggtgtcaggaagatgctctgatggtgtcacggttttctagctcttttttagtttatgagatgtaattcctaacatttttctgatgatggcgctggcacattcttagttcgatgggtgtggcattgaacctgaggacagttaggagtcactgcctcttgtggctgtgtgttcccagtttcctttctcggttccctcatgcaagtcctttgtgtgagaagaaaatattcagtgggcaaagtggcttcctacccaggatgaagccctcagagctctttcatgctgtttcctcttgatccgcaaaccagtctctctcattcccttaaaagatgtgatttcattcttgccatccctgcatcatgatgtctcctttcagcactgtcagaaaagagctggctggagagcaccccaggccgggtttcaggagctgaggcgggcaggtctgtcctggagcttggatgctatgagagggggcttctctgtcctgagatcgggagcaactgtgtttccgtccttgtccatgcctttccagtgtgcttgcagtgagcttgcgttcctttcctttaaaaggaaaaagagtttactatattgctgaggcaggggccacatatagggcaagactgccaaattgagcgtttggtaaaaaagcaaccagtagacatgttagttaggtacttggtgtgaccaaatgaaccgttaggtctggacgtaaaggaagcaacaccagagatttgccatcctgtggtatcttgccaacacagcccatctttactctaacagctgaggggccctttcctgggagctttgaactcccagaacctctggcacactggggcttgtggacattcagacaggtgggggatggaggccacaggtccatgtgtgtgagccccgtgccctgggaaatggggagccatggagtgtttcatatattatagtaatgttgtgtgttcatgttcgcgctggaaatacttcttcttggcagcagagtggagattagcttttatcaactcagacttagaagctaggggacaattaaggagcaatccctgtgaaaaatgacagggatcttgtattggagttctgcaaagaaccagaaccaattatatgcggatgtgcctgtgtgaggtaaaggctctcctggttgcaatcatctataagacttcgaaataaaactaattctttaaaagcctgccttttctttagctgacaagagacaaaggaagatttattttaaggaattggcttatgtgattgtggggactggcaagtccaaaatctgcaggacagatcagtggaccagaagcccaggaaggagttgcagttttgcagttcaagtctgaagcccagacttttttgggggatacctccctctattgaggccttcaacagactggatgagttccacccccattacaggggtcatcaactttactcaaagtctacagatttgaatgtttatctcacctaaatatgctttcacagaaatgtctagaataatgctcagctaaatatttgtctactgcagtctagacatgttgacacatcaagttaacctggactcagccaacatgaatgatacacaggagggagtagctttgctggaaaattggaaagccgagtctgtgtgatttggtgggatcaggaaaaggctggaggatgaagccaggggcatcccacttctaggatgacaggaagggcaggtgacaggaaaggaagagggtgcaaagatggggaccactgggtctgaatgcccattacccaccagacagagatgtctataagcaatggtttatacagctgtggagtgcagagaggatgcaggtgtcaataccagacagaagagaagacctcttactctgatgaaaaaagtagatagagggaaaaattatttaaaaaaaatgcacacacatacctgaaacatttattttcacttaaaagacacaaatgcgcattcatttgctaattcttttaattatggcccaagcatttttttgagtagggtctgcctatggaaggatctaagtggattatttcataaaacatgctcattgcatataatttccagtttgagtttctttaaagaaggatgaaacttgtcccatttatctgagtgggaagttgttttaaaatttgtatgtttcctcaatattttacttttgtctcagccacacctaatttgacagcagtgctgtttaatgactggtctccactgagttattccaaagatttaacttcgttttcatagaaacagctcttcttttctaatgctcatgtttcatagagctacaccaaattatattacataactccaataacaaattcagctgccataaacagattggaggacagattcagcccattccctgtgagccctggagtggcagcagaaggatgctgacatccctgggcaaggctggcacctcacccacgggtgctcagcatggtgtgggcggctgccaatgtgttttgccaagggatgaagaggcacagtgagtctcatgtgtcagctcagaatgactaaagaagagtttctaacaaggctggaagtaaaccagtgggcagggaggagcccatccaggcagcacatctagtgtccagagatgaacggagcagacaggtagagagccactaggacagaaatagatccagagaatactctagtgctctgccctccagagagtagaaagccgaagggtctcgcacaggaagttatatacccagtggaaaaccacttgtgtgcttccatgtcagggtagcagaagaatgtttgtaacctgaacagttatcagtacatccattacaaccttctatgtccaaatacaatgtaagtttaagatcttgccctaagggtaggacatccttggctaggattatctcctcagttcttaagctgagttgtttaggaggcttgcaagaacgttaatattggagaccattacctttacttttcagatatctgtatttcaatgttggaagagtcagtatgtaaggaagcgtctgtggtccatcccagctccgaaacccctttggttctgggtgggtccctctttgagaaggaactcaagcttccatgactttgcactcacagaggctaagtcacaggctctgagccagcagcctgctgcagacacagtcttcaaaatcaggagggctgtgcaggaccagacagcctgctccacagaggagctcagatgggctttgctgagatgctagtgacagggaattaaagcatctgttttcctccggaggaatcggttgaccggactccccgccctccccagtttttttattgccacatcctagttagtcctcataatgggtaaaaaataaaattagtacaactttaatacaagaaattgacgccacaaaggggaagggagggtagctcagaactttcttggccagtctcggggattttctgaagagctggatgttacatttcaaaaatcgtgtttccaaagctgccagtcatccaggcccccaggctttgcacaatttcagattcctgacccctaacccctagagagccaaggccgttcaatttctggttcatacagaacaggagcgagaccaggaatgtgcaggtgtttgagagccccacggcagctgcccctttgtgctatcgttggacatgagaactttggatgttaagcctggtaaagaggagggagttacctcttactcagacaggactcaacctcagatgtaattaggtctagatcgttaggttgcctacccgtgtgttaccaccacagtagtttttagtccatagcaaaggtaattgtagtagaaaccgttggctcaatgggtgggtgttgaaggggcacagaagcggcaagggagaggtggccttccagcacagaaacctgaagagggcaaaatactcttgttcttttgagtagagcaggaatgattctgactgtgacaacagcactgttttggagaggggactggcagtaaaatgtgcatcaccttgcttctgggagcacagtctccacacacataagacgaggctggtaaatgcaatcaatgctggagcccttcccagcacatagagagcaaagatggggaccactggctctggatgccctttacccacgagacagaggtgtctgtaagcaatggcgtatatggctgtggatcacagcagagaggatgcaggagtcaacaccagacagaagagaagacctcttactctgatgaaaaaagtagagtgcgttgctctttcttccagtcttccctggaaagtgggcagaggggcagcatcccaagaaccagagtgctgttgccaattagagttgactggtttcccttttaaaagggaatgcaaaagcccccagtgttctgcagaggaaaccctcagatgaggggtttttgttgaacgagggaattactgaggctgtctgttttgaaaagcgaggtcagtttctttggtctgtgtgtctcataattccatgttcctgtctttcccccatcagtgaaagctctgtagatcatactgattccttttaagataagctctgatgacaggatggtgagacaggaaaacctggtaaaaatggcatgctggcctcggagtagtatctcctccacacctttggctcctcacagtccctgaagatgacgcccacagcgctgcctttgtgaggagctttgatgtcctcggtttggctatgtgtgcttcagcaaagaaatcctgcatttagaggtgaaaacaattcagtgtctgtgtctggctcattgtaaatctctccttgggtttcacaaatcgggcaaagtggtttgacttttgagactgaagaaaatgaagtgactgtcaagttgcaagcttccaaatgctcacagcgagccctggagtgctgggccctgttccttgccaaccagtcatcagaaatgggctgtccgttcccacatgaaaaaccagactagaccctggcattaactcctagatggacacctcccaggagacagcccaagggtcctgccctgccagacagtgtcaggaacatctatgcaaaccaactgtggctgggagggatgagctggcatgttgctgtcatttctgatgtcctgactgctgggtttttggaggatttgatttctgatatactgactggtggactttaggaggatttggagactggagtgcattgctccagcaggcatcgtgtgtgggcacagtgcaatctgtctaataactcattctacctactgtgctcatttacctacttggtcacagagatcattgtttatttcagagctggacttctacctttgaacttgcttggagtgtagctggcaccaggtgatactgatgaagcgtcctttgtcctagacccatagcaaatccccaagccaaccgaggaggatggcaagtaataaggcccttggccacctgccagacaggcttaggacatcattgtctcccaagttctgctgatcctggcctctgtactttcagcttacagccggcctgcactcttagttaatttgctaactaatgttttccctatggaagaggcagatttttccaactgacatctctttattgttgaatgggcactgctatctttaaagcattcaatttacttacattatattagatctcaaattatacatgtgaagatgctgctattttatatgaagacaaggttgtagtgtcttcaaaaaccaagtaatattgatcctgtcagaccatgttggcagctgtcttgacccctgggccattgagtctgcagtgtgtgagtatctgggtatagtcagtgacacgaatggtttaatttagaacagcctactggacagttgtgacccatacagcagcttgcggaagtcaggagtccccacgtctaactctgatgctgaagaggcaccgcctagcgaatgctgtattctaatgttgcgtctcacggcatccagcacccgccactctggactaaatccagctggcagctggagccctgatacttatcaatgcctcgtgtaggtttgtgtcgtgacaaggtttctgccccattgttattctctgtctttattgtgttatgagagactcctgcctagaattcctagagttattcttgaaaatagaacaacagaatgctggatggtgaaacttcaaaaagaatcagcaaacaaaagacactgaaactaaattctaaaagggagggctcagggagacttgctgatgtgaaagccacaagcagagcatggctgccctggcggggcttggccctaggcagcagctcgggcccagaccagggctggcctctgcatctgaattgtcattatgacacataatctgctgatgtcgtgtgtaatgacaagggactttactaaaccctttttggaaacttgcattttcaaagaaagcattatatgcaaaaaccaaaatgtcattttaattttttttttaatggggaagagggagtcattttgttgagaaatgactaaagactgttcggcattagggatattgcatattgattagatgataccaggaaatcctgggtagaccgttgagcgaaggctgtaaaccctgtcactttctgggtagtgttgagagccacaaaggagcaccctgggagggagccttgggcagtggaggtcctgagggccagtggggactgcgtctccagagtcccgcagtggaaactgactgatttgggtaataccagccactttgcattcttccagttggtggacttaggaaaaccaaaacaaagcgagaacgcttgtggccactggtgggcaactgaacacagcttgttactgttcatggaaccctcagacattagcacagaagcttgcgtggattttgactcattcatgagctgaaatgaagacattcccctaaagctcggttttttaaacaaaacagacacttggtgtttccagatgtggtatgaaggagctttgttcaggaggactgtttgaatggagtgcagctaagagagaaggcagagaatggatcgacccagttggaacgtcttaagatggtggagacagaagacttaacgaggcggtgtgaaaagctcttgagcagccaacgtgtcttttgcagcctcagtgtagaatacccattgtaatttataaggctgcaggattgagagagcaaatataagaaatgggaggaaagttaaaaacaacaggaaagcacacagaagcggcaacagagtaaccgagaggctttacatggagaattatcacagacgggaagccaagaatcaatttttcataatgaggatgtgtatgtaatttaggtggcttaacatggaattaaaaaaaaatccactaatctcgttgacactggaaaatggaagcattaccacaatccatatagggcaactcctacaaccctgacatgtgtattttttatgtgtacacaaatttacattttagtctttgtataattttcttaaaaatataattgaatcttttcagtgaaaacacttggtacaaaataattcaaggcttctacaaaccaaagcaagtaaaacgatcatggtgctcggtttaaaggccttaagtaatgtggtgtggctatcaagggtttggggcgggatcaattctgtttcccatccaggaagtagcatcaatttccctctccttcgaggttctaccacctaattcatcctcaggactttcagaagagtccaaaccttggctctaaaattacttgagtcacagactccctggagaacttgaggaaaggcactcatcattttgttcagaaatcacgtccagccaggcatgcatagaactggagcagtttcaggatgttcctggatctcctggagcttgaggtccaaacctttttgattgtattttcttacttagatatctgtatacctcgatccagattgtggaattagagacactcaaatgtgtttataaaggctttgaagtataagaaaaacacttgttttggacaatgaatttttatttttatttatttattgtattgtattctattttttgagacagagtcccgctctgtcacccaggcaggactgcagtgatacaatcacagcccactgctgccttgacttcctgggctcaagtgatcttcctgagtagctgggacttcagttgtgtatcacctcacccagctaatttttgtattttttgtgtgtggagatgggtttttgccatgttgcccaggctggtctcaagctcctaggcttaagcatcctccttctaggcttattcctcctgcctcagcctggaattacagtgctgggattacaggcgtgagctaccacacccagcctagacactgaattttttgaatgctgaataaaacttgcatatactgcctgctctgaaccatgttaaaaatatgtttacacacagaaagcactggaagcaacagtcgtagtgatgttcatagaagggatcatagcgggatttcccttctcctttctgtctctcactgtgtaacttgggtccacaaatgccattctcgagaacacttctcccaggtgccgtggctgctgccagaggcacctccggagttcctggccaagctctctgggcttctgctttgacacctaacctgagggtgactgtggggttcagtgtgggggcacaggatggagggtcaaaggagaagcctgagcatcttcacaagtcctcgggtttaccctgagattcaggagcaagtcactgttgccctaactctactcagcaatgccgtagagtggaagacaggatgcccctgtcctgggttctcagcacagacacagctgcaggcagagcctcgcaggcgacccctaggtgggacccctggtgccctgcactgatgtgcttgcaaggaggtggtgaggaagccagctcccctctcatccccttgtgactggcccacagggagttgcacagggaaattaacatgaatggaaatcatcaagtcctcagaagtgactccaggaggcagctcaagccctcctgcccagtgagtccctgttatggcgccatgtttcccccttcctcttgacggcctctccagggtgcacaccaagccctcctgcagatgggcttgtgcaaaaccagctgaggcttggtagacacactcaggcacagtgtcttgatcaaaggtgatgccactgggcaaagcctggctcagactccactctgcaccccatcacttgacaacatgcacgttgatggggtctactttaatcaccaggaaagaaaaacacatttacaagcatcaacagctgctaacaaattgaaagaaagataatcagacatgatgagcctcctgctggaagaatgcctgataacttacgcaataatcatacgagaaaggagaaccaggatctaaagaagcctctagaaccaaccactaaagaatgaaaagatagaggacagagaaacacaagaaccaacaccacagagatgtaattccaagaatcctgtaaccagcaaaacacactgtggaagactcagtaagggaaagatccggtttctttaacaaatacattgaacataaaaataaaatttaaggtaaagcctaaagactaaaagagaagatgtgaatctgttgcacaatctggactttattaggatcctcaaacaaacatattaaattatgatattgatgacacagctgggaattggaacactagcccttcagggatgttaacgaatcattaatgctctagatgttatggtgatattacggttatgttttaaaaaatccttattttttagagatgcatattgagatattttcatgtctggaatcaccttcaaaacgctgtaggggttgggggcatacactgaaaattgtgaaggctgagtggacaggaacccagaggtgttttattttttatatgtttgaaattttgcattttttaaaaaagaagagaacagacacactgtgccgaatagggttctttccaagtccactggaacccaaaagccagaggaagggaaagaatgacagagcatgaatcaggatcagggaggtgagaaacagcaggcgcagggagactccggtaggaatgctcacccaggaaaggtggaactgaaaataacggcacacacacgaccgtggctgggaaatcgcgccgctgcctccacatcagatgtggggccgcttctatcagagtgatggagccatccctcaccgaggtctctttgtccctgcccagctggtccgtggggaactggagtgcctgcagtcggacgtgtggcgggggtgcccagagccgccccgtgcagtgcacacggcgggtgcactatgactcggagccagtcccggccagcctgtgccctcagcctgctccctccagcaggcaggcctgcaactctcagagctgcccacctgcatggagcgccgggccctgggcagaggtaaccagggtggggttggcatgggtggcagcagggcccctgcatgatctgctgtgttgcacatggccctcactgggtgcttatcctgactgttctgtgcagtgctcacacacctgtgggaaggggtggaggaagcgggcagtggcctgtaagagcaccaacccctcggccagagcgcagctgctgcccgacgctgtctgcacctccgagcccaagcccaggatgcatgaagcctgtctgcttcagcgctgccacaagcccaagaagctgcagtggctggtgtccgcctggtcccaggtaggtgcactggtctcgcgggagcgaggttgactagctctcccctcgggactgcctcttctctcctggtttttctcttctcacttctctctcttctccccttatatctcttcttggcttccttgcaccttctcagcttccaacaacttcatggggttgcttaatctcctttggcttctgaatcgtgtcctgggagcaaatcacacagtggcgtccacgtcatcatcactggtccagcgtggagcagaggacgagagggttgagggggtgtgagcgtgagaataggggttcactcatctcactgacagcggggccctggagactcacctaactcctgggcaggtgtagccacattccaggaaatgcgcggctcctgaagagcaggaagaacatgcgttgcttgggaagaaacagtacccatttcctgagacaagtttccgggggcagctgttctatttgcgaaaggaaactctcctgttagttttgttgaaatcgatcacctgttgctgcaggaggctgggaagccgtttcctctacaccattcaggagctgtcctggagcccttcatcatgggaataacgttggaatcatgagtttggaatactgatggtttcatgaccagctttggaccaagtggttccaaaagcactttggaaatcttacaccccacagagtggcaacagcaccaccagccaagcatgaacctgtctgaacggggtattgagagatcaccgtaacccagagctgtgcctctgcattgccacagcagctgtgggaagaaagctcctccctgatcccacgctcctcagggagggacccggatctcatcaggcactgcgttttctccaccctcgaacgatggcttctttgttcagattggtaggaagtgccaagcaaggcattgaatcctgttgagactctgtttcagtttgttactaaaaaataagaacacccttgctcgcttaagtgagcttgccattgctaacaatgcacttcaggtcctctttcacctggagggtaggaatgagtgtcccacagaactgaacgcactgtcattggaaaagacacatccctgggtgcatatccctagaggcagagtctacagaaaataagcgatgtgggctgcataatctatgggctgtgtccaggtagaaagtccttgccctgaaatttaatacatgcacacacatcccacaccacacacacacacacacatcctacaccacacacacacacacatcccacaccacacacacacacacacatccatcccacaccacacacacacatcccacaccacacacacacacacacatcccacaccacacacacacacatcccacaccacacacacaccccacaccacacacacacatcccacaccacacacacacacatatcccacaccacacacacatcccacaccaaacacacacacatccacaccacacacacacatcccacaccacacacacacaatcccacaccacacacacaatcccacaccacacacacacatcccacaccacacacacacacatcccacaccacacacacacatccacaccacacacacacacatcccacaccacacacacatcccacaccacacacacacaatcccacaccacacacacacacacatcccacaccacacacacaacccacaccacacacacacatccacaccacacacacacacatcccacaccacacacacacaatcccacaccacacacacatcccataccacacactcacacatcccacaccatacacacacacacacacacacgtcagagcttctctcttaggcctggatcagcgagcaaccaagaggagtgttccaagtcctctccatcttcgatcaggatgcacaaaaagcacacctgtaagcctaaagatgtgagtgcaaggtcaggacctgggcaggtgttgccacctgggctcctctgctggggaacctggggacacttcagccagaggtccactggagctgcacagcatcgtccgctctaccccagcaggagacagcaacgccaggggccgggacctctgtcccagagaccctccgcgcccagtctgtggtgggacagtgtgccttgctcctgtgtgttctccctgcaagtgggggctgcagcctcctgcctggcctgctcgtttgcacagggcacctctgcacaagccagggtgtctgcaactggagcagctcaagcttagagcctgccttagtggagagctaagggacgtgctctccacgcacgcttcctttcctcgcaggcagcactcagatgcctagggaagattgtgagccctgagtttcttctacctgccccagctttaggggccaacatcactgcatttgcgtgggttaatccatggacccgtggtagttaccacatgtacttatgtattaagtttcagtatgcttcgatatcagtgacagcccaacattttaattttccagtgaaacggtagctttagaattactcccttcatggtttctgactgccctgcccctacttatgccccatgatgctgtgccactgacttcaagttcctcttatttttaatgatagattctataatgtctcttaaaaatgctaaggtccaataattttcactgaatgttcacacttatataaatgttcaagcagatatctctgatattttaacccacagattttgcaaaaaaagagatttttttcactgacttcttttgttctcttctttttagtgctctgtgacatgtgaaagaggaacacagaaaagattcttaaaatgtgctgaaaagtatgtttctggaaagtatcgagagctggcctcaaagaagtgctcacatttgccgaagcccagcctggagctggaacgtgcctgcgccccgcttccatgccccaggcaccccccatttgctgctgcgggaccctcgaggggcagctggtttgcctcaccctggtctcaggtaggggaggccctcggttcctggagagtgggcgagcacagcttggcctggggttggccgctggctcccggggatgcttctgcgagggtgttttccccaaagctggccaagctactgcatgaggttttctttccagagcatgtgcgggtggcctggttcctgggtgtgggtgtggctttctgaggatggtctccaagtgttgctgaatcttttagggcacatatgttttcctctaaatgtcacccaattaagtataaggaaatgcaatgccttgggtaaaatctgggctgaattccccagagatgagtgtgaacaggaaaggaatgcgagccctgggataaataggtggttgttcttttcagcccaccctcagccctcactgtttcctgatcgggtcgctagcagcctcatgcccaccatggagcgggggttccttcctcggggtctttgttcctgtgtttctcctcgtctgtgcccgcgcctcccaccacccctgcgatgctgctggcatttctgctttcgggtcggggtgggcccagaccccttaggagttccgaaggctgacactcggttctctgcagcacactgcaagcgtgtgcactggcttgtggctgcccggtagagaggcgcttcatctggtctccttttcccatctcttggctgggagagtgagcctctttctaatttacacagaggccctctgcctgctgcagaggccctggctctgattctctccttttggagagatggaggtggaaggaagcaggcggaagggaataggagtgactgcgtgtggcaacagcccctacatgtgctctctcactgtctcgcccatctccatgtgggtccctaactgggtgccacagtggaatggacaggaataagtgcagggacaacagctagccaccgtggagagccctgtgtgctggcgctgctctgagtcaattcctttctctctcctattagccctctaagggggtaaccttatcatccctatttcacagatgaggcaactgaggcacagagtcagctcccacagcgctagtgagaggcacaagctcacctgctcgatggggtccacacgtgtcatttggctttggagaatagtcactgcactggggtccttgggtcctagacatggtcctgcccggcgccctctgctctatatccccacttctaggaggcagacagaggttgcatttcctgggcgagggcagcagaacaaagacccggtcgaagcctattgtcatgggggctgaatgctggttgctaaaaagcaaatgacaatgacctcatgcatgtgcttctgcttcccacctcatcaaaacacctccgcctccggccagggttgcatgaccataacaggtggcacacccaaggtgaagtcttacgttgatcgtgccaccaagacacccgtcaccaaagcctttcccgcatcctccgtggtttccagcatctgattccagaggccattgggctgtggcctgtgctctgtcattcagaaaaactttcacaggtctttgcctgtctccaaagacatttcccaagtgatcagcgtggtgtctggtgccataggaataaccctatccacagtgtacgtacagccttccctctctgcccacctcttgccactgtccacagagaagtccgtgcttggcctctcacaagagtcctcttcccagtttgcccactcatccacctcttcaggccaacctgttctgggtccccctgcactgtaccaggtgttgctgtgagctatcagcataacaagcccatcccaaggaggagggagcaccctcccagggagcacctcacaccctcaacctcccccagggcctgtgctaaaaggaagtatggacagaaaacagacagctgcctggacacgcttcccatcccattgtgggccccgagcctagtaaggccagcatagatcaaggctactcaaaagcagataggatccctgtaatcccagcactttgggaggccgaggcacgtggattacctgaggtcaggagtttgagaccagcctgcccaacatggtgaaaccctgtctctactaaaaaatacaaaaattaaccgggtgtggtggtgcacgcctgtaatcccagctactcaggaggctgaaacaggagaattgcttgaacccaggaggcagaggttgcagtgagcctggatggcaccactacactccagtctgggtaacagagagagactccgtctcaaaaaaaaaaaaaaaaaagcagattggatcacatgaaaaccatcaagaatgatgtttatccagattgctttgttatgctatgtgttttacatgtatattctatatatttaccagtgtgcatattcactcacatacgcactcacacacacatgcataaaccacatatacagtcatccctctctacgggaattggataccaaaatctgaggatgcacaagttcctgatagaagatggcacagtatttgcatgcagcctacacacatcctccaggtggctgaagccatctctggattgttaataatgcctaatacatgctgcacacttcttcgttctcatggcgtcaatgtagtaagtggtgcgctttttggaattttgtgaaatttttttttcaaatatttttgatctgcagttggttgatttggttggttgatttcagggatgtgcaacccacagataaggagggctcactgtctttgatataccatatatatgccagccatgcgcctaacccatagtaagtattcaggaaatgcttgctgaatggtgaattttaaaggaaaggcaaattcaatgagcgggtcccggcagctactaatattccgtctttagagaagtttcctcctgcagcacagaacatcaaagcacacactggtctggggtttttctttcattgtgcgtggatactgtgcatctgttgagagacctggttttgacagtatcatctttaaaagccaaaggtaaccctcactggccaaccatgtgcttcctggctgctgacccatgatgcaagtggaaacagatacacccaagcacactgctggtttggggtgggctggagagtgcatgtgtgggtttaggagagacaggtcatgtcctcgtgtgtgtgtgtgtgtgtgtgtgtgtgtgcatgtgatcagaagagggagaggcgctgccagagaaagcaaacggaatgtggccagacgagctcataaacagtcgtgcacagttcacatcccagtcaggtggccaggtcccctagtaaccaatttgattgggtttttaaggattgaagaattcctgagactgacctgccagtggggcaaaacccaccataggccactccgcaggcagaggagtgcagaaattagtgcaggtgcctgttgggcagccggggtcaaggtgtgaacaaaggaggctgagctcagcagccaagcatcccccaaatgcttggtcagatggaaccatttgtccctgacgatgaccagctctccccaagcctgtgtctctcctctcatgtccaccatcctccagctcgtaggaccccacccacactgcgcagcccatctctcatccttcctagcccccaattcccttttctgtggccacttccagcccgccactggtcatctctcctctggagagggaccccacactgtgtctcattggcagcgtcctgcgctgagtaatgtctccaaaactcatgtccacccgggacctcagaatataatcttattggaaatagatgcagatgtaatgacctgggctgacatcatcctggattagagtgggcactaaactcaaagactggctgtcctcgtgagaagaccacaggaagacacagagactcctcacatggggagcaagtggtgggtggcactggctgtgtgatgggtgacagaggcaggcatcggagtggtgcccatatgacaaagaacaccgaggactgccagcaccaccagattctgcaccaggcatgacgggccctccctcaacctccagaaggcaccacctctgctgctcataccttaattttggatttctggcgtcctaaactgtgaaagaataaatttctgttattttgagcccctagtttgtagcaattattacagcagccccagggaactcacatgggtgttatttgtgtccttgtctcattttgtctgttcctgaccccagagagggtcagctgcctgaaggcaagtgccttctttcactttatatgctgcagagccctagcccagagccacgaggaccagagatatgtgagcagcaggggctggatctcactgaatgcccgtggcttctgctggcaattggactcctcccgtgtcaagctagagacacagaatcaagacctcagggccctgtgcctcgcagcccctgtggccaggacattgagaagtgagggacttgctggcttgtccactctcggccttcctgactccccctgaaccgaagtagccccaactctgcaggcctctggcatcactcacacccaccacctaccgagacctaaaatcagcatctgccaagttcaacccagccctgcacgggaagctgcaatggaccaggcgagtttgacataggcaaaaaaaaaaaaaaaaacaaaaaaacaaaaaaacattcttattgttttatctaaatctaaaggaaacaaacaaatatttatctgaaccaatttaatccgccctggaatcttttttcggtattagctaaaatttaactaaaataaaaccagctcgaaatcccctccaaatgacacgacccttcactccgctcgctggagctccgggtgtgcatgtgtgagacggcgttgctgtgtattagtctgctccttttttttttttttttttgagatgaagccttgctctgtcaccaggctggagtgcagtggggtgatcttggctcactgcaatttccgcctccccagttcaagtgattctcctgtctcagccccccgagtagctgggactacacgtgcacaccaccatgcccagctagtttttgtttttgttttttttggttgttttttttttgagatggagtctcactttgtcacccaggcccaatctcggctcactgcaagctccgcctcccgggttcaagccattctcctgcctcagcctcccaagtagctgggactacaggcacccgccaccacgcctggctaattgtttgtattttttagtacagttggggtttcaccatgttggccaggatggtctcgatctcctgaccttgtaatccactcgcctcagcctcccaaagtgctgggattacaggcgtgagccactgcactcggccatcggttcgcttctttaaaaaccgtagtgtccgagcctgtctgctgctgtatttctttatttctccacagaatgtttggtcccagtccctgagctctgcagggactgggaacccggggagaagcagcttgtaaagagctctccccagctctgcgtgctttgctgtgttgtgggccagctccacctctgcttcctgtttacctccaaaccagatgcagctttttcatttagaaatacatgaacccctcccccaaaagtattccagttagaaataaataattgaaattaaattattggagcagggagcatttgaactctatcctttgcaagcatgtcctattttaaatggacaaaaagtatcagtagctacaaactttgcccaggagacctcttgtcattttctctctttttttgttgttttttgttgttgttattttttttttttttttgagacagagttttgctcttgtcacccaggctgtagtgcagtggtgcaatctcagctcactgcaacctccaccttccaggttcatgcaattctcctgcctcagccttccaaatagctgggattacaggtgtgctccaccactcccagctaatttttgtaattttagtagagacggggttttgccgtgttggccaggctggtctcgaactcctgacctcaggttcgagaagtggattcgcccacttcggcttcccaaagtgctgggatttcaggcatgagccgctgcacccagcccccttccttttgttttcttctgagtctgctgtcttttgagtcaggtaaagcagcaagtgagctaggcagctgagtcgaggcatttctcaggcagatactttgccttctctgtctgtgggaaatgtgggtcagggacaaagaggaaactgaggacgctgaaactgaaccctaacctctggctgccaagcccacgttcaccaccctcctgcttactgcagagacttcaggcaaatttagaaagtggaaaacaagctttatcattatttaacgtataccctaaaatacatctaaaacctaaactgtatcttcaatagctgttgccggtctgagatactcaatctgtttgtctaagtcatttttaccacaagctggctgaagtctttatccaccatgattcatctgctatgttctgaggttgtaacttttcctgggggtggtaatggctgaaagggctgtgtttaccatagcacttgtgcccaagtctctgccttcacactgtgggaaattgtcagacggtaatgaatggcccgggcctggctgaactttgccaccagacaggcttattcttgtgacagtctaaagatcgcccttcctattatttggtctgcaggatttccattgatttaaatgttttgcttatcttcacatttcatggtgcagggcagcgcaggactgatttaaatcactgcagtcatttgggcttagtgtcaggttgttcccacgctaatttggtctgggaatggcttgcatgcgatcacctgttggaaactgaccccacatgcagagacagggtgtgccctcagtgctgggcagtgtggggggtgggggctggctcattctgggagctccccacaatttggtcaatttgtgaccaggacagcgcacacactgatttggaaactcatgggcactgaggggcagcagccgtgtcagagaatgaatttgattttccaccgtggcaattaagactgcatgagactgcattctgcaccaagtgcacacgggagcacacatgtgcctgcgtgtgtacgcaaacacacacagagtgca

SEQ ID NO: 1218 - DNA, 27994 bp, Homo sapiens
agaaaactgtacacatgtgcaaatgattgtgttcaaagtaattcattacaacatttttgataagagaatgattacacaaaattataaagaaacacaacgtttatcagtactgagttggttaattaagataccttaataagaaggaatatcatgtatccccaaacaatgtacagccatatttattgatgtggaaagagatacctagcatgttgaatgggatatacagtgaggaagaagcaggttccagagcaggatgtatagtaacattaccctatttgtggaaaactctgtgtgggggtgtgggggaaggtagagagacagagtggataaaattatatttctaaaaactaataatgatggctgggcttgagtgtgttttagttaatagtaatggttttctttttttatactttacaattttacagtgaaaatatatgatctttacaattagaaaaagcaataaagtaattgccatgccagaggatgggaatgtctttgacaataagcacaccaactagaagtactaaaaaaagaagaagaatcagttgtgctcaaaatagtcaaaacatataaaaggcaaatacagaactgttatgactggtcagcttgctagtctaaaaaacttaagatcaaagatgactatgactgaccaaccactgaaatcatccagtaaaatttataaagaaaacatttgctgattgctccaacaaatgtcaggcattgtgttgggcactagaaaaataaataggaagattaagaagtcattccctggtcttgaggaacatagtataatgggataaaaatgcctatacacagaccacttcaaaacaacacagtgttacaagacaggcatgcaaaagccctataggaggaaaaaataggtacctagctgtctgtggggaagtcttttcatttataagatcccccatcttttctagccttgtgatttatttgttgaagaaagtgaagtttctctgtagattttccagagcctagattttactgattgcacccctgtagtgtcatttgagatgttcttctgtggtttttgtaaattgagaattgaatctagcgccttagtcatatttaggttagaatttttttcaggaagatcactttataaaggataatgtgttattttttcaggaaatgtttggttgcttccttctatgaaattagtagacgatgatcaatgcctaaatccattatttttttaatttttaaaatttatttatttttttaagagacaaggtctcactctgtcgctcaggctgaagtgcagtggtacgatcatacctcactgcagccttgaactcctggcctaaaatgatccttctgcctcagcctcctacgtagctgggactacaggcacgtgccatcacactgggctaatttttctatttttttgtagagatggagtcttactatgttgcccaggctggtcttatattcctgggctcaagtgattctcccatcttggcctcccaaaatgctgggataacaggcacaagccacagtccccagcccacctaaatccattaattaattaaggttgccaaacggtaatatcctgtcatttctttttaattttgcatctggagtacatttatgaagagtgctttccctcatctactatttgctttgccagtgaaccatcatatgagaggcaggaataaatgcttgattcttttccattacctgccagtttgcaaaataataaattggtgcactacaatcctccaaaaacgatcaattacatcttattttttagcatcatttataaactcacagatgaaacatatttgatgagtctcagtatattagagttattattcttatggatgattaacttgtcccatctttggcaaatgaaaaaaacaatgcaagctggtttttgattcaatcatagtggtctgtgacaattttctgttatgacaagacgttccagactcttatttttttttcccccgacctggagtcagtcattttaccaagaagctgtagttttcttaagaaacatttttttcaaaccacaacgtgagcattcattgtggattggtcactgtttctagacaatttaagtacaaagagttggggagaaatgcttccaacaaaaaaaaaaaagtatccagacttcatactgatatttccaactcaaattcaggactataaggtttttacttaatcttttctgtcttgtatctgtacatcatttttcccaagctgagagttattctcaaggacaccaactatgaaagaattaaaagtatatcatttaatggcgtgaacccggtaggcggagcttgcagtgagccgagatcgcgccactgcactccagcctgggtgacagagcaagactccatctaaaaaaaaaaaaaaaaaaaaagtatatcatttaattactcatctgtgttgttctaagaatggcatcttaagaaatcccaagattctacgttcagacagagacagacaagtctgcaaagaagaccgaaagggcacccatacagaagacagaaaaccaccagagtacaatgacatggaaaccaaaggaagaaaatataagaaaaatgaaataattaaatatttagtgctactcaagagccaagttaggcaagtactgaaaaaattcaacgggatttagcaaaatgaaagtcactgataatctcaggctgcaaacagataaaagtagggtcaggaataaaaaggaggtaagaaattcttaaaagtagctgtgaagggaaaaaagataatgcaataattggagacagactatgggaattttggaagtcttttaaaataagaaaggtttgatcttgatcacatccttgtgaaaataatttagttaagacagagtctgcatatactagaacaagaatgtaagattcctgaggcgatggtgggaaagaacagaatccaaagcacatggtaatatattaacctgaagtatgtctataattcctcattgcaatgtttattgagtatccagtgtgataggtactgagaatagagataaaagatgaagtccttagcttcatagaactcgtggtctagaggggaaatcagacaagcaaataatgataataatgtagtatgataaatgctgtgaacacagaatcacactgcagccagacaaggacctgggattaaagaatctgctcacaaagcacatgaacagacacttctgaaaagaagacacacatgcagccaacaagcatatgaaaaaaacctcaacatcactgatcatgagagaaatgcaattcaaaaccacaataagataccatctcacaccagtcagaatggctattatcaaaaagtaaaaaaggaataacagatgctggtgaggttgtggagaaaagggaacacttatacactgttggtgggagtcttagtttaaccactgtagaaagcagtatggcgattcctcaaagagcaaaaagcaaaactaccattcgacccagcaatcccattactgtgtatatacccggaggaatataaatcatgctactataaagacatatgcacatgaatgttcactgcagcactattcacaatagcaaaagacatggaatcaacctaaaagcccatcaatgacagactggataaagaaatcaagtaaatgtggtacatatacacagggaataccatgcagccataaaaaagaacaagatcatcatgtcttgcaaaaacatggatggagctgggaaccactatccttagcaaactaatgcaggaagagaaaaccaaatactgcatgttctcacttagaagttgtagctaaatgataagaacttatgaacacaaagaaggaaaaaacagacacaggggtctacctgagaagggagggtggaggagagagaggagcagaaaagataactattgggtactgggcttaatacctgagtgatgaaataatctgtacaactaacccctgtaacacgagtttacctaataaaccttcacatgtccccaaacctaaaagtttaaaaaaagtattaatctacattaaaaaataaaaaataataaaagaaaagaaaaactcaaaaaaatctgctcacaaatgtcaatgagaaatttccaaatgaaatagacaagcaaaacatacagaaaaacaaacatgccatgcatgcttccctctaccaccccccactcccaaatctccacatttggattactactatctttgctttgcgggcatggacatgactggctacttcccatctttcaaatacaggaaagcctcaactttacccttcccccatcacaccactttgttacttcattcagaactcttatagaatctataattatcttgttcatttatgtattacttcttatttttatatctcctctaatacagccaaaatacatgagggcagggaccttatctatttgtataactgctctattaccagtcccttaaatagtgcctcatatttaatgaataaatgaatgaatagtacagacagcattagaaaatttagttacttaacacttctaggagtttagattccaggttaaatagaaattgaacactatctataaactacgtttgatttccaatataagcaatataattttaaactcatctctgaaggtgaaaggcatgcaattttgagttccgaatccaaattcttttccatttgactactaactccattaataaattcccaaataaatctagtaagtctttacattgcatttaaaattctccttcaaagaaatttcaaatcaacaaggtaaattaatgaaaaatgttgaggtagttgacacttagcaggaaaaagatgaattcctatttcaatctctcatcaaaataaattatagatcaaaggctaaaataataaaaataaaaccacaaaaatactagaagagctttaaagagaccggattttataggtgagaaaggcatttcttagcataagccagaacatttataagatgtaatttttaaagcatctattaatacacagcaagtgataccataaacgcaggaggaagaaaatgacaaactgaaaaaatctattgtttgttatatatataacaaagaattagtatccacaatatgtaaataattcctaaaattagtcagaaagagacaaacttaaaaagagggtaacaaggaggggagcaaattatgtacataaccagatgattcgcaaagacggcaacagagatggccagcaaaacaaactagatatatacttgtctattagatttatcaacattttttgcctttttcattaaaagcatttgtaaaaggatataggaaaagaggaactctcatatactcctggcagggatgtaaattggtacaacccttttgaaggacaatctgacaaaagcaatcgtaagttacaagtcaacatctatgaatgtatatgaaaatatttatatacatacatcaccaccataaaagcattttctatacatactgtttataattagaaaattggaaacaaatgattaaaagggggctgattaaattaaggttcatctatataacaggattatgcagctattaaaaaggacgtggtaactctatagacattcataggaaaataaattttaaaatactaagatcctgaatgatatatatatcatgagctattatacataacaagatcccacttgtgttataaaaaattatgtttagtcattcaaagggtctggtatgatagacccaaaatgttaatagagtcgagatttttattttttataggtttttgaaatacctgaattttcacaataagtactttgcacattaaaaatcttagctgggcatggtggctcacgcttgtaatcccagcactctgggaggccaaggtaggcagatcacctgaggtcaggagttcgagaccagtctggccaacatggtgaaaccccgtctctactaaaaatacaaaaattagccaggcttggttgggggtgcctgtaattccagatactcgggaagctgagacaggagaatcgcttgaacccaggagggggaagttgcagtgagctgagatcacgacgctgcactccagcctgggcaacaaagagcaaaactccgtctcaaaaataaataaagaaaaaatctttacatgtccaaagatacggctgttcaactaaaaaatatatatgtataaaacttaacatgttaatagtgaacacacaaaacagtaagatagataaaattattccttcaaagctcacttaacctctggatctacactgtccaaaaagacggtctaatgagacaattgagcacttgataggtgagtggttctaactgagatatgttctcagtataaaacatacaataggatcttcctatacaacattaattaaaaaacaaactattgtagttaaaaaggaaaaaattagagatactatgtaaaaaagagccaaaataccttgtattttatttgaaagacatatctccataagattacacaacctcgtgtaggataaaggactttgctttgcttggaatttaaacaatttaggctcttaaatgtcctaaaattctctgtagctaagaaatttttatattggttcctaggaactaggaatccttaaattaggccctacatttgcttacaagtttattttccttggcataaaattttttagtttttacattactggttatatttgatcagggttctatttaaataggcacaagttcaagcaaagatcagattctgcttttagcagtgtgtactcagacaggaagtattaaaaggcaggcagaaaatcctttataaaattactactttcaatgcattttcccacgttgaaatgcttctgcagtttataattaggcaaattactttaattataatcaataatgctgttcaaattactataagaattatacagatatttataccaagagacaatatactagaaaccaagactacgtgaccattacctctactctgtcagtgttatttgtgagaaattgcacaaattttgcaaaaagtgttagtatcctactacagtaggatataatatagaaggaaataatttcataaagcctgtctttggtactagtgctcagttactttcattaactaaaaaaggggctactcttcaaattcccttctctaaaaagaatgtactatatcaaaagggggtaaacactactacgtatacattctgcacttagaaatccctatatgttgattttatcattctcttattcaataaatattgtttctacaatgtgtaaggcattactgtactaaagcattataaggaatataagttaaaaacacatacaaatcttgccaatcaacagcttatagtgtaataggggagagaagctggcccatctatattctccctcaactagcaagtggatgaaatatcagggtcaatagttataagccacaaaagctgacagcttaattaagagaagttttgaaatatgtatttcatgaccaataattacaactgtaacttttctatttaaagaaggagaaaatttgaatttcttctctagctcaacatacacttctataattccattacatgaaccagagtaaagggtaagatggaaatgaagaatattttcttacccttttgtggttctatattggacacttaaaaatcatacacaacctaatcaaaagatgtaattctttaaaaaggtacgagaccaaaattcagaaaatctagactataacaaaatttctcaatttacattatcttaatatgcaattaattttcaccagtaaaatactatagtatgggtacaaatgcattgattagttctaattacaaaaatggctaatatataatactgtgtagtgtttatgatacatcagataatgttctaagtgctctgaaaatataaacttttaatcttttatacgaccctataaaataggtgttattctcactggagagatgagaaaacaggggttcagagatgtgaagtaatttgaccaaaggtcacaaagctgaagaatatgaaatccgggattctgattcaggcagtcttattccagaatcatgctcttaaccactatggaatactgcctctactgtaactattatacccaaaacccttaatcctaagtcatcaaaaggaagagcctctattttacacaatgaagaggcatttctaagaatagaaatttagggacgagcacagtggcttactcctttaatatcagcactttgagaggctgatatgggaggttcacttgaagtcaggagttcaaggtcagcttgggcaacatagtgaaacacagtctctacaaaatatttaaaaattagctgggtgtggtggcatgcatctatagtctcagctacttgggagacagagggaggaggcttgctcgagcccaggagttcgtggctatagtgagctatgatcatgccactgcactccagcctggacaacagagcaagaccctgtctctaaaaaagaaaagaaatttggaaatggtttattttgtattaacaatttataatttacactgaaatttattatgataaaacttttccctgtgttaaaaagctattaactttatgaaaaatttcttttaggtaaggttgattatatatacccacacacatacacaggttaaaagttagtttcatgtgacataataactagcattttgagcactacctgtttgcccagcactgttctaagtgctctacatgtattattgttaaattatcataacactatgaattatgtactataattaccccagctttacagatgaggagactaatccatggggaggttaagtaacttgtccaaggccagacagctagagccggcttttggacccacaccacagtctgactccagcacccatattcttaacaatttcaccatattaatatgtcaagattaagcagttttaaaggatgctattttctcacaaatttcttaatatgaacactcaataagaataatcactaatataagcatttagtatttttttaacactaagttggaagcatagtggaacatttatttttagaaatattattaattggctgggctcacgcttgtaatcggctgggctcatgcctgtaaattttgggaggccaaggtaaaagaattgcttgagcccagtatttccagaccagcatgggcaatacattaagacatcatctttaaaaaaaaaatgttattaatctcctctttttgttaaatgtatattatcaaaattgttactaagctaacaaacttcagaaaaacttatgatgggcaagctgcttgtgacattgaaggtatttaagattcaattctagtttggtcctagatgaccacatatccattgttccttcaacgagcacatggtaaagagcctagaacacagagacacagaacacagtggagaaaagggagtgaaatgtctttaatgacacttactatatatgggattttgtgacaatatacaaggatggttaagacatataaggtgatgcaaaaaaacatattaacaattatagtgacaaaaaatgaggagcatataattatacattgatttatacagagtaccagaggaacacagcattgagagccgtaacaccacctgagggagtggagaaaggcttcagagagaaagtgttttttggaatggatcactgtttccaaaagaactaaagtacagtttgagaaatgcatacttaattcattacttttttcccctcaactttaataataaatttacccaacaaaaaagtttatttttgacttgtaaatctcttaaaatcataaaaaagtaaaattagcttttaaaaacaggtagtcaccatagcattgaatgtgtagtttataatacagcaaagttaaatacaatttcaaattacctattaagttagttgctcatttctttgatttcatttagcattgatctaactcaatgtggaagaaggttacattcgtgcaagttaacacggcttaatgattaactatgttcacctaccaaccttaccttttctgggcaaatattggtatatatagagttaagaagtctaggtctgcttccagaagaaaacagttccacgttgcttgaaattgaaaatcaagataaaaatgttcacaattaagctccttctttttattgttcctctagttatttcctccagaattgatcaagacaattcatcatttgattctctatctccagagccaaaatcaagatttgctatgttagacgatgtaaaaattttagccaatggcctccttcagttgggacatggtcttaaagactttgtccataagacgaagggccaaattaatgacatatttcaaaaactcaacatatttgatcagtctttttatgatctatcgctgcaaaccagtgaaatcaaagaagaagaaaaggaactgagaagaactacatataaactacaagtcaaaaatgaagaggtaaagaatatgtcacttgaactcaactcaaaacttgaaagcctcctagaagaaaaaattctacttcaacaaaaagtgaaatatttagaagagcaactaactaacttaattcaaaatcaacctgaaactccagaacacccagaagtaacttcacttaaagtaagtagaaaataaagagggttcatgtttatgttttcaatgtggatcttttaaaaaaaatatttctaaggcatgccatttgaaatactttgttgcattgttgaaatacttttttttccaagaaaaataatctccagaaaataaaatttcctattataatttcaagttagttttttgtttccctaatgttatatatgaaaacactgaaaatttgcattttatatgaaaattacaaatcggttaaattatacaatctagaacactatgtcattacactattgtaaattactgaaggtaagtaaaaagttaaaaaaaatttaaaactattctccagtgtttaaaacagattaaataatacagtaaatggaaaagatttattcatatgaaaatatgctgggctttttcttttaattgaagttcagaaaatcaaattttagagatagtacaatttaaataaaatgttaaggacaaaaatatgtgctatttgaaagaagcatacaaggggaaggaattgccaatattcatttttcaaatccattattagtttaaaaatttagattatgatagtgttacaggaaattaatagaaaagaaagaggaaagcaacttataaccaacctactctctatatccagacttttgtagaaaaacaagataatagcatcaaagaccttctccagaccgtggaagaccaatataaacaattaaaccaacagcatagtcaaataaaagaaatagaaaatcaggtaagtcagtattttaatggtatgtcccatctttcacacaggtctgtaaaaacactgaatcctaaaattatttacaagctttaactggatcatgagtaaaattatcacatcagcataactgttaaaattgcaggctctgaagctaataaactacctgcatttaaaccatggctctaaaactttgtgtgaccttgaataaattacttcacccctttatctctcagtttcctcacatatactacaaagataataacagaacttataggattattgtaagaaaaaaaattaattcatagcagccaatgtcatcttactaaaattcaaattagatcatgtttctctttgctcaaaaccacacaatagctttccatttcactcatattggctctttagaccaagattacccaacccttcgtcatctcactgacttcacctcctctactctagttattctgaccgctttaccagtattcaaacacatcaaacatactgccacctcaaagcctttgcccttgttgtttcctctaactggaacgctcttctgccctggtatctacgtggcccactctctgatttcccttagggtcgttatcaaacaaaaaattcccaatgaagacttacaaggtcacttaaccaaaaatcacaaccgcctggtcccatccctgaaaacttctacttccttagctacttttctcctgcacactcacctttatttaacataacataaattttagttatttatctcttctattcctgcactaaaatgtaagctctgtgaatacagggattttttccattatcttcatattttccattatttgtatatactccagaatatagaatactgtatggcacacagtaggcatttctgttgaattaataaatgtaatgtcatattcacacagaagcgtgtgctatgattattattacttggattactagaaatagtgtgcctcataattaaaggtcaacattcaacaatgtaattaatctacaatgtaaacatctggtgaagtgacagagggaagcacttgtttagaaaaaagctatgtcagaatccatgtattctaatatgcagtacaatagtttaaaaatattaataatactctcaaacagctattcaagaggattcaaaaaacataatataaactcagagaaactggtaaacaaaatcattttcaagagatataaaacaaatattattaccaatttccactaaacaaacataatgttagtagtgctgctaaaaggttttttatcaactacttttggtttccatactttccttcttatgatgttattattctaaattcttttcaattatatcttttactatgattaaatgaacctgctccccaaagcaaaatgttactatagtaatatacattgtgtctaaaaataaaaatgtgtgaagaaaccaaaacaatgaatttctgagttggaagaagagttagatcatttaactttctcatatttaaattaaaaaaacaaaactctaaaaatttaagtaactttaagatcacatagttacttagtagaaaagagtaatacccagcaagcaaactttacaatagatccttttaaataaggtcctaggaaatatcattcatgccagcatcaaaaaactaacactaataatgcaagatattatatattctgcttttcttactgtcaatgagaaaaactatcattcaataaattgcaaacccaacacacttaaataaaaataaaatgttactgctaaactaacgataaactactgaatatatagaaagtaagcaaacaaacttgccaacctgccaacatctacagatatgtttacaggtcaaaaattatcaaattatcaagaaagcctggttcaaattatgtattatgtctttatcacaggtctgaagatcagtaagacctaaaactgaaaattattaaacttaaaatctgaacagaatatcaaatatattttattcatataaataaaagaatacattacaatattctaagcaaagcagtctctacttttggccttgctctgttttccgaccaatgtctgcttttttgccttgctttatttttttatcttattaaataatgtccctgattaaatattttgagaacaggtaatctgtacaatctgaataacactgtttatctaaatatcaaacaccgttataacattatgaactgaaagacaaactgtacttctgacatccttactcagatttcccctaattgtatattcagtatcattttaaaaaacagatttatattcttttatcagctcagaaggactagtattcaagaacccacagaaatttctctatcttccaagccaagagcaccaagaactactccctttcttcagttgaatgaaataagaaatgtaaaacatgatggtaagacactttggtgggtttccttcttgaagctattattatcaaattccctattcttaggacttgttctagactaaaagatagttaagagatatccatcaaatacaatgtatcaacctaaactggatgctggggttctttttacaccctataaaagacatacctaagacaatcagagaaatacaaatatggacttgattattagataatatagaaggtttattaattttcttagatgtgatcatggtattgcagttttaaaggagaacaatctcctgtttaagagatacatgctgaaatatttacggagttaaaggtcactggactccagactggtgatagaacaagactctgtctctaaaaaataattaattttttaaaagaaaatagtttggtaagatgattcttacattcttaaataacacgccatctaagaaaaatgctttaacataaacattactgaaaaaatgctacatttgccacaacttcataaaatgtcaagtgaaatctcaagctccaaagatattattcctattactaaatctgatgtaataacattttattgattctaggcattcctgctgaatgtaccaccatttataacagaggtgaacatacaagtggcatgtatgccatcagacccagcaactctcaagtttttcatgtctactgtgatgttatatcaggtaaaacctgtctaaggagaatagacagtagttagttcaacttactcattacgtattaggaagattaacctggttatcattgttttatacatatatatatgaaatatatatgagtattcgtataaatataatacttttaccttgtttatgtatttactcaatattctccttttcctctaaaataatctgaagtgactattatcaataagtttactatgccaaaattcattaattgcctttcacttaacttttgggaccataataaataataaaatgtattgccataacattaataaactaccttacaaaaccaccaattaaaatcaaacaaacaaaaaagtgttatttacatctgtcaacataaatctactaaaaatacatgatttcattcattatattcaggtagtccatggacattaattcaacatcgaatagatggatcacaaaacttcaatgaaacgtgggagaactacaaatatggttttgggaggcttgatggtaaggggactacattcaatcattcattcacttgctaatctacaaatatttactgagaacctcttatggaccaggtattaggaaaagtagtaacgaacgagaagcagtctcagccttcatataatttattatcaaacaattacacatttgttagtaaattacacttattacaactgttattatttgaattatatttatcacaattacatgtctgttcttaaatatacttatcacaatttaattccacggcttacaatgatcataactataattattaaagacaattttgattaaatgttatgtcataagtagtaactgttacaaataagctgtgaaaagaaccactcctagcattagtcactctattctctcattaacgttttacatatcaattaattggaagttaaaaggaccaggaaactcagacatacagtatacattttaaaatttcaattatttaaatataatatatagaatgtatggcttataatgaattagttaactcaatgcaaattattctattttgattacaaatagtaaaataagcaagataaaataacagatgtttaaaatccaaaaagcacatacaaaaatccatgaatgatgtctaagtactcacttataaagtagaagacattcattattatatcaaatttttaaatgctcagtactatttgaccatttaaaaattttgtattcaaactaccagtgaaagccctacctagaaggtatactcagtgataagttttgtagctccaaatcttctaatagtgagtgtaaccccaaaataaaaggctgacaggtaagtcgagaatactcacttaattctggtaagaaagcaacccatttgtacttgtatttaccagcaatccttaaaatgaagcttcctactaactcaatagcaataagacaatagtgaatgtttaatgaaaacagtattttataaatactttaataaaaaggattgtgatgaagaacaatctatttatatttgttatttgtttttaattccaataaaaataatttttaaaattacagaaaaaagttattaagaaccatgcttttaaatttaaaatgattttttaaatttattcctgtctttttctacaaagaaagcatacattaagcaaataccaaaggccaggtttacatttgaagaaagtgacattattattactcaagtctctaggaatacttaacacatctcttgactgtatatggatgttaataaatagctgacagtaaagtttatccatataaagacttgcaaatattcctctaccaatgacgagactttaaaatatctataataatgtaacacatttcactggtgaaacatgtcttgtcatatgcattatagaaaggataatcagactttcagttatattaatatttttaacatttttgtgcacatagctatcttcaataaaattgttttaaaaggtattattttaagatacactaaaatgatcaagggattcaagactaaacaactcaattagttgcaccaataaaaaacacttaaaaaaactgtcagtgtccaacctgtacttaataactcacagatttttaaaacttttcttttcaggagaattttggttgggcctagagaagatatactccatagtgaagcaatctaattatgttttacgaattgagttggaagactggaaagacaacaaacattatattgaatattctttttacttgggaaatcacgaaaccaactatacgctacatctagttgcgattactggcaatgtccccaatgcaatcccggaaaacaaagatttggtgttttctacttgggatcacaaagcaaaaggacacttcaactgtccagagggttattcaggtatctttttctgataccaatactttattttcatatcttcaaagtatcttcccacattattagctattatctgcaatgacaacttttaaaaatccgaatcccaaataagcgttttctctctagacgaaaacctcttaactataatgaaagtgttcattctagttcaatcaggtattttacctctaatcttcctcagattttctattttttggtagtgtatagattatttatacagattatttaaaattgggacttatacagattatttaaaactgggatacatgcatctaaaacactgtaatatttataagaaaggaagataaacttacggggaaatacagtaacagtaactacatacgagtctgtacccattaaattgcatatctatctcctttaggaggctggtggtggcatgatgagtgtggagaaaacaacctaaatggtaaatataacaaaccaagagcaaaatctaagccagagaggagaagaggattatcttggaagtctcaaaatggaaggttatactctataaaatcaaccaaaatgttgatccatccaacagattcagaaagctttgaatgaactgaggcaaatttaaaaggcaataatttaaacattaacctcattccaagttaatgtggtctaataatctggtattaaatccttaagagaaagcttgagaaatagattttttttatcttaaagtcactgtctatttaagattaaacatacaatcacataaccttaaagaataccgtttacatttctcaatcaaaattcttataatactatttgttttaaattttgtgatgtgggaatcaattttagatggtcacaatctagattataatcaataggtgaacttattaaataacttttctaaataaaaaatttagagacttttattttaaaaggcatcatatgagctaatatcacaactttcccagtttaaaaaactagtactcttgttaaaactctaaacttgactaaatacagaggactggtaattgtacagttcttaaatgttgtagtattaatttcaaaactaaaaatcgtcagcacagagtatgtgtaaaaatctgtaatacaaatttttaaactgatgcttcattttgctacaaaataatttggagtaaatgtttgatatgatttatttatgaaacctaatgaagcagaattaaatactgtattaaaataagttcgctgtctttaaacaaatggagatgactactaagtcacattgactttaacatgaggtatcactataccttatttgttaaaatatatactgtatacattttatatattttaacacttaatactatgaaaacaaataattgtaaaggaatcttgtcagattacagtaagaatgaacatatttgtggcatcgagttaaagtttatatttcccctaaatatgctgtgattctaatacattcgtgtaggttttcaagtagaaataaacctcgtaacaagttactgaacgtttaaacagcctgacaagcatgtatatatgtttaaaattcaataaacaaagacccagtccctaaattatagaaatttaaattattcttgcatgtttatcgacatcacaacagatccctaaatccctaaatccctaaagattagatacaaattttttaccacagtatcacttgtcagaatttatttttaaatatgattttttaaaactgccagtaagaaattttaaattaaacccatttgttaaaggatatagtgcccaagttatatggtgacctacctttgtcaatacttagcattatgtatttcaaattatccaatatacatgtcatatatatttttatatgtcacatatataaaagatatgtatgatctatgtgaatcctaagtaaatattttgttccagaaaagtacaaaataataaaggtaaaaataatctataattttcaggaccacagactaagctgtcgaaattaacgctgatttttttagggccagaataccaaaatggctcctctcttcccccaaaattggacaatttcaaatgcaaaataattcattatttaatatatgagttgcttcctctatttggtttccttaaaaaaaaaaaaaactctcataggacatgtttcattttgttcctttcaggagtagtaaattagacgttttccccatataaagcttttttctaccagaaagatacttctggtagaagaagagaaaggagctctttatggttcacacgactgtctcctgtcctaactactttgcttaaagtgctcaaattccatcactactcacagttgtctaatctaagtctaatcccctttgatctctcagactaccttcccttttatctctctactacttaataataagaatatctttttttcaaacttgaccttcattttgctttcacaatactatactctccatggattatcccttatctgaatccatctttataaccctattcctttctcatatttagtactgtgggccaatggacaaccttcaatcatcttttctacactgaccctcagacattctatctgctctcacggactcctttatttaccatgaataaagttccaaaatctacatattcatcccaagtctctttccagttccccttcttacattgcctatttgccatttctcccttcaataccctatacttcactcaaattcaacataccaaaaataaaaggccaggcacggtggctcacacctgtaatcccaggactttgggaggctgaggcaggtggatcacctgaggtcaggagtctgaccagcctgaccaatatggtgaaaccccgtctctacctaaaatacaaaaattagccaggcgtggtggcatgtgcctacagtcccagctactcaagaggctgagacaggagaatcgcttgaacccaggaggcggaggttgcagtgagctgagatcacaccaatgcactgggtgacagaacaagactgactcaaaaaaaaataaataacaaattccccagccccttactgctactgctatccctttctacccacctttccctcctttatactctttcacaccatcttcctcacttctttatatccattaatatgaccagcatgttcccagtcacagaagcctggaacccggaagacatctctggcttttcactcaactttgtaaactacctcttttgtatcataagccaccaagttcaatacaatcttctcttgaaacgtctcttaatcttataagctttcttccccaaagactgtctttaacttcagtgctagattatataagtagtctcttctttcctcctaattttacgtccctctccctgtcaatcttccgaaaaggaatttgtaatggctgcatactgcctggacctgtgtctttcaagctcatctactgaagaagtgtaacagcagaggataatgaaaacaaatccttttattgtctggagttacaggataaaataacttactatatgcacaaatttctttcagaatcttattgggatcttagcttaaatcttagaattttactttaaaattgcatatgaattgtgttttatactttataaatctatcttcatgcctgcagtggctcacacctgtaatccaagtattttgggaggccggggcgggagtactgcttgaacccaggagtccaagatcagcctgtgcaacacggcaaaactccacctctacaaaaaatacaaaaattagctgggtgtggtggcaggtgcctgtaatcccaactacttgggaggctgaggcaggagaatcgctggagcctgggaagtcaagcctgcagcgaaccatgatcctaacactgcattctagcctgggcaacagagtgagactctgtctcaaaaaaaatcttcatataaaaatatttatttccccccaagtatttaaaaagtgatgttcctagaagatgtgtcatgtttatcctgtgaacttgcacgtcccatatagttgtgccctcacaagaatgtatactccaattagaagagtataggcctttggaacaaaatccaaaatccttccaggttttcaaaagtctctatcacctggccccaaattacctcttcagccattttttcccacaacacaaaccttctgctctcatcaaaacgatctacttttaaacatctcctctatgccttcctaatgtattccatttgtctagaatgtctccccacacatttctgattggctagattgtgccgtattttaaggtgcagatatctcaattcttccacaaatattctagtaaatggcagcttgttcatctgaaaccacacagaattactgtccatacacctcaaatggcacttagtgagaaaatacacagaatatggcaaatcataataataaaaattctgaaaaatagtactaaaagctccaaaagcatcaaagatagtcagtttacctgattttagtgaattactgaaaaatttctatatcaagagtttattttgaaccagtatgaattttactgaaaccaagtacacacatgtctcattatgaggtaatctagtgtagtataatctatttccatacactctgtcatcctggaatcagcatattttcatgcttgtatctttacttcctaatagcataactcatggaagtcaactaactcattcattaattttagaaatggtattcattaaacaacacttattgagcatctactatttgtctcctttaaaaaacatattccaaatttgtactcatatatactctaccttctgctgtaggataatcaaatttccttgtgatttttttccccatcactaacagccataaactctgcacttatgtatgtactactgagtgattatcaaacacagcagttttaaaaatgaaaagaaagtgacccaacaattggcccttttatcaaagtccaaagtattatcatggcaaatcaactagggtaaaattacttaactggtgcacagttcaaggtcatgaaagtagcactaacaatcctctattataacccttaataaaatgaggttttaatgacattttaggaaatataaaataaacttaagaattctatctaaaatacaaaggctgtttttcctaaattcatgtttagtcctaagaacagtcatacatctaataaaatgactgggtatataatttgaaagagcaataaattactaccttgaagatgtaaggttgtagctatttatcttaaaatacacagtcaaacctcagtttccacacccaatagatgggaataataatcctgtcaaatctattaatacttcatgggattgtaatcatcaagccagataatgtatttgaatagctttatgaactataaagttctaaacaaatgtatatactttttaaaaacaggttcttccgtgtcatttttcacattcctttaagtaaataatctctacaaacgcttcctaactgaacatattataattctcaggacagaagaacaaaactgcccttctcagagtttgcatctgtttctggaactttactccttcccttcacaatctaagataacactccatcaccttcagatgcaagcccctaactaaaaacttctgggtggctatgttaaaatgttaggaaatagagctcttgactcagaattcttttttttttcgagatggagtctcgctctgtcacccaggctggagtgcagtggcactgcacagtgagctgagtgatctcagctctctgcaacctccgcctcctgggttcaagtgattctcctgcctcagactcctgagtagctaggattacaggtatgtgccaccatgcctggctaatttttgtatttttagtagagacggagtttcatcatgttggtcaggctggtcccgaactcctgacctcgtgatccgccttcctcggcctcccaaagtgctaagattacaggcgtgagcccccgcgcccagccgactcagtttttatagttaaaataaactaggaccaattcgatagaataaaactcagagtggtataacaaggacaaaaccaaaatagcagagtatgtggcagtagcttgagacatctatgaactctaaaaataaaaacaaaaaccaatactttctgaagcagagaaccatacacttgaatagaaaaaaaaatgctcctgaattttcagtaacgttcagctgaaatttatacttccttaaattatgaatgtagtaaaccaaccacagcagtattaccagtatataagattttgtcattaatagaaacatacatttactattattattattattattatactttaagttctgggatacatgcgcagaacgtgcagttttgttacataggtatacacgtggtatggtggtttgctgcacccatcaacccgtcatctacattaggtatttctcctaatgctatccctcccctagccccaccccgacaggtcccagtgtgtgatgttcctttccctgtgtccatgtgttctcattgtttagctcccacttatgagtgagaacatgtggtgtttggttttctgttcctgtgttagtttgctgagaatgatggtttccagcttcatccatgtccctacaaaggacatgaactcatccttttttatggctgcatagtattccatggtgtatatgtgccacattttcttcatccagtctatcattgatgggcatttgggttggttccaagtctttgttattgtgaatagtgctgcaataaacatgtgtgcatgtgtctttatagtagaatgatttataatcctttgaatatatacccaataatgggattactgggtcaaatggtatttctagttctagttccttgaggaatcgccacactgtcttccacaatggttgaactaatttgaaacatacatatttttatatcacaactattatagacatctcaaaatattgttgatgcttattactatttagaaaatacaatagttttttaacctgaggccagatcatgttatttcattcatcaataaacacatatatcacaactttaatattttgataattttaattcaatgtaactgatttcctttgttattctatatattttatttcatgcatttaaaaacatttaaacattacagattgagtatcccttattcaaaatgcttaagaccagaagtctttcaaatttcatatttgttttggattttggaatatctttatactcacggttgagcgacctcaaatctgaaaatccaaaatgcttcaacgagatcttctttgagtatcatatgggtgcttgaaatgttttggattttggagcatttaagattttggattttcagatttgggatgctcaatatatatttcaaaaaagggtatcacaggattcacaagacgaccacaaggtaccatggtacacaaaaaaattagcagcccatgttcaaaggacctactgtcatgtaataacctagtttaagaaacatgaattacatggctctcatgtcataacatcaacagcacacatattctgactggccaagctcttccttgaaacaatattttaggaaaaaaaatttaatcagtatataataagcttattcaactactcaagaaaaaaaaactgatgatagtaaaattctaaagagatcataaaacatttcatttgttattgaggttaacttttaaaagtccttatctggccaggcatggtggttcatgcctgtaatcccagcactttggtaggctgaggtgggcggatcacctgaggtcaggagttcgagacatgcctggccaacacagtgaaatcccatctctagtaaaaatacaaaaaaaaaaaaaaaattagctgggtgtggtggcttgcacctgtagtcccacctacttgggaggctgaggcaggaaaattgcttgaacccgggaggcagaggttgcagtgaaccaagatcatgccactgtattccagacagggcatcagagcaagattctgtcacacacaaacacacaaaaaagtccttatctgttagagatacatactgaaggattttcaagtgaaatgataggatgtctaggctttgcttcaaaaatattaccaacaaaacaaaagacaggacaagtaacagataacacaaaaatgacaatgcaagttaattaatctgttctctaatgagaatatatgggcacagtgagggaacaacacagactggggacagtcagggggttgggtgcaagggagggagagcattaggacaaatagctaatacacgtggggcttaaaacctagataacagattgataggtacagcaaaccaccatggcacacgtatacctatgtaacaaatctgcacattctgcacttgtatcccggaacttaaagtaaaataaaattaaaaaaaaaattaatctgttctctttacttttaggtgtattaattttaggtgtaggtgtattaatttgttccctttacttttataattttccataataaaagtttaaaactatattcagattagatcagagaaaatagatttactaaaatttattaagagatgtatgggcatattcctaacagaccaaaatccttttgtttctcaccctgacagttaccaggtctgaaccattgtattcattcttacattcttagtaacgcaccatgtttgctagatatagtctttcaaaaatactaagtagaaaaacaaagatacaaacattcaacaggtgattacaactaaggccattactggaaatgcggctaactctaacaatcctgccaagaataccatgtgttctgtggacatacctcttaaaaactggatgtcagtaaaacacataagcatttgctcaattaatgtaccttgatctattacaactcaaatacaacagtggtgatcaagtaaaaatttggaacacaagtaacattgcatacaatctattacctaactttcagatgatttcaaatatccaataaaagatttttttcaccattgagaaagatctttatttggtttacttaatgttaacaattacactagtactttttctaaaatactgtgatagggtaagtacttccttgataaagcaagaatttgatgtaaaccccacttgtatggtgcagtaagaaacaagtcattcattttctgattgttagaaactaccatatatttgtgtatcttcatctacccctgtagagaatttgaaaagatcaggcccctcttcagttaaccctatgcaaataaatgtgaccagctgtgtgtgggaggtagggaggcgcggggaacgacagagtttgttatttaaaggtgaaaatctctagcttcaggtataacttaaataacagatttaagtctttaagaagactcaacatcttcaaaagaatattttttaaagtgtacataataaaagtaaattaaactaatatagacctctttagacagctttctctgaattatctgataacgaacataaaaatgagaagtgaaaggtgtataggaaatctgtcactttcagaatacagttctctttcctacgatttctcaactcagtcaaatgcttcaatgatgtccattcattccccctatattcatgcagtttttaattttttccctatgagaccctttacaatcctctcaagtttctcactaaaactaaatacaatatggaaatattttcttaaaacacacatgaacaatgcttaaattcctatttttttcagatataaatttgaaccccctgaacttcagctttgtcatctataaaatagggataaccacattggttctgtgcaggctgctatcagagttaatagataatggccatatataaactaaaaggagccctagtgtcaactttatcttccttttttttaacattattcactgggaaaatgtgtacacaaatatttgtatagtgaccactggtatgtattatcacaaattatgtcttatcctgaaacattcctgagaaggcaaaaagaatccaaatgagctaaaagattatcatcaccatgatccagcataaccattcagttagcaaatatttatggaactttctgtaaattattgatgatatttgtatattagctgtcagctgctgaggttgtcatacatcccttttcgtcattccaaaattatttctacctatgctaggtttctagatatgcttaaggtttttgtttttttttaaaataaactatcagttcctaaacatataagctgtccataaggccaagtttttctaacagcatcaaatagaataaacaacttttaatgatttggttttaaggtcccatggacattgatggtctaataatacaaagcaggccaatattgactctgataatctcccttttaaaataattctcttatccaattataccccagatgcctagtaccctcatgcttttcaaaccaatctctctcaagttgtatagtgcatgagtaaatgtaatctaataaagccaaaaacaataacaacttctattgagcatttaatatgtactgcattactttgtgacatgcactttacacatatttaatccccatagatttctaagatataggtacttttattatacccatgttaaaggaaggaaaaatcattcctcaattttaaatacagtaagtcctcacctaatgtcatagctactgtgacactggataatgttcttggaaactgtgactttaagagaaggactttaaggaccatgtgcagcaggttcttgaataatatcattttgttcagcattgttttgttataacattgactggaaaaaaaatggtttcgtcacatgtcatttagcttaaaaccttagtttccaagaacctattaacaattttaagtgagaacttactgtaattcctaaaaatgaaacatggttacaaaatacaggttacgagagcccatctcccaatttttcataagctacacatatagtcgtaccatttcaagtaacacaaaaattattatttctttatgtaatttggagattatttttaaaagggaatggtcaactttataatcatattttgttaaagaaactatttggcaaaacagtaacaacaggaaaaaagtcaaccaagtatagtaatcacaattctacttctgaattttcatgtagtatctaattttctctacttcactgaggatactcttatactagaaaattattaatcgctttcttaaaataatgcatcctttttgctccaacagttctcactggtacttgctactaacagagcactaggatcatttccataaactaagaaacttagccttgacattctatatcacatttaaccaatgtctgttaacaggttaaagcattttatataagttccttacaaactgta

SEQ ID NO: 1219 - DNA, 45745 bp, Homo sapiens
agcctgggtgatggagcgagactctgactaaaaagaaacaaacaaacaaacaaaaaaaaatgtaaacatttggtctaaattatacaggtcagatattaagtttgctaaattctttaaggtcataagctgcttctttgactattaaaaattgttcaattttaggctgggtgcagtagctcacgcctgtaattccagcactttgggaggctgaggcaggcagatcacaaggtcaggagttcaagactaacctggccaacatggtgaaaccccatctctactaaaaataccaaaaaattagccaggcatggtggtgcgcacctgtaattccagctactcaggaggctgaggcagtagaatcacttgaacccaggaggcagaggttgcagtgagccgagatcatgccattgcactccagcctgggcaacagagggagactctgtcttaaaaaaacaaaaaaacccaaaaaacaaaaaacaacaacaacaaaaaaaattgttcagtttatctactttggagcattagattaaatgtgttattggtacatgttccaaaattatgagaaattcctataattctaatatgacttagcgtatgttattaataattgttacataaaattttgtatgcaacagaagtaaccaaaatttcctagttaattgtggctttactagtggctgtcctaagacttttttttttttttttttgagacagattcttgctctgtcacccaggctggagtgcagtggcacgatctcagctcactgcaacctctgcctcctgggttcaagcacttcctctgcttcagcctcctgagtagctgggattatgggcacctgccctatgcggctaatttttggatttttggtggtgacggggtttcaccatgttggccaggctggtctcaaactcctgacctcaaatgttccacctgcctccgcctcccaaagtgctgggattacagatgtgaaccactgcacctggccctaagactttttatcatccacagacaattgttgtcttgttttgatcttctttagaaggtagtttataatcagccataggactttaacaggtgcacttaaatgcaggtttctgataactttggagattgtgacattagaatagaggaaacaactttcagaactctcatggggagctgaaatgttcatagatatcaaacaaaagttaactgcataaactaaagaagactaaagcaatctttttgcctttgcttaaaacattgctgatcctttgttttattttttagagtcaaggcaacttttcttttcagatatttacagcttttaataatcgagtaaagtatactcctgtgaacaaaatttggagtatatgcatctctctacttgatttctccagaatttggaaattatttgtgtgtattcttaatttatggcaatgcagttatttgcataagggtaataagaatctgttttcttttgcaacaggacacaattggagaaattgtttattttatgaagggtttgactggaatggtgtgctttccattaaggaatcaaacttgacttgtaaagcctataaaagccacttagcgacctgggctcataaccttgcctacacagtccctgtacagggtttctgacctgtggtaagtaaagaatgtcaccttctaaaaggtccaggagccccaagttatctggggacctcaaaaggagaggaagaatttacccaactcaaaggtatttgagggcacaaacccatggcagggctcagctttaaaaagtcttatccaagattctttctatggaacagagttccatcaaagccaattttaaaagcctacgtgaaaaataattattcttgctgcactttatacaatcatcaggccaagtataataaagcacattggtcttaccataaaaatggtctttcataaaaatgggaaactggagagagaaaaattatgtttcaagaactatgatacacttgttattaaattccagtctcatcagttgtctttaagtttgtttctgcaatttaggctaaccctgcttagtcctgtgaaccaaccagtggcctctgactgctgctcagaagaaacaagagggatgggtaatgtaaaaatctgcatcaatattctaattctgggcatgtactggaatcatctagcaacctcatatcagcgtggttccaacagttcctcagttcatggaaagccttctagtttagtttacttgggataattttacttattttgctttatggttgtggaatgtatagctgttgtaatctttgtataggaatggaggacaagcttactgaatgtttccttaaactgaacacttatgaatcttccagagtatcaccttttgtcagaactcatgagttatgaatggccctcaagataccaatgctttttcttcccttcccttcccttcccttcttttcttttctttcagatggagtttcattctttcaggctggagtgcaatggcacagtcttggctcactgcaacctccgcctcccaggttcaagagattctcctgcctcagcctcctgagtagctagggttacaggcacccgccaccacatctggctattttttttgtattttttagtagagacagtgttgcaccatgttggccaggctggtctgaactcctgacctcaggtgatccgcctgcctcagcctcccaaagtgttgggattacaggcatgagccatcccgcctggcccataccaacactttccaactgagctcctctctaccacgaatatgagagattctaagagttaggcaaaaatatcatcgcccctattcatcctgaagaacttacagaagatggaccttcgtccctctgcaacccttaggattagtgcttctcttataaaaggaaggggggaaatgtcagaggcacgtgaaccagagcaagtctattttgaacaagagctgagtaaaatgagaatgagacttactgggctgcattcccagatggttaaagcattctaagttacagaatgagataggaggttgccataagatacaggtcatggccgggcatggtggctcatgccatgacagtttataaatgccatgacaatgacaggaagttaccctatatggtctaaaaaggggaggcatgaataatccacctcttgtttagcatatcatcaagaaacaaccataaacatgggcaaccagcagccctcggggctgctctgtctatggagtagccattgttttattcctttactttcctaataaacttgctttcactttactctatggactcgccctgaattctttttttcttttttttgaggcggagtctcgttctgtcacccaggctggagtgcagtggtgcgatctcggctcactgcaacctccacctcccgggttcatgccattctcctgcctcagcctcccaagtagctgggactacaggcgcccaccaccatgcccggctaatttttttgtatttttaatggagacggggtttcaccatgttagccaggatggtctcaatctcctgactttgtgatcccgccttggcctcccaaagtgctaggattacaggcatgagccgccgcactcagcctgaattatttctagtgtgagatccaagaaccctctcttgggatctggattcagacccctttcctgtaacaagattaggcaccaggagaaactgacacacatggatgatataacagatgcctaaatggatcctatgggggaactggagctggaacagccctttagagttgtcgcaaagtgaggcaaagaggctagacttttatatccctccatcaatcagtgtttgacatgggccccataggagggcatgtaaccttcggtgaggcatctttctgacttgaagggcattgcccaatgagggaggtagctatgtggtatcagcagctggtatttcctacatgtagcgaatgggcatattggctcccaagggggaatctgggtggagcactatagtatccattaaacctagtaaagaaatattatttctttactagtcacacagatgtgcccaggacagtggtagagcccacagggttacataaatcataatggtagccctcaagaacttcataaactgtatatggtattttaaaaagttgcatattgtctgtttccacctactagaacataagctctaggagggcagagactatgttttgttcaccactgtttctccagtgtctagacgtagattctttgaatgcatttaattggagccttgagatatgaagaagtaggatgcggttacttcatgcagagcaagagtggcatgcacccagagaaggccaggtggagctcagcatgagtgtgaaggcctcatgtcaagccatgtcaggggacacaaagatggagtattctctaacctatgtgacactcggcataagggaagtacaagcactcaatatgtgagtttcattcccacagtctgtggtctttagcccagtctttccagatgcctattgagttcttcaagcatccaaatggtttggggtaaggcttcaggttctaaatgagaggctttgtgggttaccagctggagagtcagaaaatctggatttgaattcactcagccatgaaataattgtgtgatcttgggccgggcacggtggctcacgcttgtaatcccagcactttgggaggccaaggaaggtgaatcactagaggtcaggagtttgagaccagcctggccaacatggtgaaaccccgtctttttttttttttttttttttgagacaaagtctcgctctgttgccaggctggagtgcagtggcacaatctcggctcactgcaacctccgcctccctggttcaagtgattcccctgcctcagcctcccgagtagctgggactacaggcgtgcaccaccacgctaatttttttgtattttagtagagatggagtttcaccatgttggccaggatagtcttgatctcctgacctcgtgatctgcctgcctcggcctcccgagaaaccaagtctttactaaaaaatatcaaaattagccaggtgtgatggacctgtagtcccatctacttgggaggctgaggcaggagaattgcttgaacctgggaggtggaggttgcagtaagctgagatggtgccactgcactccagcctgggggacagagcaagactctctctcagaaaaaaaaaaaaaaaaagtttgatcttggggagttctaaggcccactagcctcatctgtagaatggaagcaatagtactactttgcagagctgacttcaggaccaagagatctaatgtctatgaagcggggtacttccttctatttgtcaggatgggggaggctagtcctgtgatgactgggaatgaagggtaaaagagacagaggttgggtaaactccaggctctgtgttcatagcctgctcccagacattctcttgttatctctctgtttcctagcctacacacgtgcacagacacgtagctgctgttcaggaactgagctaatggttttaaagtctgttccttatctttgctggaggcaggcagtagctgtgcagtgacagtgtgcctatgcagacagagggagcagtgaatagcaatagggtgtttccaccatggtcttcactcaggccccggctgaaatcatgggccacctccggatacgcagcctcctggcccggcagtgcctggcagagtttctgggtgtgtttgtactcatggtaggtaggatcactgcgggaaggaaagaagggggttgggcaaaagttcctggctccttctgttgtccttatctctttctcttggtgtcccccttcctctcaactccctatcacttttcgtttttatcctctcgtctctcctaatctcctttcctctcctacttcatcatttttattcttgtcatttttattctttctttaataacaagtgtatcatagttcttgaaacataatttttctctcttcagtttcccatttttatgaaagaccattttcatggtaagaccaatgtgctttattatacttggcctgatgattgtataaagtgcagcaagaataattatttttcacataggcttttaaaattggctttgatggaactcttccatagaaagaatcttagataagactttttaaagctgagccctgccatgggtttgtaccctcaaatgcctatgagttgggtaaattcttttcttttttcccacattctttccctttcttcttcctccactttccccatttcttttcccttccctccttctgcttttctccttcccttgcttgtcttctgtgctcattcatctccttggctgctcccctggccttcccaacctttctccctgttggtctcctgggctccctgttcctcatctctcctcttctcagcagctcctcacccaaggagctgtggcccaggctgtcaccagtggagaaaccaaaggcaacttcttcaccatgtttctggctggctctctggccgttacgatagccatctacgtgggtggtaacgtctcaggtgaggagggtggggtctggtcatcagagcacgtgggatgtgcatgccagtttgtctgtctggtgatggtggaaacgcaaatccttctgtgactcgtggacattatccccttgaacagtgtcccagactgaaataagcctttggccccaccagcccctcctctttctgtatctctccatcctgcttcctcacactaatgcttggctcacctagacagaaatcaatggcagggcacgaagggcagctgctatcctcttgtatcccccacctgaagtcctctgggggctcatctccactcaggacctctcctgtttgtaccccagatacacactgcatcggtgtgcttgggtggagccttgagacatagtgtgttgctgtggaaaaagcagacagacctaggttccaactttggattcacagtgtcttcttcttttttttttttttttttctttttttttgagatggagtttcactctgttgcccaggctggagagcagtggtgtgatgtctgttcactgcaacctctgcccctgggttcacgcgattctcctgcctcagcatcccgaatagctgattttacaggcacctgctaccacgcctggctaatatttgtgtttttagtggaaacggggtttcaccatgttggccaggctggtctggaattcctgacctcaagtgatccactgcctcggcctcccaaagtgctgggattacaggcgtgagccactgtgcctggcccacagtgtgactttgctaagtcacttaacatctgtaacatctggagcctcaatttcctaagctgtgtgatgagaattacactatctgccttaagagctataggaaggagcagtagtgttgtctggtgacaatgcctggcagtgacacttaatagatgctctttttctttccttgatacttgaaggggcccacctgaatccagccttctccctggccatgtgcatcgttggacgcctcccctgggtcaagctccccatttacatcttggtgcagttgctgtctgctttctgtgcttcgggagccacctatgttctctaccatggtgacagagggaacagagggagctgtgccttgagagcacctgtgggtgggcaggggtgcctcagaatggttttggatgaatgagcaaagagggaaatcctgggtgttcccttcctccacagatgccctacagaactatacaggtgggaacctgacagtgactggccccaaggagacagcctccatttttgccacctatcctgccccctatctgtccctgaacaatggcttcctggatcaggtaagtgtgagggggagacctggggacactactttggtcctgttcctcggcaccccagcctattgttcagtctctgggtggagtgtgggttgggtctatcttggcactccccaccatccccaactgcctgtgttgcacaaagccagatgacatggaatatttggatgagagagggcagatggagcacctggcagctgacagggaaccctctgcctctgttgactccaaggttctgggcactgggatgctgattgtggggctcttggccatcctggacagacggaacaagggagtccctgcgggtctggagcctgtggtggtggggatgctgatcctggccctcgggttatccatgggtgccaactgcgggattccactcaaccctgcccgggacctgggcccacgtctcttcacctacgtggctggctggggtcctgaagtcttcaggtgggagacagactctcctggtgctggcctccactcaccttcctctgctaagggctctgtccctgggtccacagcactctgcctttaaaatagctctcttggcttcttaggacagtgttctttctccaagtcatattctccccctttctcccttgcttccctcccaacttttcactgaaacagtaagatttagaggttgtgttcttaggcatgccacattacttccatgcacattagtgacttcatcagcaaaattaatatattcagataattccctaaggcaagaggctggaccaagctctcctggggttccctcttctaaatactatgctttggtgacaaggcaatcctcttcctggtgtctaccaccctgggaacaactttagggcactctcttgttactgccccccgtccttggagaggggaaggctaagggagtcactcctgataccttcccactgtccttcttttgcagtgctggtaatggctggtggtgggtgcctgtggtggcccctctggtgggggccaccgttggcacagccacttaccagctgttggtggctctgcaccaccctgagggcccagagccagctcaggatctggtgtctgctcaacacaaagcctcagagttggaaactcctgcctcagctcagatgctggagtgtaagctatgattaggacaaccctcacttcactcatggaccctggagccagccactgaccccgcctgggaacaacagtcattcttcctctttgttaatgtgccagaacctgggaggcttctctgtttatctgtttggcatcccttcctcctaaactaagaaggatcctggacagggagaagtggaggaggataaggtaccaggactcaggcttctcatcccctcctcccgcaaagcggttttctgaccctcagggcctctcggaatgtagttgctcgaggtaaccgctagagggtgcgcacctggatgctggatggggacggctgcgggcatctgcagggtggagggggccaccatccagtgtagggcacaaccctggggactgccctccatagcctgtcccgactgccgactcctagctctcatcgcctcggcgcctcccaccttcaccctctcggggatgcctccccaagagggtagttaggggtggggaagccgcctccacccagggggcgtggtgggggcggagggaaggagggcggcggggcacagagacagagagcaaggctgtgaaactgaggcaccgttcctagacatctcggtgctgtgtcgttcattcaaggagagttgagatacagtgaaatgagccagggcgaggagggagggtgaaggaacggagggcgggcggctccgaggagcgagagtcgggctgagggcaacctggcgccagggaaaattctggttattcaccacttctacagctctcctgccgctccctgcagaggatgctcgttttgcagagaaggcagtgttcctctattcccttcttccgaattaaaaataccccctcagagcgatctagcctcccgaattgttttttcttttaagatgcggatggacgtacgtgtgggggcatcccagcccagccacgccgaggctcggaagggctaagaccctcccactgccccgcacaaagatggctgctccctcctccccgctccttctcccctccccaaaaccccctcccgccccccggcccccgccgccggctccgtcacttccgccccgccgtggccgaaactgacacaaagtagcgggccgaggccccgggggagcggggccgcagctgggggggcgggagcccgtggggagccgagccgagcgccccccgccccagcccccggcatgggcagtacggggccgccggggcgggcgccgagcgctgagcgctgaggtgaggcgaggcgaggcgaagcgggggcgcccgggagcgcggggccaggagggcagagggagatgcggccgcagccgcggggctggaggggccggggagcgggtgtagactggggagcaccgggggccaagatttgggagctgcggccagacggggcggggatggcggccgactggagacgaggggctgtcgggttcccggggacggggcagagcgggggtctgcgtacaggatgggaggatggggtgccgaaggggcgcgtggagagcaggagagcggcgcgagtgccaaggagaagctcgtgcagccttggccaggggagacccgcccagagagttgttgggcgagaggagtaaccgggacccgagggtttggtgcctggagaagggagtttgggctggtaggctttgtctcagtaaggtggaggtctatgcctgaggaaaactgagggtgtcaggaaggggcagtagctctgggagatgatagctgtgccgggagccctgagttctgtccttggtgagggaaggtggcccgagctcgtgttggtggccagtgagctggaggtctcgagttccatttcctcctgtttccctgacctgccatcctcctctgaaagaagtggccagcctttggggctcttgcttgtaagggagcagggaccggacctataggaggagctgttttcctccatggagcattgcctgcttgccggggctggctatttttatcccaaatgtggccgagagggggctggggctgggtgacggggcagggcaacgtggctgatgggcctgacctgctcagaaaacccaggctgtgtgagactaagaaggaaaagtgagaggggatcccagttcccaggtctctcctctcttccccttggaatgatggcccccccagaggggatgaggtctggggccaagcctgcttccagtctccccagggtctcagaggtagaacaactttcctggtccatatccagactcctgactcctgatggcgtgtgcagctcctacattaactctttcatgggactcaaactcagatgtttaggctgatagtgtttcttgatcccttcctccccaagggcggggctgcctgtagaacttgtgatgcccactcttgcatcctttaacctctccctgtgctccccaccctcccgtgactcatactcagactgggtggagaccctggctgggggccctggaggagggcttggcatctctaaaatatggatgaggtttttcttcctgagccaggcaccctggactgccatagttggagaaggtcagggatgaaaaggacttctggctttcaggattgcctgacttggtgtaagggcgggatctgagctagcgaagggagaactggtgtgggtgactgggttgtggccagaatctgtaattatagagcttagccagacaggcaattagtatctcttggggctgacaggttggtggggtgtgcctggtaggctaaaggcagagggaaccaaagaggatgaggaggtgaaaggccttccacccagacaaggaaagaggaggtgactgactggcagtttcctttgggccaggctggggagtaaggatgaggctctgccttgtaaggccaggccttgaaccttttaggagaaaggacatgggaaggcggaagcaggcagaggcttgtctcactggtgctccctaagcctgcaccctgtgccatactgactggactaggcttggggtgggagggagggaggggcaaactccccaccagggttgggaagacccctctgccagcccagaagggtggctgacccaggctgaggggaagctgtttagggactgtctgtgcagaaagtgagggccatgcctctaatgtgagctcccctggaggaggtgataatggaagccctagtaatggggggtggggatggcagggaacttataagcctttcgagaagggtggagcctgcccaccctgtttcctgatgccctgccaggtgtttcctggctcatgttccctccaccccaccctttggggaaactgctttctagtaagcacaagcactactcattgccgccagaacacatgagagcctccattgtccctgggatggataccttgagagctgttccccttttttcaatatctggcctcttctcctttccctacaggcatgggcttctgtaaagtctcagccccccatgtcacccaaggcaggggcatgatgggaggtggtggggaagtcccctctttcccaggaacccatcatggcagtaagaggagagactgggagaaggaggctgggggaggggcagggtcagagctggagaagagggtcttcaaaagaggtctcatgaggggagggaagggttatcctcagcttcctgacctcattcgtctgtcacttcttgcagggtctcccatgggattgctgggatcttgctgggtgagatggcagtgtgtgcaaaaaagcgccccccaggtaagacaggcaaggaggggagatcccgggaaccatcaagagtgggtgttgttatggctcagggagcaaaaggaaaagggacaactggtatgggtctgagggagggtagcttacagcagcccctacccagcttgggggcagcctaggaaaccgaattcttccgcttgatcccaaagctgggttatctgccaggacagcgcagagcaccagccccacgccccgaaacacctgcagtcttatcttcgggcacctgcagctcctgctttctggcctagggagctgtgttctcatctctgcttggtcctctcaccccttccctgctcccctcgtttttccatctaccggttctcctggtttttccgcgggcgggggtgtgtgtgtgtgaaagcggttgcccccgacaacgccggcagtccgctcacccgcattggcccggcccgggggtgggaggggaggcggggctcgcgcgcgagctttcgcctacgcggcgcgctggcaggctgcggctcctgcagtcggggagcgggcgggggcggaaccctgggcgtgctcggcgtgtccggggccactcagcgcacgctggcatccgccggggggcatggggggcggcggcggcggcgcagctgagctcgcggtgtccccgagcgccggcggccgggaggatggcctgggctgcgggtggggcgcgcgcccgacggctggggctcccctctgagcggctgcggctcctgcacctccccggggagccgccccgtcgatgccactaaggccaaggacatatagacggtctgccctcccccactcaaaccgggatcatgacggtccccaaggagatgcccgagaagtgggcccgggcccaggcgcctccctcttggagccgaaagaagccctcttgggggacaggtaacgggaggcagcgcctggcagctctcccgcacccattatttcccccctccaatccctacattcacttgtccccagcctccccctacctgccttgatcctctttccagacccagagatcctggctccgaaggatccagtccctaccttcttcgtttgcatggtctttggtgattgcgcaggggacttggcccaagagagcccctctagggaagtttatgggagtgaagtggcttggtaggcagggggcactgtggcctgggttttgttactgcagtgtgctctgcaggggtcctggggtgtgtagaaagggttctggaatgctgtctttggctcccggacaggcttaaggcattaggtttgctgcctaaccaagttacccctttttgcagcatgaggtcatggtgacccccggggagacgggctggggaatctattataggacagctccttgttctgggacatgaatttgatgcctgcagtcccagacctgcagaggtttcagataggtttagctagataggtgtcactaactgagtgacagatgagccctttaaagctaaatgtgtgcagatggtacaaggaaggtccagttagagagcaactgtttcaattacatttcattcctccctcctctatctctatctcagtctgcatgacccatatccctgaaacgcaccccccacacctttttctacttgaagatgagctttgaaataaggtgatgtcatttcgggccagtcagaagcagttgctggtgacatgtgacaaccagaggctcctgtaggggggactgcacatggggctgggatgctcccgcagagcagctccagggcacagggagcctccttcttgccacctaccccactctctaaataagggagagagcagtaccgcgactagatctgcagtggtccccagggggaaggaagctttgcgttttcagcgctactccttgattatgacaatgtatgcattagtaatagcagcaaaaggggctggggaatcccaggactgtcagtggctcagattcctctggagtgggggtgggggagacaaactgggtgcttccagtggaagaccttgaagtttggtggtgaggaaaagagaacatgtcctgtcctgtgaatgtaacctggagagccgtgtggtcaggctgctggtgagaggtggactggagggaagaatttgatgaccccctcagttgtggagctaactccttaaaatgatattctgtggaaaaaaacagggaaccccccagcaaagtgttggtccagacctcagtttgctcctcctgactgcagcatcattttgttgcagaagaagaaaggagggcgcgggctaatgaccgagaatacaatgagaaattccagtatgcggtaagcgactctagaccacctgttccctctctctgtttggagaggggaatggggcaaggacaacctaccgttgggactgagggctgcctgggaagagtgcttgggggaggggaagcaacctcctcagccactctccatctgctatcgtgctgaatttttcatgccttcacctgtcagtgaagcagaatacattgacccccttgagactcccttctctcctcctctttccccctcccacacctgtgtttgctagcttttggggtagaggtctggggaagtataaagatgggggaggcagcctcagtctggttctgggttgggactggagactgctcattatcttctctcctactgccatagagtaactgcatcaagacctccaagtacaatattctcaccttcctgcctgtcaacctctttgagcagttccaggaagttgccaacacttacttcctgttcctcctcattctgcaggtaggtgacccatagtagattttttgcagctccccaaactgaataaagccaaggaagaggaaagggaatgaaggcatcagatggggcctcagaggcatacttctctttctttttttcagttgatcccccagatctcttccctgtcctggttcaccaccattgtgcctttggttcttgtcctcaccatcacagctgttaaagatgccactgatgactatgtgagtggttttcattcttctattttgtcccagtcacccacccctactcccagccccacccccatctcatggccaccttcatccagcacaatttcttggtgaccttgacatcccttacccggtccagctagatccatgatgtctttttgctgagcgtggggagagggaatcagggagtgaactggtttgtgatggggtgtgtatgaggcgttaaccagcatgctctgagttctactgatcaacgaattccttcgaggcgggggaaggtgtcttacctttcagttttcttcttttcagttccgccacaagagcgataaccaggtgaataaccgccagtctcaggtgctgatcaatggaatgtgagtgcctgttggagacaagagctctggggacgaagggggtcccttaggaacctctttagctcctgacagcctcttcactgtcttctcgttgcctcagcctccagcaggagcagtggatgaatgtctgtgttggtgatattatcaagctagaaaataaccagtttgtggcggtaagggacagggtacccctctaggcctgtaggttcttcctcttctttgtgagaaaaggatgaatctttcctgatttactgttgcctcttaaacacccgtggcaggaatctttctcacaccaggggcttctgtgtcatgctgatatgcctggaactagccatttatgcacctggaactaagcaaaccaagaatgcttagtggaaggagccaccattacagcccactgggggtggaggtttgcatatttggacttctcattagtttttctctctaggcggatctcctcctcctttccagcagtgagccccatgggctgtgttacatagagacagcagaacttgatgggtaagtggcatgctcagtgtcagccctctccttctgtctctttggaggtaaaaagattgtctttgaatgaggttctcaggcctgggctctgtctgaatttggaaaaattaggggtaagaaaggctttggatgggatgtgtgaagtgttattcaaccagtatttgctgggctgagcagttatgcaccatgcttaggtgtcaccaggtagaatttagaggatggggagaggtgggcatggtgactcactcctgtaaatcccagcactttgggaggccagtgtgggaggattgcttgaggccaggagtttgagaccagcctgggcaagatggtgagacttcatctctataaaacaaacaaacaaaaaatttaaaaagtttaaaacttagctgggtatggtggttttaatgcctataatcccagccacttgggaggctgaggcgggaggattgtttgagcccaggagttcgaggctttagtgagctatgattgtgcgactgcactccagcctgagcagcagagcgagaccccatctgtgaaaaaaaacatttagaggatgaggagggagcggggactcagagatactgtccttccagcgagaccaacatgaaagtacgtcaggcgattccagtcacctcagaattgggagacatcagtaagcttgccaagtttgacggtgagtaattttggaggagcagcctgaaggtagaggagtggggttgggttttgtttgggggcgttaaattatacattttcctttgggctttttgttgttattatgcaactccctggactgttttggggaggggagtgtttgtaatgtcatgtggctccctcttggttttgagtttataattatttcaaggggactttgtggctgatagctccccacttgctatgcatgttgagagaaattcagcttattcttttagcttattagctcagaataataatatgtgttccttataagacaaaccatacagagtgtataagaaaaagtgaatagaggtcggtaccatggctcacgcctgtaatcccagcactttgggaggccgaggtgggcggattgcctgaggccaggagttcgagaccagtctggtcaacatggtgaaaccctgtctctattaaaaatacaaaaattattagctgggcgtggtgctgcatgcctgtaatcccagctattcaggaagctgaggcaggtgaatcccttgaacctgggaggcggaggttgcagggaggcggaggttgcagtgagctaagatcgtgccactgcactccagcctgggtgacaagagcgaaactctgtctcaaaaagaaaaaaaaaatacaaaaattagccgggcgtcgtggtgtgcatctgtagtcccagctacttgagaggctgaggcatgagagttgcttgaacctgggaggtggaggttgcagtgagccgagatcgggccactgcactccagcgtgggcaacacagtgagacactgtctcaaaaaaaaaaaagaagaagaaaatagctcttccttcctcttctaccctgctgaagtagccacattaattgacagtcagtgtgtgctcatccacacttttcatacatgtttgtacaaacaaatattaggtcatgctgcagcttttttttttttttttttttaaatactcctgcccaggttggagtgtagtggtgcgatctcggctcactgcatcctctacctcccaggttcaagcgatcctcgtgcctcagcctcccgattagctagaattacaggctcccaccaccacacccggctaatttttgtatttttagtagagacagggtttcaccatgttggccaggctggtctcaaactcctgacctcagctgatccacccgccttagcctcccaaagtgctgggattacaggcatgagctgccgcgcccggcctgcttcattattttcctgaagagttgcatcagctcacactcctcccagcagcatatggatgggcccttgcccttgcatcctcttcgctcagctcattttctctttgttttattgtcttgtggttaggctgtagactggaccttaagcagtggaattcttgtctcctgttcaggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtgagcctcctagcatccaaagaaagaagggtaagagtgactcagccagccctcactcaggagtatgggatgaggtgggagaatacctaaggtaaaaaacctccagctgtgtatacaggcttcttatctagccagtatctctattccaccctggtgtcctgcagtctggggatcagggcagaagcccagaggcagatgtgttatttggctttcccagcccttcccattcttttccaggtcccgacactaagctgatgcaaaacagcggcagaacaaagttcaaaagaacgagtatcgatcgcctaatgaataccctggtgctctgggtgaggcgccccacatctggctccctgcccctgccctctcttctccttgggtgctccttttcctttcctctttcttctttggtcagtagacttcaggtttggctttaaagctgctagcaggtcagctacacaaaggcagtgtttattttaggctccttttagttggaagatgttatttaaaaaaacttcaggaacgtgcatgaatcaacaacttaaagctaaaacaaatcatcccttctctgattccagttatgatgatgactttgtgaagcatgtgaccttctgtttgcttttgccagggacaaggaggccttcatggggatggagagggaattaaaagaaaaatttccatttggaagaggttggcagggtcttttccccccaacttctaagaacgaaggatcccaaaggaaaagtttctgtttaagtttttggcagttcctgaatccttctcttgtttagctagaaatctgaactccttgttgggctctcctccccttcctgtgccccgactgtctgctgcctgcccgccacatgccagcttgtgaaggctggggctagcctctggtgagcttgtttccgccctggctttaaagagtgtgcggaaacccagcctggtgggcgaggttgtctatcacataagggctccagtcgccccctggtggccattgggcaccaatctcctattttgtttcaaagcctaaacagcggaggcagctttggaaatagatgtaggaaattggacagtggcctggttttttaccagtctctccagagactccaaaatttataagatttttgactaatcaggaaatctagaccaggagtggtggctcacacctgtaatcccagcactttgggagaccaaggtgggaggatcatttgagcctaggagttcgaaaacagcctggacaccatagtgagaccctgtctttacaaaaaactgaaaaattagccaggtttggtggcatgcacctgtggtcccagttactctggaggctgaggcggggggattgcttggcctgggagattgaggctgcgttgagctaggatcatgccactgcactccagcctgggcaacaaagcaagaccctgtttcaaaaaagaaatctacgtttatgaagataagtttgtttcccaagtttaaaaaaaaaaaaggcaatcttagccaggtgcagtggctcacgcctgtaatcccagcactttgggagaccgaggtgggtggatcacgaggtcaagagatcaagaccatcctgaccaacatggtgaaaccccatctctactaaaaatacaaaaaaatagctgggcgtggtggcgggcacctgtagtcccagctacttgggaggttgaggcaggaaaatggcgtgaacccgggaggtggagcttgcagcagtgagccgaggtcgcgccactgcactccagcctgggcgacagagcaaggctccatctcaaaaaaaaaaaaaaaaggccatctatgtgagatagtgaacattaccgtggcttggcatttttgttggcttgtacctagcccaggtgaatagattatttacagtaagttttctggtatgttaaaagtagctcatccccactcttaccaactttgaggactctggaaggtttcaaggtgccagattgagagctaatcaactatttcagtttcttcatcatatagatgaaataatggtcagacagaaggccacatgataattggtgacagactagaacctgtcaccagttctgagctttttccactagagcagtggtgtccaatattttggcatccctgggccacattggaagaagaattgtcttgggccacacataaaatacactaacattaacaatagctgataagcttagaaaaaaaaaattgcaaaaaaaaatctcataaattttttttttttttttttgagacggagtctcactctgtcactaggctggagtgtagtgcaatggcattatctcggctcactgcaacctctgcctctcgggttcacgtgattctcctgcctcagcctccctagtagctgggattacaggtgcccgccaccacacccggctaatttttttgtatttttagtagagatgagagatggggtttcaccatgttggccagactggtctcgaactcctgacctcatgatctgcccgccttggcctcccaaagtgctgggattataggtgtgagtcactgcacctggccttttttttttttttttttgagacaggttcttgctctgttgcccaggctgggatgcagtggcatgatcttggctcactgcaatgtctgcctcccgggttcaagcaattctcatgccttggactcctgagtagctgagactacaggcaagtgccaccaggactggctaatttttttaatgtttttagtagagacggggtttcaccgtgttggccaggctggtctcaaactcctgacctcaggtgatccatccgcctcaacctcccaaaatgctgggattacaggcttgagccactgcgcccagcccataatagttttttttttttttataattatttttcatttaacattcagctgttaccaaaatctcatagtgttttaagaaagtttatgaatctgtgttgggccacatgtggcccagagaccatgggttggacaagcttgcactagagcatctgagcttttgagggctcaagggatgaatacatcacagatgcacttggttttgagggcttcctacatgtcagcctcgcctgtgcttctcattcctccccagatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcaggtatgtgccttctctgacctggggtctctccagggagtcaggcggtcccatagaacttttcttttctatgaagatgaagtccttgagaagtaacgagaagtcctcttcttcctgtactgtaaacatttgatgttatctgtttatctttgtgggcagagcaaactttttaccacagtttcctggtacttgggactgtattagagaaaaaaaaatattgatttattcagcacctatttattacatgcctactgtgtacaaagaagtgtgctaggtgccatcacaaataaaagatgaattaggaatggatctccttccttctaggagcttacgtctagtaaaggaaggaaaatctaaacacattataaaacaaaataggaaccagtgctgtagaattcgacctagagtcttctatgtgaagcttggggatacagagatgtataaggtggcctctgcctttagcagcagcagatggataggtcgaggaggggagatctggacagtgtcagactgagataccatgtgggaggcacagggtgcccggggactgggagagtgtcgctccctaagcaggtaggcagagagggagagatggcatttgctctgggctttgagtggtgactgggctggatgaaggtggagccacaatggagaggaggctgagagggctggaagcaaaggtgtggagatgggagcctgggaatggcctatggaaatagttggccagggtcttgggccaagagcaagagctggaaacatagcttgctcctgattgtggaggcttttgaatatttgcctgtggactttgtatttactaaccattaaaagttattgaaaagactgggcacggtggctcacacctgtaatcccagcactttgggaagccaaggtgggcggataacgaggtcaggaattcgagaccagcctggccaacatgttgaaaccccgtctctactaaaaatacaaaaattagccaggtgtggtggtggttgcctgtaatcccagctacttgggaggctaaggtaggagaatcgcttgaaaccggaaggtggaggtagcagtgagccaagatcacgccactgcactctagcctgggcaacgagcgaaactgtgtctcaaaaaacaacgaaacaaacaaacaaacaaaaaagtttttgaagaaagtcaaaagaatgtattctgtattctaaaaatgcattctaagtgttacagctcttttagaatttgtctagcaggttttccagttttcactggaacccctcccccacaaaaagaaaaaaatgcattctaaaaaaaaactaaagaatgctttaggaagtattgactggcagtagtgtacagcatgaataggatcaaggcaacatgtaggatgtttgaggtaaagagaatgttagcagggacaggccagtgagaatgaaggggaggatcggaggaagacgaggcaggaggaatggccaggggaaaggaactttcttgcttagtgccttgcacttgagataagggaacctgtgacatttttaaggaaatgttttatggaggtgctgaaaacttgtcctgtctcccatcttttgttcatacagattccccaaatagccctcaactctctcccagcccccaatcttactgctggtgataataaatagaagatacagcatttctgtgctgagagaatatagtttaggcttttccagggtgtgaagaggagagttgggaggttctgggtttagtcctgcctcctcactggccatgtgacctcaggaaaatccacggtcactcagggcctcacttgatcttagttttcccacgtgaaacaggaacaggagtacttgtctcaccttttaataggatgtcttgatataagatattggcttagaagatacattttaaacttaagtgactgtacagttactgggtggtagcctgctcattgtgactgttgccactcccttctgcattactatttaaatgcctttgtgcttacaacctaattttgttttcccacctatgggctttgctatctgtgttttgtatctcagttcacttgaagcccttgggagcagctaaagcagttttctttctgagtctcatcaggtcacagtgtgtatgtttcgggaggctaagagggggttgaagagctgtgtgaggaaaaggccctttggaatgtgaagacattcccatttgcctggtaatgggatcctgataggtgccttagtcaggtgggaagcagggctctcgatagggccccattgctcggctgcactggacctaaacatggccctttctggaaatgctaacagtgcatatgattagcaaagaagaggatacgaacagacctggagatgttaaaggcactataggggccaggcatggtggctgtcgcctgtaatcccagcactttgggcggtggaggcgggaggatctcttgagttcaggaattcaagaccagtgtgggcaacacagcgagatcccatctctacaaaaaatgaaaattagccaggtgtggtggtgtgcacctgtagtcccagctactagggaggctgaggtgggaggattgcttgagcccaggagtttgaggctacagtgagctatgattacactactgcactccagcttgggtgacagagaccctagctcaaaaaacaaacaagcaaacaacaaccaccacaatgcgctgtgccattgtgaagtggtggtgttctgcagatgcccagggccctctccctctggagtcagcacctcagccctgcccggtgttcagaatcaggaatgtagtgccccaagcccagggtggaaggagcgcacccagcctgtggtgggacagtgacgagtgggcttcaagccttctccatttcccctccccggtgccacccctctttgaggtggcgtctgtgttgctgtggcatgcacagcaccctcattatttctctctctcttttctctcccctccctctggcactttctcttgtttttctctgcatggtttctgtattattagtcctgaggtaagaactggccgagtgccttgtctacagccccttttcctcctttgctgtctgtcctgcccacccaggccctttgcaccttcttgtctggagagcatcaggagggtcgggtcggggcgttcctctgctggctgtgtgcagccggctccaccttcaggctctccttgccctttcccacccaggtttctgtgcccaggtgtcttctccgttcttgtctctccccaggcggagggcctgcagcgaaggcccatgtgggtggggcacctcctcttcttcccgacccaagcctcacctcttgtcccctgtgcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtatggtggcaccactggggactgggggcttgcacctcgcctggaaggacagtggaactggggccccacagtttccttaacattggttttttcttccttcctagttgggtctgaggggcctagaagaaagggtccatcctggccaggcacggtggctcatgcctatagtcatagcactttgggaggctgaggtgggaggattgctcgagcccaggaatgcgagaccagcctgggcaacatagtgagaccacatccctacaaaaaatttaaaaattagccaggtatggtggcatgcacctgtggtctcagctggccagtgactcaggaggctgagatgggaggatcacttgagcctgggaggtcaaggctgcagtgagccatgatcttccactgcactccagcctgggcgacagaatgaggccctgtctctcgagaaaaatccacacacaaagaagaggtccattctgtgtcccatgtcaagaagcagatcctggctgggcgcagtggatcacctgaggtcaagtgttcgagaccagcttggccaacatggtgaaactccgtctctactaaaaatacaaaaaatagctgggcgtggtggcaggtgcctgttttcccagctactcggggggctgaggcaggagaattgcttgaatccaggaggtggaggttacagtgagccgagtttgcgccattgtactccagcctgggcgacaagagtgaaagtctatcaaaaaaaaaaaaaaaattagattctgagagtcctccccttgtcctctcctgatgccctgaccctggtctcagctccaggaattaggggagctccttggctgtttgaagtgagacactggcctctgggcatcctggccaggcggaaccctgctagactctcccctgttgctgctcagggtccttgtgagtctgtggaatgtggctgtggttggacttcccagtgtggcccgtggctgtgctgctgggatggcctggggcagcatgtggggctgacttttatgcagagtgtggacccctcttgtgactgctttctgtactgactgatgcctttcggtcagtgtctgagccttgtctgctgctcaggtctaatgggtgcaaggaggcctgggaggtgtggaattggagctgccctgaggggggtgccgcctagggtagagacagggatggtgagcagtgggtgccggggctctttcatggccaggccttggggttctggaatctagggtgcctgatgcctcctatcccgcgagtcagcaatgtgactgagtgactcacactgtgacagctgctcagcgattagggttgaggggctcagtgcctacggggattctgcattggagatgtttttccatgctctggagctctctggctctgacattgcttctttttctgccctggctgtatgtaggtgatgtgtttgacgtcctgggacacaaagctgaattgggagaggtaagattcagtctccctaattctatgtgccagtgaaacagggtgcctggccagtaacagtgtagtcaggagtgatgtgttgtctggataggaaatggaagctgcttggagaaatgggtgttttaaggcagaactggtgatgacggaagtggaaattttgaggtccaccgtggacaggagcctactgagagttgggagggcagggatgaacccttccccgggatgcagcctggcactctagcctttcctaagagccttcttatgtgtttcagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggtgggccgaggagccggctcgcactctcctgacctgactctgcccttgggctctgctctgctctgcaatgcggctgggctggggcttcctgggcggggcacgtggctgagggaagccacttatatcacgtgtattcttcctccccacccaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcataggtgaggccaggcctggggtgctggggcgtttggggacagcattcaggcctggaatgggtgaagtgtgccgggtgactcttgatgtgtttatgttgggggtctttgcctgtctgaatttttctggcactttcttcacctgccccattcatagtgcggaatccagaggggaagatccgactctactgcaaaggggctgacactatcctactggacagactgcaccactccactcaagagctgctcaacaccaccatggaccaccttaatgtgggtgtgaggagaggaggggccagcctggggggttctactcttagtgtgggggaggcgacttaagtttgttttattgtgtaaatttaaggtctacaacgtgatgttttgatgtgtatatatagtgaagtgattactacagtcagacaacttaacacatcagccagctcccatagttacctctttttatgtatgtggtgacagtccctaactgtggaatgtggcacacacccagtctacagtgcaggattattcattgtcgccctcacgctgtccattagctctccagacttacccaggtgtgcctttccactctgcctccaggagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatggtacgggctgcgggacgggccaaggatgggcacggagggctcatgcctgcaattcttgtgccaggaatccttgtggtattttcagctgctgggtgcaacggccattgaggacaaacttcagcaaggggttccagagaccattgccctcctgacactggccaacatcaagatttgggtgctaaccggagacaagcaaggtgagagcccagcagggcagagccagttgcaactgacagtagccctgttggacccttgcatggagccgaggacatcaggcaggcaagtgtgctgaccttgttgggtgcctgtccgtagctcctgcgttctctcttggtagagacggctgtgaacatcggctattcctgcaagatgctgacggatgacatgactgaggttttcatagtcactggccatactgtcctggaggtgcgggaggagctcaggtaaacaagaagcccaggggaggcggtgctgtgcgttgtgcccagggctcaggtgggggtttctggaccatttagacttgaatccctgctccccactgccgttctggaagaccacaaccgtatcatttccacctcgacaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggtaggcatcgctatccttagcttgggcagtatctttccagtgagcacttctgtccagggcttttatatcttgttctaatttcccctgatttcagagaagactggtctcaaaggggactgggaggagctgagactcccaggtgtctcctggaaagactggctctctcaggtttctctgtgctccaggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaagtgagtgtgggctgtgcaggtgtgtaggctgggcttgaggctggggaggggcccactgaggtctctggactgcagaagaatgacgggaagggggttgtaacttggtaggctctaaagtgtgtggccggtggccatcttcaccctcttgtcatctcttgtctctgcagcggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccaggtaataaatgttcccagtccactgttgtgcaaatctgtaaacctgagggcagaggttctgtcttgtttatcactcagtcccccagggcctagctattttctggtacatactcttaaaaaatgcttattaaaggaggagagaaggagcctcagaaaatttcttagggttctctgtatgtgacatcagctgtcttcctgtgcctgatgtgtagcaaagaaaggttgcatgctcccttgctccctgttctcttccagaccgtctatgaccagtatttcatcaccctgtataacatcgtgtacacctccctgccagtcctggctatgggggtctttgatcaggtatgggggagtttgatgatcagatgggatgcggggaaggtcactgcttgaaggagtcacatagacgtggtgtgtgacacttgtgcccatttcctgtggccactgggaaggcagttctttcagccggggaaggtgtggctggttctccctcctggctgcagctgatctagaactctcttgggttgctgaactaagttagtctgggggtagctggcttgaggttggttctagctgccaaagactttggaaaggaggaggcagggacagagtcagagtctgcccttggtcatccagggtcaaaacggcaacctctgaggccccctatgctacatggtcctcccacacaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcaggtatgaggccatccaggaactcccctcttctctggaaggagtgagccttctgtccctggggctgccctgggcaccacagttctgtttctgggggaaggggcttttagggcgtgcgcctgcctgactatgcctactttctgcagattgggctcgacacaggctactggacggccatcaaccacttcttcatctggggaagccttgctgtttactttgccatcctctttgccatgcacagcaatgggctcttcgacatgtttcccaaccagttccggtttgtgggtaagtccccgtggcctccttgaatcggtgaggaatcacagctgttctgggactaacaggaccatcagctaatctgcacattcaacatttcttatgtgccaagtattctgtttattttatttatttatttatttattttcgagaaggagtcttgcccaggctggagtgcagtggtgcgatctcggctcactgcagccttcgactcactgcagcctctgcctcccgggttcaagcgattctcatgcctcagcctcctgagtagctgggattacaggcacacgccaccaagcctggctaatttttgtatttttagtagagatagggtttcaccatgttggccaggctggtcttgaactcctgacctcaggtgatccactcacctcggcctcccaaagtgctgggattacaggtgtgagccaccgtgcccagctagcacagagaaatctgaataaagggaaagggagcctgccatgtggctctctgggaactgtcaatccaggaagaggaaacagcaatataaaggccttcagccctggcctgggaggaggtcttctgcacgtggagctggggaggagtggaggaaatgagttggagggtgggggtgtggaatgagtcaggattatttaagcccttatgggtcagaggaagaactttgagtttttgaattttaatctaaatgtgagaggaagccattggagggctttgagcagagaaataccagaagcttacttatgtttttaaagggccgctcttacagtttcgtggataataaagtgtagggggcaagggtggaaatgggagactaggaggtgagagcagtcaccaggtgagcctaatgagggctcggaatagagtaaaaggccgtgagattccagagatgttttgaaaatggaaacaacaggccgggcgcggtggctcaagcctataatcccagtactttgggaggccgaggtaggcggattacctgaggttgggagttcaagaccagcctgacccacatggagaaaccccatctctactaaaaatacaaaattagccggacttggtggcacatgcctgtaatcccagctacttgggaaggctgaggcaggagaatcgcttgaacctgggaggtggaggttgtggtgagccgagatcgcgccattgcactccagcctgggcaagagcaaaactctgtctcaaaaaaaaaaaaaaaaaatggaaccaatagattgaatgtggggtccaaagaagagagagaaatgaatcaagataaaaaacaacaaaaaaaaaattaaaaaaaaatttttacagaaatgaatcaagatccattgcagggtttttagttggagcaactgaatgggttgtggcatttcctgagttgagaaagaccaggatcagatttggggaaaggaaacaatagttgagtttgggccacgggaaattcaagatgcctggtatgtcaagtctggcagttgaagcagcaggtctggagctttgggggagtttggagctaaatttggagatttacatttggagggtgagcctggagaagcgggaagccagaggtgacttaggctttgagagtagggaagtggagctgccagaaatgggaacggggaatgtctgcctcgtgactcccaaggccactgactcctcttcatccccagggaatgcccagaacaccttggcccagcccacggtgtggctgaccattgtgctcaccacagtcgtctgcatcatgcccgtggttgccttccgattcctcaggctcaacctgaagccggatctctccgacacggtgagaagccaggctacctgctgtgggaggcagagatggggtggctggaaaggcctcatgtgaacactggggggctctgtggggccatgtggctgttcagtgtgttggtgcttatctgttcttcctggggacagacaccctgtgcagctggccacagaggcctctgcgtcagcctggtcccaggtgctgtgggtcggaggcctctgtgtcagcctggtcccgggtgctgtgggtcccttctccttggcgatatctgacacctccacgctgacagagggctcttccctgtgcccctctgcaggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagttatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaagtgtgtaatttgtctcttttctgatgtttaaccaagactggtggtgaaagtaaagacagaaactgtctcttaaatgtaattgagtgggtagatctgggatatcttggacaaattggaatctgactggtgtgggatagcacctcatccatttgcagacctcccgggatctgagtttcagctgaagatgaagacggggcagtgggtggtactgagcggcatatcgtatggactttggctgggtgcctaggaccttgagctgtttacctttctccaaacgcaggccaacctgtcatccctaacacacgccagatggatgtgtgtgtagggaaagtacctggtaaatattgtaaggttttgttttttaactctgcgcttttccgcatgcctcacatcttcctggcttctcaagtgagtatcaaggaagctaaagtcttatattaaagggagctttcctccagggaagggagggcggatgaggatggggtcctaggagtcagggccagggttagtgctggcctgaggagaaagaagtatagcttcctccgccgatggccaatatcagcatgatccagccccacccgcaggctaatttccccctgacccagccagtcttcagttatggaacaatccttctcaaaaacgtagactgggtgtggtggctcaatgcctgtaatcccagcattttgcgaggctgaggcaggaggatcacttgagcccagcccaggagttcaagaccagcctgggcaacatggggagaccccgcctgtattaaaaaaaaaaaaaaaaagggtgggggagcggagggtgtatggggggaagatgtgaagataagatctgtttccctcttcaggagaaacggcccctggcgggaatcccgccacagaccgccaggaacaccacctgacacccacctccacccagggagaggctgtccagtccacacaagcctttctttggggtctgtctggaaccctgagctttgggcagcaagtggcatctggcttcagtgcccccacccccgaaacacagaaagaagccttaatcccttgaggctggtgaggccccaagtccacccctcccacaagacaggtcttcagcactgcgctggcctcccgttgggggtctgttcagccactgggaatgtcttccttggctcctctcgctgaccctggctctcctgcacccaggatcctattatgtgtgtctgaggggcagggccaatgtcattttaactttcattgcctcttggggacgcgttttctccgtcgcgatatagacacacgcctccacggaggctccgggcactcgggctccccgttttctcccctctgccgcaggcatccctggtcttccttccctgcgctgactgagcacctgggctcctgtgggagtggcttccagcccctaggtccccatcgtcctagtgccttttctgagtgcgtggaggtgaagtctgtccgataccgcagctttgttccactgagcctgcttatctccaagggcgttcctctccactccactaaagcagcacacacccatgggcgcccactgccgtcgggaggagctccacctctgaactctcacaattcattcagcatttggccatccatattcttcagttcttcccgcttccatctgtgctcccagcgaaaactacggcccctccctttcctcctggtcgcttgcttccatatgtgaacccttacttgcttcccaatccagcccggagcccgtggtctggtactcgtcgctttgccccggaacattccagccttgggtcagcccagcgtctcccagggtgagctgtggaatgctgaagggcagcacacaaccacggagcaagaggagcggcagctgcccgggctccctccgcaggcgcctctgcacggcgaggagacgctgggaacctcattctcctgcccctccctcaactcctgccaccgcctcccaccctgccctcagcagatggtgctgcctcctacttcacggagcaaataacttctgcggctttcctctcaactacaaatctcactgcgcacaggcacgccggccttcccctttcctttcccctgcctggggaggctggactctcctgtcccgctccctgtggccccgcccctcccctcctcccaccactgcaccttccattgtccttcaccaggaccttctcttgaccctgccttcatttccctctccgttgattctttccttccccaaattagcctgctcagttttcttccccctcacctgacccctaacccctatcaactctgttgtggtctgtgtccctcccattagcctctctgttatctcttccactgcctgtaatctggcatctccttcaccagtccctgaaatgctttcactaaaatcacctttgaccttcatgttggccaagtccagaaggcatttccaggtctgatctgacttgcaatctcttagtcatttgactgtgttggctgccttctccttgaaactctgccctctgctgactttgttccactttctcttggtttaactgctgcctctctggttgatccttctgtctccttccttggagctccttcctctgttcttcttcccaccatgccccaggactccatacttggctctaagcttttctcttctgtgcagggtccttgaaggtccccatgcaaacccatggtttaaataagatttgtttaaacaagtaagatttaacaattaaatggagagtcaccattgttcacctctagattggacttcttccttccactccacgctccagacccttgtattcaattatccattggacctctccactaggacgacccaccaccacctgttattcaacataccccacactgaacattgtttttcccaacacctgttgctcctcccgcatcctctatttcagtgagcagcacgcgatctcaccagtcaccaaagccagacacacatgtcctggagaaaaccctacaacctctgctctggggccaccacactgtaaatcatatatttcatcttctttgatgtggagcatgaaatgattaagctgcaatgtcctgagccactgtttcccagtgattgtgacccaggcagggtcacgacagccatatttctgtccccaaagcggggccatctaggttgggactcaaaacacaaagaaattctgccacaaaggttcaatgtcactttccttggccccaaaagagaaactggagagatcagagtgctcagattaggtaggcagctgcagcctcccactgtagccaccctgcagagcatgagggagggactcactgataaagcaccaggactacccactgcagtctctacttcagaggaagcaagccattgatggagatgtactaaacactgggctctgcggctgaaggaaggagctgagttctcctgcttatctctgctccagtgtcctatcttgaaggactgtgtcctgaccccagtgagaaacatgacctgtctgaccctcccaacccttcctggaaactttccagttctcagtgagttgctgggagctgccctgctggacacccgcctggggagggtgtagacttatcttgccgggctgagagagggaagtctttcccaatactagtctattaaaacacacactgggctgggcgcagtggctcacgcctgtaatcccagcactttgggaggccaaggcgggtggatcatctgaggtcaggagttcgagaccagcctgactaaaatggcttcaccctgtctatacgaaaaatacaacaaattagctgggcatgggggcagacgcctgtaatcccagctactcaggaggctgaggcaggagaattacttgaacctgggaggcggaggttgcattgagctaagatcaggccgttgcactctagcctgggcaacaagagcgaaactccatctaaaaaaaccaaaacacacacacacacacacacacacacacacacacacacacacacacacacacagtggcccggcatggtggctcatgcctgtaaccccagcactttgggaggtcaaggtgggcagatcgcctgaggccaggagttcgagaccagtctggccaacatggtgaaaccctgtctctactaaaaatacaaaaattagctgggtgtcctggcgtgcccctgtaatctcggctactcaggaggctgaggcaggagaatggcttgaacccaggaggcagaggttgcagtgagcagagatcgcgccactatactccagcctgggcgacagagtaagtctccttctaaaaaaataaaataacaaaacaaaacacacacacactttccctctctctctctctccaaaacgtgatggagtgtctcctcttaagaaaggagtgtttttggacacagaaagagggagttcctccagcctagcacagcctgagtttggcctgggctggaaattctgcagaaatcttccatcctgccactgggaataggacagggaggcctaagccgtgttttcggccccccggggcccagcagggacatgtgtgggttccaggactggggcaaggaggagaggatgcccaggtttactcaagggcaggcaggaggtgaggagggggtgacaggtggaaggaaaggaccatgtcccactctccactccttcctcatgggccactcttcatttcactcgcagccccgcagtgcacagctacaagctgggggttcatctcttcctggtcccctactaccttgggtgcagctcttctgccagaaccttctgggcgcctgctgctgtgcctgggctccccacgcagggagggacacccctggggcggaaggcaggcagctgcatagctgagtggctgcttctacaacacctggagaaccgctggggctagaagcaaacatgcagcagtttgggcctgggggttgattctcctctgcaggggaagggaagatttctagaaacgcagaaagtctattctgtggaggtacaaaggataccagaagactataggagacatccttagtacccccagatgctggctgttctctaggtctaccctcacacaaagaagtgggtgagacaaccttggaccccggctttggatccagcatagtagaaccggccagcttgccctgtcatgttttctgcaatgtctgggactgcggttcttcatacttttggctcaggttcacctctgaaaatccagtgaagccatgtgatgaaatgcttatgtgcttttacaaagtgcatgcagtttaataggctcctcagctgttcacctagggatgcttcaggcagccctgccctgaatgttcatgggactcagggcaagtagcaaatggaggcccacgtaccacgtgtctgagtacagaggagttatgagatcaaagtaggctgtgtcttcctaccttgacagatatatcttcctaacaacttggaatgtcagtttaaatttagaacctgcccctttggcctcccagcccccagcctgcccctcctcttcccacttccctccctgtcccattctacactgtgagggtccttgcttctgcagcacaccccagcacacaagtccaagttccacctgcacccctgcaaacagctgttcctggccacttactggagccaggtgtgcacactggcagatgggtctgtttgccagagaatacctgaagcagaaggctgcagagtccttggaaatgaactcaacaccatttggatagaaaaatgccagagtctagaatagtgcttcaggtgaataaccagcttttaaagtttccaatctgttaaatttctttcctttttttttttgagttggagtctctgtcacccaggctggagtgtagtggcactatcttggctcactgcaacctctgcctcctggattcaagcaattctcctgccttagcctcctaggtagctgggattacagatgtgtgccactacaccaggctaatttttgtatttttagtagagatgggtttttgccatgtttgccaggctggtttcgaactcctgacctcaagtgagctgcccacctcagcctcccaaagtgctgggattacaggtgtgagccaccgtgcccagcctttctttcccttcttgaaaagtaaataaataaataaaatttccaatctgtgataggctggctgatacttttataaaatacaatgaaaacaaattcctggaaaatggaaaatgatcaggagcttggatgttgcagcaaagtaaaattgtgataaaagtttctaaatgcttggtgtttcatttcatttcatttctttttttcttttcttttttttttttttttttgagacggagtctccctcttgcacccaggctggagtgcagtggcacgatctcggctcactgcaacctccacctcctgggttcaagtgattctcctacctcagcctcccgagtagctgggactacaggtgcccaccaccacacccgggtaattttttgtatttttagtagagatggggtttcactgtgttagtcaggatggtctcgatctcctgattttgtgatccgcccgcctcggcctcccaaagtgctgtgattacaggtgtgagccactgcacctggcctaatttttgtatttttaatagagacggggttttgccatgttggccaggctggtctcgaactcctgatctcatgtgatccacctgcctcagcctcccagagtgctgggattacaggtgtgagccactgcaccctgctgcttttcttttctttctttttttttgagatggagtttcactcttgttacccaggctggagagcaatggtgcgatctctgctcactgcaacctctgcctcccgggttcaaatgattctcctgcctcagcctcctgaatagctgggattacaagcatgggccaccgtggccggctaagttttttgtatttttagtagagacgagatttctccatgttggtcaggctggtcttgaactcccaacctcaggtgatctgcatgcctcagcctcccaaagttctggcattacaggagtgagccactgcgcccggtgccctgctgcttttcatttctttctttcttttttttttttttgagatggagttttgctcttgttgcccaggctggagtgcaatggcattatctcagctcaccgcaacctccgcctcccgggttcaagaaattctccagcctcagcctcccgagtagctgcgattacaggcatgtgccaccatgcctggctaattttgcatttttaatagagacagggtttctactggtcagtctggtctcaaactcccgacctcaggcgatccgccagcctcggcctcccaaagtgctgggattacaggcgtaagccacagcgcctcgcctctgctgcttttcatttctatacttggctcattgtggtccagtaacaagccatctgttgaatggcagcagttcaagggccacaatttgagtgtgctggtctagaaggaggcagtgtgggctccagctgggcaagtccagtcggcccctttgactcatcattttatgggaggggtatggccagaagagggctcatggtggtggtggtgaggggagctccctagatcagcctgcatcagtagcctttcttgtctgagtttgggtggtattgtcagaggcatttgaaccagagcaactccatcttgaatagggtctgggtaacataaggctgagacctactgggctgcatttccaggagatcagacattcttagttataggatgagctaggaggtcagcacaagatacaggtcacaaagaccttgctgataaaataggatgcagtaaagaagccagccaaaagccaccaaaaccaagatggtgacacaagtgatctccggttgtcctcactgctcattatgtgctaattattagcatgctaaaagacattcccacctgcgccatgacagtttacaaatgccatggcagtgtctggaagttaccctatatggtaaaaaaaggggaggaacactcccctcagttccaggaattgcccaccctttcctggaaaactcatgaataatccaccccctgtttagcacataaccaagaagtaactataagtataatcaattgttacttgattagtctgttctcatgttgctaataaagacatacccaggactgggtaatttataaaggaaagaggtttaattgacccacagttcagcatggctggggaggcctcaggaaacttgcaatcattgcagatgggaaagcaaacatgtccttcttcacatggtggcagccagggcaagaatgagagcccagtgaagggggaagccccttataaaaccatcagatcttgtgagtacttactatcatgagaatagaataggggaaacggcctccatgatcaattacctcccaccaggtccctcccataacaagtggagattatgggaactacaagatgagatttgggtggggacacagccaaaccatattatcagttgagcagcccatgccactgctctacctatggaatagccattcttttattcttttactttctttttttttttttgaaacagagtctcactctgtcacccaggctggagtgcagtggtgtcatctcactgcaaccctttactgcaacctctgggttcaagcgattctcgtgcgtcagcctcccaagtaaatgggattacaggaatgaaccattatacctgggtaatttttgtatttttactagagtcagggtttcgccatgttgcccaggctggtctcaagctcctgagctcgaatgatcagcctgcctcagcctcccaaagtgctgggataacaggcatgagccatggtgcctggcctattcctttactttcttaataaacttgctttcactttactctattgatttgcctcaaaatctttctttctcgagatctaagaaccctctgctggggtccggattgggacccctttctggtaatagcataagggagggatgtagtgggatgtagacccttgaactgcgtggaattctagcatgatttatcaagaagtctgaagtatcatctcatatcatggtgctaagtctccactgggccagtggccaatgacaggcaagggaatcaaaggcagggtatgtattcataaatgaggaaacctattatatgacagaagagcttaattcttattcttctaatttaaaaagttgtttttttttcaggatggggtcttgctatgttgcccagtctgttctccaactcctggcctcaagcaatcctcccacctcatcctcctaagtaggtgggattacaggtttgtactacatgctgggctgaaaactttttgataccaaaattttgatttggtttttaatatttgatgtataggtacagaagaatgctacaagcatcaaagttcaagtaagctaggtgtgtcaaaataaatctttagataaataaggctgtgctatgaaataaattgtatcccccccaattcatatgttgaaatcataacccctatgtgactgtatttgtttttgtttgtttattttgttttgattttgagacagtatcactctatcacccaggctggagtatagtggcatagtctcagctgactgcaatctctgcttctggggctcaaaccatcctcctgcatccgcctcctgagtagctggaactacaggcatgcaccaccatgcctagataatttttgtagagacagggtcttgccatgttgtccagtcttgtctcaaattcctgaactcaagtgatctgcctgctttggcctcccaaagtgttgggattacaggtatgagccactgtgcctggccagtattttgttacagcagctggagttgactaatacagactgattggatagctttagttcatcctagaggacaggtcttgagctgggcatggtggtgcgcatctgtggtcccagctacttgagaggttgaggcaggagaattgcttgaacctgggaggcagaggttgcagtgagctgaggtcgcgccactgcactccagcctgggcgacatgagcaaaacaactccatctcaaaaaaag

SEQ ID NO: 1220 - DNA, 191595 bp, Homo sapiens
gaaggtagcagtgagccgagattgcaccactgcactccagcctgggcgacagagaaagactccgtttcaaaaaaaaaaaaaaaggaacaaaagataatgaaaatatccctctttgaaacgattctgtaggtaaagcattttgcctatagccatagctgctgttgaaccaagactccacaaaccagacttgaagtgatctgatgcaaattaaaaccacaacgacataccagaacacacccaccagaaaggctaaaattaaaaatattaacaacaatgacaatgaaaaggcaagctataagtggggcaggggaatatgcaaatcacttaccaacaatatatatagtcagagtatatttttaaaaactctcaaaactcaaaagtaagaaaacaatctaattcttacaaatgagcaaaagacgtgaacatttcaccaaagaagaaaagtggatggcaaacaagcacatgaaaagatgttcaatattatcaactgttagggaaatgatatttaaaaccatggtgagataccactgcacatctgttagaatggctagattaaataccgacaatgctaagcgcagacaaggatgtagaactggaactctcatacgaatgcaaaaatggtacagccactctggaaaatggtttggcaggattttaacacctttaatgagatataagttacatgccacaaaattcactcatttaaagtatataattcaatggtttttagtaaatttacagagttgtgcaaccatcacccccaaaagaaactgccagactgttttctaaagcaagcaaaccatttcacattcccaccagcagtgcgcgaaggttctgatttttccacatcccctccaacactgaccgtgtccttttaattgtaaccatcctagtaaggataaagtactatctcactttgagtttgttggcagtttctcataaagtgaatcagacaccttctccatgatcccagtaggggtcccatgggtgcaaacctatgcaaaaatgtatcactatgcatttaatattagcctactagatacactttgctgtatgtattctatactcatttttttaaaacaaaaagacaacaggagaagaaaaactaagagattcagggaaaattaagatgaatgaaataaggaatgcaaaaaaagaaaggaataaaataaaaagaaataatgtgtctggccagagagtgcctagtgagatcacagctactgctctcacaagagggcgagttcacgtctcctacctgttcactcacctctggcacccatttaactttaagtgtatggtggccgggcgcggtggctcatgccctaactccagcactttgggaggccaaggccggtggatcacttgagtccaggagttccagaccagcctggccaacatggcgaaaccctgtctctactaaaaaatgcaaaaaaaatttagcaggatgtggtggcaagcacctgtaatcacagctacctgggaggctgaggcacaagaatcacttgaacctgggaaggagaggttgcagtgagccgagatagcaccactgcactccagccggggtgacagagtgagactctgtatacaagaaaaaaaaatagtatatagtaagtaaatgaagtaatttaaggtgaaggttccttagaatcccacgtctttcccctgtctagtgtagaaactgctgtttgcccaccttcttttccctcctgcctcagaaacaaaaccttgctttttgtcagtattcttgttaaacagctacatttcccagcctctttgcaagccaggtgtggtcatgtggtcatttgcccaagatgtcagcacaagcaatgtgtgggaactctgggaagtctccctcaaaggacagggctccctctctttgctccttcctactggccggacttcaggcatgaaggcgggacctccagcagccaccctggataaggaggataagggcagcagccttaggatgggccagtgcagagctgaagaagccttggtttcccagtgacaatccaggccagcatacctctcctgaacctcctaaccccagcctcctctgatgtgagacagaaagcactttatatcttatttaaactaggtcgtttgagagttttctgctataacagatgttttttctcacagatacatcctctgtcaaaattcaaccacaaaattcaatcattttaggtgctatgtgggcctgggtcaacctcaccctctctcggtgttgtttttctcatctacaaaatggagataatgacacctgcctcacgaaattgtgaggtctaggtgggaaagtactttgcaggtgtaaaaagccatcaaaaggcaagagtcattttgttcagtcaggttcctgaatcttccagaatgcacttttttttttttttttttttttttgagacagagtctcgctctgtcgccaggctggagtgcagtggcataatcttgactcactgcaacgtccacctcccgggttcaagcaattcccctgcctccgcctcccgagtagctgggactacaggcaagtgccaccacatccagctaatttttttgtattttagtagagacagggtttcaccatgttggccaggatggtctcgatctcctgacccatgatccgcccgcctcggcctcccaaagtgctgggattacaggcacaagccaccgcgcccagcccagaatccactcttaaaactcaagaacttagtgccaatgaactgtacacttaaaaaattgttgaaatgctgggcgcggtgactcacgcctgtaatcccagcgctttgggaggccgaagcgagcagatcacctgaggtcaggaattccagaccagcctggccaacatggtgaaatcccatctctactaaaagtacaaaaattagccaggtgtggtggcgcatgcctgtagtcccagctacttgggagtctgaggcaggagaatcgcttgaacccaggaggcagaggttgcagtgagccgggatcgcaccactgcactccagcctgggcgacacagccagactccgtctcaaaaaccaaaacaaacaaacaaacaaaaaatagttgaaatggcctgtaatcctagcactttaggaggccagggtgagagcatcacttgaggtcaggagttcaagaccagcctaggcaacatagcaagaccccatctctacaaaaaaaaaaaaattaaaaaattagccaggcacagtggcttgggcctgtagtcccagttactcagggtcctgaggcaggaagatcacttaagcccaggagttcaaggttacagtgagctatgattgtgccactttactccagcctgggcaacagagcgagatctcatcacaaaaaaaaaataaagtttaaaataataaattgtatgctatgtatattttaccagaattatttttaaaaccaactcaaatgtcacaaaggtttactgagccctaaccatgggccagacgcctggcttgctaaggataagccagttcctctcaagctgcacctctggatcctatgagcagaagccaatagtgaagccccgccgccgcccatccacatgggcaccagccacctcctccccctcaattatctcatgccttgtgtgtttttttttttttaattgaattttaagttctgggatacatgtgcaggacgtgcaagtttgtttcataagtaaacgtgtgccatggtggtttgctgcacctatcaaccaatcacctaggtattaagccccgcataccttagctatatttttttaacacaagtaaattctgctttctattatattaataagtttgttttaatgtaaaaagagaagtttttaatgattggccaattctatgactttcattctcccttccagatccctgaggaaatggattcttgaggagtccctttgccttctcctttgtctgtatgtcccctgccccatgacaggtacattctccagtcagggatgcccaggccagcccagcatactggaggcaggttcacctccaactgagaaccacggctggggccacaggaccctgggcaagtttgcaaatccatgaaaggtgcacagagagattcaaggtcgaggccaggtgcagtggctcacacctgtaatcccagcactttgggaggccgaggcaggtggatcacctgaggtcaggcaatcgagaccagcctggccaacatggtgaaacctcatctctactaagtatacaaaaattagccagatatgctggcacacacctgtagttccacctatttgggaggctgaggcacaagaatctcttaaccccgggaggcagaggttgcagtgagccaagatctcgctactgcacaccagcctgggcatctggactacagagtgagactctgtctcaaaaaaaaaaaaaaaaaaaaagattcaaggttggacattgcctctgcccccaaactttgaaatcttctaagaactctagccagccaggtgactgcagtgtttgggggaaacagtagcataaacccattctgatgaagggcttttgagcttggtggagaccaggcctccctccatcagcagcagcctcgagtgataatgacagctactgtttctatatctgcactgcttccaatgccatcagcctcatggctgatcctcacaaatggggttcctgctcccaaaaacaggcaaggaatgggaggtcagaatttaaggaattggccccatctcactcaccagtaagtggggaaactggtgttcaaaccaagtctgtgtccgtcccagctaggtccaggccacattgtccccaactccagcacagccccctgaaatggctctgattcatttccactcccaacccgctcagggcccagaagaaaggtagtgctttctcttggggtcttccccaagcgtgagcagaccattttagagcaaaagcctccacgtctgcataagcctggctctcagattttttctggcctgattttcactaattctgttggtgatgagctgcctaataaaattatgctaagttatgtgcataaagagtagcatcttaaactctaattattggccacatctttgaagaattcctgtgcaatttccagggtaatcaactcacctctttctttcggcctgattagctgtttgggccaatttaagcccccacccccagccccactcgaatcaacggggttctggatgtcattagctactccaattgcctttttaaaaatctgtttcatataaaaggacaaatgagaatgaatatttggccatctttaagacactaactacattcttttccacagcctgttctcgtttattctttctttcttccggaggaatttgaacacagcctgggctcccgcagttcatgactgcaaaaggcttcgccttcgaaatctgacccaagtgggcatattcgggaaatgtggcagcttcgaagaacatgagccagttaagttttctctacctattcttcctccgcactcacctcccagttctaggcagctggtttatgcagcctgctttccaggactgtcgaaggaaaaggcacctctgccaaaagcaccccaggctacagggctgaacagagacccatcgtatcattcgctggaaaagcaagaggaaacttcatccaaggactggcttcttctctcctttatttactagtgtggttatgtcaataaagtcatgcagaaccactgggcatgggagtgggttggttccaatggaaagggttgcacctgagcctcctcggacatagacgcagaaatgagaacaggtgggaaagggtcggtgaggcggggtagaagagaaggagtgaaaggggccctcgaacatggttcagtgtagagggctaactttaataatgcttgctcgttctgcaacggactctttagtccgaatgccaaggtctgcaggccctccctatctccctgacctcacctcctccatgccccaccccctcggtctcagcactccagccctgtgcccctccgacatgcccagcctttcctaccccggggcctttgcacacactgcaaccacaatgtcacttccccagatctctctgaatgacgctctgcctttgcaaacttgcccagggtcctgtggccttagccattgttcaaagttagaaatgaacctccccccagtatgctaggctggcctgggcatccctgactagagaacatacccctcatggggcagcccaaggagaaagcaaagggactcctcaagaatccattgactggctgggcacggtggctcatgcctgtaattccaacacttcgggaggccaaggcaggcagatcacttgagatcaggagtttgagaccagcctggccaacatggtgaaaccccgcctctactaaaaataccaaaattagccaggtgtggtggcacgtgcctgtaatcccagctactcgggaggttgaagcaggagaattgcttgaacctgggaggcagaggttgcagtgacccaagatcgtgccactgcactccagcctgggtgacaatgcaagactctgtctcaaaaaaaaaaaaaaaaaaaagaatccatttacttggggatcttggagaatagaattggccaatcattaaaaacttttttttttacattaaatccactaatggaatagaaagcagaatttccttgagattaaaaaaaaaaaccccacaaggcatgagaaaattgagggggacggtgtggctggcacccacatggataggttggggggcatcactaccagcttctgctcttacagggtccagaggtgcacagcaccctccttctcatcctgcagccctctgctccagtgggcccatctctgactcccagcactttccccacctttattcctacctggttgtcatcctctgcctaacccttaggctgctttatcttaggaagctttctctccacctgatgttagtcttaatctgtttattgtctttcacacacatacacacacacacacacagagtgtaatcactatgagggcagacactacgcttgtctggttccctgccacgcctccagccccaagaacagtgcctaacacataggaagtgctcagcaaatatttgatcaatgaaggaataaaaatgtcagcatattctgcacatctcctacccatcccccaacactttttccattccttctggactctgcaatctttctcaaaggaaataaaaaatagtcctgggcttatctggacctgatctgatcaaagaaaaaaaatgtatttcttttaaatctcttgaaaacaaacaccacaggcttagaacaccaagttcttaatgtaagcaaacagaacctgctggctgaattctaagaaatgagccctggcttggtatcaagcataggttgtggggccgatgacttcacatgtgactcagttaccccaaatttcagggggaatccatttcaaaatcaaaacgtcaacatggaaagtggagggtggctttgtttgggcattcctgcaagaaggcaggctttctgaaaagatgctatgttatagataactcatccacaaaaggggggcaggagggatggggagaaaccccaggattgggtgtatttctcggctaaggctttggatgcaaactgatccgggaatgcgtgatcctccaaaaatccaccagcccccaaagtgcttgagttacccctccgaccacagccacatggaaaatgaaattaaatcccacggaaagatttgacttttttaacattatgcaatgtttgggtgaaaaaaggggggtggggagagggagatcagaaaaaaattcatctttttcccagagtttagcagagctatttctagcttttaatgatacatttcaccatcacttcatgggtagttttgagaggcgcgaaggcgggaccggttctgttatgtaacccatttaaagtaggaaattagcaagtcctgaatgaattctgtcactgtgctcccacttctggaaaatttggagcgactacagttctattttgaggtgagcaaatccatcatttatagacctcctcacaaataccacagggcttcatgtcaccctgaaaagtttcataacaaaaacactaaaagtacttggggtgttggtacatttcgtctcaaaaccttattagactgaacagtgaattggcaaagcttcctacttgccaattattcaaaaatgcaaatatccaagagcaaataaatattcatctctcaccctccctgccttttttttttccttttttttttttttaactaagtccagcaaaatattctggtcaacaacatgaaaagaaatgtctgtttttcacggagcctctggccatgaaataaattctgaagctatgaaagcacagtcttgaaactcagggcagttgggcacgtggggtccggctggttgtggaaaacaggaaacagcaatgtctttcagtcctcaagttccccctagcggctccggcggaggagtgtccgcacatggacggaagttcactgcaggcaaatgcagaggcttaaggtcgtgcagggatagcacacgtttaagggaaagcatggtcggtccctacctttgaaaccacataccttccttttgctgctgtcatgagataacacaactaagttacaattatctttctaatctatatactgaggatggccctttccattgagaaccaaaaagagggaaccagcagctcacactgcagacagccactaattacaccatttggtatagtatttggtatagtaggcggaggcataacttgcttcctgagacacacgagcttatacctccgggcccttttacaaatacagacagacaaatggtacagctgacacgtgccaattaaattagggtttctctggctgggcgtatgggctcatgcctgtaatcccagcactttgggaggctgaggcaggcagatcacctgaggcctggagttcgagaccagcctggccaacatggtgaaaccccgtctctactaaagatacaaaacttaaccgggcgtggtggcaggcccagctactcagaaggctgaggcaggagaatcgcctgaacctgggaggcggaggttgcagtgagccaagattgcaccactgcattgcagcctagataacagggcaagactccacctcgaaaaaaaataattagggtttctcaatgttggcacttttgacactttgggctctgttgtgggggccaccctgtgaatcacagggtgttcggcagcatctcttgcttgtagcactcctcttccccgagttgtaacaactgaaaaggtcttcataccgccacgtgtcccccaagggacaaaaatcacccaattgatttcaactacttcctacacaaaagctttttttgttttgttttgttttgagacggagtcttgctctgttgcccaggcaggagtgcagtggcacaatcacgactcactgcagcctcgacctccgaggctcaggtgattgttccgcctcagcttcccaagtcgctgggaccacaggcttgagccagtacacccagctcgttttcttgtattttttgtacatgagtttcaccacgttacccaggctggtctcaaactctgggctcaagcaatcctcctgccttggtctcccaaagctgggattacagacatgagccactgcgccgggccttaaaaattttttctgcctaaaacttaactgactgttcctatatgttccatccctcgataaaaaaaaaaaaaaaagattccagtcatcgaggaccgtgtatagaaatacaatatgaagcttatggttttcatcttattttccatttatatctatcaccttttgaaattctgacacgtctgggatggacaatagtacaaaataataaataacatgcattgatttggggttttttttgccaaaatcaaaataattttctgaactggaaagagttttctttacatttcatgtaccatgaaataaagaaaaaataggagcgttataataaaaagtcctcattttgataccagaattcatgtttctgtacaaattaaaataatcccccaaggcagaacgtacacaagctttattgggcaacagcaacgagccacgctggcaaacaatgaaagtagagtcgctcagaaacacgaaagatcatatgtgtgtcatcacagcatcgagaatttaaatcatctggaagttcctgctaaattaaagcatactgtgccagagctcccctctaatcaaaaaacgctgtcctggtgaaaatttgcaatgaggattacagagagagagatcaaccaatgaggaaatcacagactcttacatgagtttacagttaaccccactgcaacaaaataataaattagccataatttgttttttttgcaaataccatgccccccacctgaccccacaaacacaacagtcactgacatggcccagctatattaacagactgcgcctcaaaccatgctgtggcggagaagacagattcacgggtaatgccgctttggcctgagaagatgcttcggagctccaggtggaggagctgctcacgctgcaggatgctttgcaggttcattcaaaaccaaatttttttccaagaagaactggacataattcatgggaatattttaagtatatataagtggcaaaaaagctgtacattaaaagaagggggagaaataaaatgtgttgtatttacaaagctctttgtatatttttttaaatgaaaacaaagctgggagtgatagaattttaatgcaatgaaaaccaaataattcttcaaaaaactttagatgacatcattctctcgctctttcacacacacacacaccccccacacacttcaaacatacagaaaaggttaaagataaaaatagctgataggtgtttaagtaggatggagcagaagaatgtacatgtcccatttgcaattttggcaaaggtttaaaatgctgccctaaaggcacgcacgcatgcccagcctaccccagtaaaaacaagacaaagtataaaaagaaaagtctggcggggggtgggggaggcattagcatatcaatttccaatgagcacaaaattcaaaatacattaaaaagtagcatggcttacattttcagcagagaagaaactgaggaaatgttcataaagagacaatgatttttaagatttactgtcacaaaaaaaaaagggtttcacttcaggggagtggaactgggatgggaattttacaatgctagttccagcacgtggtctaatggccccaggggctggaaaagggaggtctgctccaactttaagatgcgcccttgggatgccttccaagcagctggagttagtgccacctgtctcacctggcaccacaggcaacacacatgtgcacacgcatgctttcaaaatgaggatcaaaactgtcccacataagaaattactcaagatggaaaaactagtctggtgattttcttagagaaaaaaaaagagagacaaaaaggaaggggtggggggaggggaagaaaccaaatagatcctgcttccccctgtcacacaaccatcatcaaaagacatatgaacaataataaaatagtaatagaagttcttactctggcagaaatagctagtgttgtcagagggcgcagggagctgtgagttttgctttcaggaaaagtgttcaaacagtgctgactgtgtacctcaaggccctctgacctcaaattaaattggctgtcaaagacttacggcccatggagctcccaggtgacagtgtcaatggcgctttatgtaagttctttccagattgatgaaccaagaaaaaggtcaactgaatccttatgcttaaggtttacaaactcaggagagtttcttgtatagtaactctagtttcttgtttgcttatttctttgtcttccccaccacaactaagatgacctccgagaagtacccaggcgcccctggggttctctgctgggcttacagtctgattgtgcaggtaaagatcgtgtcctctcaccggactgcatcctcctgcctttgcgtctccagtgtctgagaagcacggtgtgtgcattcctaggtgttcagggaccgtccagtgaatggcgtcagccagctgcccactgatgggatgggccaacgacgtggcagtttgcacttgagtgtcggtacttctcacccttgaccgcctccgccccagtgcggctgagacaacagagtaaaaaggtttgtggagaacactgacgagtaccttccacttccaactatggcttcttcagcccctcctgggagcattctcccttgaagatgtcaatcagtatcttaagcgttggctttaaaagtcaacttgtgcacctcaatcaaaattgagaattaaggaaaaggccagggagaccatcttcattctgcttctgctggaaacctctaaaactttctgacgaggctcccacacgccctgcctgcaggagccagcatcccgaatctccgagcaaagccaggtacagggtttgcaaagtctaaacaggactatcttaagacttcccagcgttacagagccaggttcagcatctgcaaagtctaaatgggactatcttaagacttgccagtgttacagactgatttccaagaaaacggaggcttaaaaacttccagcacaaatttctcctccacctttgaaaacacagaaactcactcaatgaatacgtcagatttgctcaatctttctgaaatttttggacaaagatcctatccttaactattcactcaatacatcttttctgccgaccttttccctctggcagaaatggctgaatcagatagagaaaagtactgcaaaactgcagaatcataagacaaaatagatgtggtgtcaacagccaattaaccagtacctgcaacgtaaagtcattctagaacattttaaaaggacaacacaaaatacaaaagcttatcaagagtgctccaaaggcaagggactatctgatcctcgtgtctccagctctccaagagcaggagttagtaggcatcagaaaccaggctgtgatgtacatctctgaagcacacagaagtagcgccaggcagagggtttgaaggatatgtattcatcaagaagtaaacgcaaatccaagatctcaaccacacttggctcttaaagatccaccaacttaacccttatggcatgcatatgtggcttctgcaagaagcaacttgaaaacccaagaatgccttgctctaccacgtcccgcgactgcaaactcccttcctctgaaacaagcagccacagctttataagaaacatgccggcatgtagtccatcctgggaggggagaaatcttcaccactggctgcctttcagcaagttccccttgaaatctgccggcagtggaacagatcccagatcccaacgctgtagcttgggcgtcctcccaccaggggttccttgttctgaaagctgccaccagtgttgttccgaaagatgcctctgcctttgtggggtcatcttccattatgcctcctaacaggaaacaggcttctatggaagagaagagtcccagccccctgacctttccgctttggtcttggaggatctgagtcacatctgccatgttgcctaaagaattagttgagtctcttatcacactgtcgacacatttaggggccattcagtggcacgtttcctgctaaaacaactctgctgaaaatgtctgaggtccttctcaaacagccactggctttgtgattgttaccaggtcccaataaagcgggatcacacctctgaaattcttttacgaggtggcaggtgaagttaactcacacactatggatgctgaatcagatcaaggataacagattggacttaggacactctctctccctctcctctcatttactggttacgatcccaggaatccagtgtaacctggataagcagggctggctggagacgatactgagcatttccgaatggagattattgtgtggataactttttaccaaatgtcactgtcttttcctcccaaaccgacaccaagagctttctatttttctgacacctctttgtaagagcaagaaagacataaagagtacatacacattaggactctttaaaaacacacacacacacacacacacacacacacacacacacaagccttctacaaccttcagctacacagaaacttttatcatgtgacaacaaaattcaagtcataaggaagctcgcacagtgacccatataaatctcccagctgagccaccagctttaacatattcatattcacctaaacatgaagaacgaggggttcagacaggcccagatgggtctctttcaggaccctccctcccgttgatgcagcgttaggactccgtttaggcgcagagccacttcccattaaaactgcatgtgttagcaattactgcaaaatccacaggtggcggttaatataaatggaacttgagctctgtccatcagggaagcgccaagaccagggccccctccagcgaacgcacggcctatgatgtgagctttgagtagctggggggagagaaccgtcttcgcaggtacttgaggacatagagggggaggcagctgaccagagtgatgacggagactttccacaagaatgacaaggtggcgatgaagtacacatctgcaaggaaaggggaagacggcagtgagcaggcaggaatattccggaaggtgcatggggtccagaaacaggcgtcacaactatcaaagggaaagtcatctcccgtcacaaacccacagcctcctggcattggccctctttctccatggactgtaagggaaggtaccatggctaagagcacacagcgccgcagcttgattttcctcgctctctcttctgtagcttcctgacagtgaaatgctacttttaacacccaggagaagaaaactatgggggccaccagatgcagtggctcatgccttaatcccagcactctgggaggccaaggcgggcagaagaattgaacccaggagtttgagaccagcttgggcaacacagcaaaaccctgtctctacaaaaaatacaaaaactagccaggcatggtggtacatgcctatagtcccagctgttcaggaggctgaggtgggaggatcatctgagcccggggagcttgagactgcagtgagccaacattgcaccaccgcactccaccctgggcaacagaataagacactgtctcaaaaaaaagagaaaaaaagaaggaaagaaaattacaggggaagaaaactcagagatgcttttgatttggtgttgtctaacagttggagagtctttctaagtcccggccactggcgagcagaaaatgacattcaaatgcaccctctgcttccagtgatggtcgcagaaagccacaggatgagtctgggtcatggtgcaaagtgttcagacccccttgtcagagaaaggcttaagctgaccctcagggactctgatggaaggtggggggggcgggcgtactgcctttcctgctgcaggattataaacccggttatgaggttttcttaagagaggagtgacagtttgtggctttcaatatagcagaagccagaataagccccttctccactttctgagcacaggatgctgaaatgcagctgccactgaggcagcacctactaagtgccaggcccaaggctcaactcaccctgtggttttcctacacctctgacccggtcctgtggtgtgtccctatcacaaacaagctgagcttcctgagcaggggccacatctctgtgaccacctcaggcccaagcctttgagcacatactaggtctcacaaaacgctttctagagactagtgacaagggtgaaactgctttaaaactccactgttcacagggatgctcctttagttcctggagcgcacagtaaatgctcacaaatcctttctagaaactggggctgcaactgtgaaacctttacttttcaggggatgtttcttttacctttactaaaaccttcctaaggagctttggaagctggcaaaagagccgcgatcaaagatgcttccagggtaaggtcgagtttctctgcctttttgttgttattgccccttaaggaacatttttagacttttcttcttctcctaattgaccacctccatgacatgttaatgtcacaggtatactgtgtatctgtttataatattatatatacatctcctttatacgtaaaaggttagggtttgttcacaccccaccaaagaccactgtttgttccccaggcggtggggtccacaccacccccactgagaaggcctgaggtaaaggagcaagggatgggccattgctagagagcctgggccctgcaggtttcccacggaggatggggcgtgagggggttgtcattaactgaaagtttcccccagagagagtctatcctgcaatcctgaacacacatgagcttcttagcagagaagcagcctccgggccctgctcccccagctgataaaggagaaacagtatcactcttgagggttttttgtttgaataacacagacagaaaattaaatgctcctactgaggaggaaagaggtgtaaagaggactgtctgctaaaccagctagactttcaggatgacccctggccctgaggttccaaagccatagcggcttgagtttgccccgtgcgggggaaaccaagattagagttcagaatctatccacagcacaacacagaaaatgctggatcatctgaaccgtgcccgtgttgcaagttctagttgaactagaaacaggtttctagacaggaattaaagcccgtgtcagcacccgatggggtccgtagcatagcatggggtcatcttggtggccctgcagggacttgtggctcaatcaattgggaagaaattaactgatatggcaaagcaagtgaggtcagcatggaagagtgatgaaaccaggcttgtccatctagagacagtggctgacgctggacaagcccaagagtacctggaatcactactgaggtcagagaaatctgccaccaccccacattaggatggtgctgacactcccccatctctacattcccataacattttttattatttatttatttatttatttatttagaaatggagtcttactctgtcgcccaggctagagtgcagtggcgtgatctcagctcactgcaaccttcgcctcccgggttcaggcgattcttctgcctcagccacccaagtagctgggactacaggtgtgtgccaccacgccctgctgatttttgtatttttagtagagatggggtttcaccatgttgaccagaccggtctcaaactcctgacctcgtgatccacccgcctctgcctcccaaaatgctgggattacaggtgtgagccattgtgcccggcctccataacattttttatttggggtgtgcctgggcgtctagcacctcaccccatttttctttcttggtaactttgatcacatctgatattcctgtgctcacactcacttaatgtgtgtttatcgtgtgttcccaacgagaagggcagctccctggcgagcccgtccacctcatctgccaccataatcctggcacacggcaggtgctcccacgtctacggaactggcgagtaccttcagcacttggtttgctgtgaggagcagcagattgtattctgagatccctggagtccctcaggagctctatcaggacacagcagcaaggcagggctgcacgggcaaggttctggggctcggcacctcccagcactgccactttgctatcacaagtccccttttatcagtttcatagattggacttcagattaagatttcatgggaacaaaaagattttgtggcccaaaaaaggtgacagagcaagactccgactcaaaaagaaaaacaaaaacactgtctactgcaatcacgccctctgtcctcaatttcacaccctgaggcacaactaccacctgtccctagagaacacctgttaagaaaacgtggacagctgagcgggaaggactgctggaggaagagcccaggccgagcgctgggaaccccccttccttcatacggcagtgagacctctgggccagattcactgggggtgacggacggggtttaagcattcaggggtcttaccgatgaactcgtgtaagaacaccagggaggcgatgtagcaggccaggctgagcagctccgccactgtcatgagccagtgccaggtctggatggtcagcgccaccatgagcagctcggtgaggatcagcgaggtgaaggagatggccacgatgtgcacgaactccgactcaaacagcagcagcgccccgtacatgatggtgctccctgcaaacaccagagaagggtattcccctcaccctccctgcgaaagccgtgcgctgctcgcctacacctggctcctttccgcagttttcatttagacatgaaaggcatcacttgttacatgaggttaatgactggtgctttatgcaggtctgaacctatggttttctgattttcctctttgaccttgtaggataaataatctttaactacaaagtgagaaaaagggagaaaaaaggaagtaaggcagggaggggagtatctagagttgatgaaagaaatagaaagttaaatataatatttaaaatgatggagtcgcggccaggcgcgggggctcaggcctgaaaacccacaatttgggaggccaaggtgggtggattgcttgagctcaggagtctgagaccagcttgggcaacaaggtgaaagcccgtctctacaaaaaatacaaaaattagccaggcatggtggcatgcacctgtagtcccagctactcaggaggctgaggtgggaggatcacttgagcctgggagatggaggttacagtgagctgagattgtaccactgcactccagcctgggtgacagagtgagcccctgtctcaaaaaaataaaaaataaaatgatgtcgtgactcacacctgtaatcagcactttgggaggctgaggcgggcggatcactggaggccaggagttcaagaccagactagccaccatggcgaaaccctgtctctactagaaatacaaaaattagctggacgtggaagcgcatgcctgtagtcccagctactcgggaggctgaggcacgagaatttcttaaacctgggaggtggaagttgcagtaagccgagatcgtgccactgcactccagcctgggtgatacagcaagactctgttacaaaaaaaaaaaaaagaataaaccccaataggagacatgaacagtaaatttattttttaaaaaaataataaaccccagccagtcgcggtggcttacgcctgtaatcccaacactttgggaggccaaggtgggcggatcacaaggtcaggagttcgagaccagcctggccaacatggtgaaacccccgcctctactaaaaatactaaaattaggtgggcgcctgtaatcccagttattcgggaggctgaggccggagaatcgcttgaaaccataaggcggaggttgcagtgagccaaaatggcgccactgcactccagcctggacaaaagagcaaaactccatctcagaatagtaataataataatccccaaatacacatgtttatttgtaagttatatatgtgtacctgtccagatatatagaaatattaggatcatttcacatgtatattatatgtactacaaaacatacataaaaatggaaatactaaaaaagagtgaggattccgggcacagtggctcatgcctgtaatcccaacactttgtgaggctgaggcaagagaattgcttgagtccaggagtttgagatcagcctgcacaacatggtgagacctcatctctacaaaaaatacaaaaattagccgggtgtggtggtgtacacctgtagtctaagatgctgaactagaaacaggtttctagacaggaattaaagcctgtgtcagcacccgacaggatccacagcacagcatgaggtcatcttgctggacctgcagggactcgtggctcacagtccattgggaagaaatgaactgatttggaaactgatttggtggtggtgtacacctgtggtcccagactcagaaggctgaggtagggggatcacctgagcctggggaggtcgaggctacggcgagccgtgattgctccactgaactccagcctgggcaacagagtgagaccctccgccacccagggtctcactctgtttctacatattatataaaatatattttataagtatataaaatctattatgtgcactacaaaacatacataaaaatagaaatactaaaaaaggattctgggcatggtggctttgccctgtgtctcaaaaatatataaataaataaatatatatatgtaaatttaaaagagttaggaaaaataaatacaaacagaagttttgctattttcttcttatattccaacaggtcatcttacaacgcctccacagtctgggaagacccccctctggaggccactgaggtaaacatgtttttccaaaactacgacttgacctgactctcagaaaaggtttcagaacatcccagaaagcatctgctttttgcctcatgagtggagcagccccacaggctttgattactgtccactgccttcctctggcttcactacctcatttctcacacagcagcactgtgcatgtctgatgttcaagtccttatacagggtgagcagggtctcccctgggtcccactgccaccctccttcctgctatttcagattcgtttcttctcttcttgttctacaggcaagaaggggacaccctgagtcagtaccagagcacaagacaaacaggtgtctccactcatccttaccttgatagatgctaatcaaaacccatattaagaatgtcttgtaggacaacggccgtccctgaatgagagacagagaaaggttagagccggtttcgcggggggctcacgcagcatgccatcagctttcacgttattctcccgctaacgagataaggcaacccatctgtcttcatcaataaagtggctcgcacacatctgaacacattggaggaattatttctttaaaaaaagaattggccaggcatggtggctcacacctgtaatcccagcactttggaaggctgaggcaagtggatcacttgaggtcaggagtttgagaccagcctggccaacatggtgaaacctcctctttactaaaaatacaaaaattagccaggcatggtggtgcacgcctgtaatcccagctactcgggaggctgaagcaggagaatcgcttgaacccaggaggtggatgttgtagtgagccgagatcgagccactacactccagcgtgggtgacaaagtgagaattagtctcaaaaaaaaaaaaaaaaagaattaacattaaaattaacattacatgggaataaaccttcccttgggtaaaaaaccctgaagacaaataaaattatacacctgcctaggcacacgccaccacacacactttttggaactgtacacaagaacatctctgggagcaaacgttaagttgcaactgcaaagcggaactgtcaggggctttttgcaagtcgtgagttggcttgttttcagtttatctattactgtactttttcacgttctttataccagtgaatatattactgctttaagaaaaaatgtaaactcccacaccttccccccaaaagtaaaaaagctaccagttcaagtgtgttcaaatcagaattggagggtctgtgtgaaataaattcaaagaaaaaaagcagggagggagggaaggaagggaaaagcaaaggaggaaaggaggaaggagggactgaaaagctaacagaaccttgagaagatccttgtagagctcaggatacagcatggcaacttccgatttgacatctttgtccaggaccagagaaaacacaggaaacatggtgtaaattgtggagtacctgggagagaaaaccgccataggtaagacctggctgacgcgataggagctatgtgctgtgccagcctccggcacccaagtcccaaccatgcctctaacaaatatttactgcttgtctattatgctccggggctggctgtaagcaccagaaacccatgagcaaaaatggacaaaaatgtctgccctgaagagctttcatcccggtcagcgagtcaataaacaaataaattaggtaaactctatgtgtgttagagaagtgctaaagagaaaaatataatggggtagaggaaataagacgtgtgtgtgtgtgtgtgtgtgtgtgtgtgtgtagggggtgatggtacaattttagaggctgaggaacagaacatttgagtgaacacccacaaaaggtgagggccagccaagccaatcccaggaggaagagcattccagggagaaggaaccaccagtgcaaaggcactgaggcgggagtggctgtcatgtctgaagaacagccataaggccagtggggctggggctgagggcgacggaagaggaaatgaggacccacgggaaagatgggaccagaccacggaaggtcgcacggcgcacagctcagggaacccctgactatattctgtaatgttcttgtactcttccagaacccgacgaaagacagcccgcttttccagttagaagcaggcagaattctagtgcctcctctcaggctgaactcatcagccaacacagtaggatggaaagcggactctgtgagactctccagagcgcagctgaccttcccgcacccgccgtctcctcataaccagaagtggcctcagctgcatgtgtctgtatctagggcactcggtaaccaaactccacctacctgggtgattcagagactgagcacattctctgaaaaggtcagaaggatcatcctgaagttccaggtcagtaatgggggtgggtttgcaggctgcaaaggcccaagtgacaccatctctgtcactgtggcacagcagccaagctctgttacttgcacatccccgaggcagtggactctggccctccctggagctccaaggatgggacttctactgggctcagttcaggccaggagggcatttttcagatcccccacccctttttattaagaccccagtgaaatcaccaagtctgcaaaccttccaccttgctctcctcaatcaactgataactctggagtattttttcaagaccaggtacaaatggcaaagtgcaacacaccacacacatctccaactccacttcctccatctggttaagggcttaacagctcaaaaccttgttaattgaaggaggttctaaaccatggtgctgggcctgcattcgctggggctgggaatccaatgtggcttgggaacccaagaatttttccaccacgtttcttctctctgttgcagcatttgaagaaggttttgtaaacaattaattccttggcaggatttccttacccaatgatgaggaatccttgatagagagggacggaggcaaagtaaaacacggaggaaaagacagcctgtgccaaggagagaggaggatgtcaccaaaagtcatgacaaaatcccttacatttacagaataaaaataacacctgatacttacataacacccgcgccggcactgctgtaaggtactttacatggatttgctcatttcattctcacaacatcaacaacaaccctatgaagtaggtacgattctcatcatcctcattatgcaaagcagaaagtgaggcatagagagggtacgtggcttgcccaagcccacacagttcctaagcagcaaatctaggaatcattcccgggtagggtgatgtatcacagctccagggtctactcagcctgttgtgaatatttattaagttccaggacccaggaatgctttgtacatgagcacagctgatctccagagcagcccacaggatcaagccctactatcacccacactttacagaaggggaggctgagcaggtaaacagccctatgggactcaagcccagctgtggccacagctctgtggccacacttctaaacagctcggaatcctcacctctgtaggcatgcacgctgctaaccaaagtgccgtaggtatggaaacacatacagaaaaagagcctctgaagtgtctacgggggctgggatggcagaaaaggcttcacttcttatattacatgtttcggtatttggggaaatttttgaaaagagcatggtgacagattatttttgcaattagacaaaagcaatgaagatatttacaaaccctcgcggaaatgtctgcttcctgctttggaaaatattagctgctggtaatgatgaataggctggggagatccaatcaggcttgaagctctgttagctccatctctggacctctatgggctaacagaggaaacacggtctccaagctgatatccattcatataaagctgaaggaaggccagagacaaatgctgcctgaaagcttttagaaagcagaagaaagcaaggcagagataccctagtcattagaaatagcatcagaccagggctagctccccagagcaccttcaatggacacagagagaaagcatgtaagaaacacgtgctttctcggcacagagctcagagcgcaggtgatcctgagcgccatggccacaggaagccccagttcgccctggctgcgccggaaaagccacttttccagtgacttttcacccaggctgtgccgctgcttaggaaggatggttgtaaaaatgtcaagaatctgttgtttattttccagaccagtatcaggagccccttcctctaaaagggtcatcctaaccacaaagtcttcatctcgacaagagcactttgggaaaaataaaaacactgtgttctctgacagactcatgtcccggtgcaattctaactgggacttgctctcggccattttcagcacagtggacaggggttaaaggcattttctttagcacaaagaacaatgcctcatcctggaattctttttctacatcaatgttaacagtaacatccagtttttgaagaagtcagctcatcccggccagcttttgtgtatgagtccaaggacgggctgattaatctcccaatcattaaagccacagcattatcctgttcaattggtgagttaacataaaagtacagatgtggtctggtgaaccacagcagctgtttgggtttagatcattttgatgaaagtcactttcaggctcccctactcacaattgcaatagatatttaaaacataaaatcacccccaaaaaactggggtgtagccagtggacggaaaattctcatgtacccaaagcagcactacctgatacattgtacaaggcagaccgcctttcaagtatgattaaacattctcacaaattaaaatatcacctgatgtttacatattaccttatttcacttctactaatcacggtaaggatgccttagcactgatgccttaaaaacgtctctgtttttcacagtggccctgtccgagggcaaggagggtctcatcatccccgttttccaggtgggaagaccgaggcctagagtagtaaagttatttgctcaaggtctcacagatccttaatggtatggccagaaggagacgtgagttccaggatctactgtacctacattctcaccactcaactgggagcattttcacctcaatgcccaaaaaggaagattgacaatcaatagctttttaataccaaaaatattttctttccctcctttggcctcctttctactccacacttaattgctacagactgatggcaaattttgttgttgttgtttttgagatggagtctcactctgttgcccaggctggagtgcagtggcgcaatctcagctcactgcaacctccacttcccagattcaagtgattctcgtgccttagcctcccaagtagctgggattataggtgcatgccaccatgtccagctaatttttgtatttttagtagagacaggatttcaccacgttcaccagactggtcttgaactcctggcctgaggcgatctgcccacctcggcctcccaatgtgctgggattacaggcatgagccactgcgcctggcctatgatgacagattttgaagaagtttgtgagagagaaggtgagaaaatatatactctagaatccttttatgaaaaagcaagatgggaacaagatgttaacttccaagggtattcgtgatcataataattaaactcagttcccctactaggctctgctggaagacagaaccgtgatgctgagtcaatctcagtgccaagtgtcatgctgacccctgcaagtggacacggtcccaggccctccatgacgagtgtatcaagaaggtactcagattgtgactgcaggctttgaggtccacctgcctgagctgactgaatccctgcgggacaccacaaatttctcatccatattcagcctcagcctccccatccgtaaaatgggctcaggctattgtgaggcttatgtgagacactgcattgtcaacacttagcctgatgcctaaggtacaggaggcacacaagcaaagtacattcttctttagtggttgttctctgatggcccttacctctgcaaaaggtgaaaaaccagggcctgaatagtcattcagcatttaactctgcgtctttcactccagcaaacaaattataacaacgtacccacaattaaaataactcatgtacactccacttgccccatgccaggcactggatgtcaccactgctaacgcacacatcctcaccacatggcaggaatgaccagcaccgcttaacaggggaggaatcttgagcaccaagaagttcagggactggctcaaggtctatcagctggaatgcagccaggtgggggatttaaactggcgaggtaggggtgacagctccaaagcataatctaattcccaggctttttccatgataattacatagccacatgtacatgtgcagagggagcagctgcccacccacctacatggtatagccacaggcacatgtgcagaggggccagctgtccactcacctgcatggtgctgatacagaggctcctgtgaatcacgaactggctgagggcggctgaccgcttgtagctgttccggccatgcaccataagcaaccggccaagatgcttaaattgagtgatggagaagtctgcagccaacgaagcctgttttccttcctaaaatccaataaaattaggcaccatcagaagcacaagaggtcagggcaaacacattttctttcactgaaaaagcaagacattgtaggaaatctttgaagaacttcaagaaagaaattctttggtttcaagctatatgcagttggtggtccaagtctaaatttgattttaaaaggggaatttatttaaataaaaaccattccgaatcacatatagttataatttggacgtcaagtggatctaatactttgggagttcagcccaccccataagtagcaaagaatcatttaaaaatagatattttaaaacattcagttcccttaagagctaattaaacaagaggcaaaaacccagagctactaacaatattagataggatattcctgaatacacagctctgcacactcacagaagtgggaataacttgcagtgcaaccatataatggaattctctcattttgtattttttaatttttattttttcttgagactgggtcccactctgtcacgcaggctggagtacagtggtgtgatcttggcttacagcaacttctgcctcccaggttcaagccatcctcccacctcagcctcctgagcagctgggagcacagacatgcaccaccacacctgactaatttagttatttttggtagagatggggtttctccatgttgccgagtttggtctcaaactcctgagctcaagccatccgcccacctcagcctcccaaagtgctgggattccaggcatgagcagctgcacctggccgaattctctcattttaaaaggcagtgacagccagcaataaagggacagagggacatgagagcctctggatacgacacaacaggaagaacaccaattccccttgtacagtgctcatgccaaaccagaattggaaccgaatcaatctgatgggttcaagaactgtgtgccgtgagacactacaactgtcctgaatgcttcaaaaatgtcactgacatgaaaaacaaaacacccgctaaccaaaccaaacaaaaagagagaaacgtgttctacaataaagaagatcagaaacatgaggacatgctaataaatgtgatttgcaatccttcctggagcttttattacttaagctgtgaagacactcagaggacagatgggggaatttgagcatgaatattatccagtaccattatatatcaatgttaacacggggttgagcatgaatattatatagtagcattgtatcgatgttacatggggtgggggtgcctgggggggcggggcggggggtggggcgtggttatgatgttactttctttgtgtgggagaatgtccttgttctaaagagatccagctgaaatatttaggggtaacattacatacaatttactttctactgattcaaagaaagaaagataatgtagcaaatagtaacaattggccaaagtgaagggtagatgaatgctcactgttctatttcaacttttccattgttgtatttcaacttttgacatttttcaaaataaaaaggtagagtcagagtaagaagtgatggctctgtatgctctcatgtaggaacaaatccatgatgtagcagatttaagtaagctgcacaacaaaatgtacagtgtgttttcaatttaaaaaaatacatgaaaattacatatatatacatgtgtaagatatttgtatagatagcaaatatatacacactcataaccagtaatatacacacagaaaaaatgttgagagaataaccagtgttactcatttgatgcagttacctaaaagaaaagatgcgttttacttctagattcttttattttatgttatatatatttttgagacagtctcactctgtcacccagagtgcagtggcacaatctccgctcactgcaacctctgcctcccgggttcaagcaattctcctgcctcagcctcccgagtagctagaattacaggcacccactgccatgcctggctaatttttgtatttttagtagagacggggtctcaccatgttggccaggctggtcttgaactcctgacctcaggtaatctgcccacctcggcctcccaatgtgctgggaatacaggtgtgagccactgaacctggcctagattcttttaattttttatagtgagcactattttatatcccaagaaacaaaggaaccagaataccatttttaatagaagggaaaatgctttaattttttaagaactggtagagaatgccattaaactcaaaaacatgcttcttaaaaactgtattcagggaatctatacagacttctgatatatctcattcaaaaatcatttcactctacaactttaaatcatcgtcatcttgctgagaaccagagaaccagaaagggtggtaaagagggggaaaaaaagccctatgggtcagccaaagtcatgaagctatgcaacaggatggacaggggagcatctctgctgccccctccgggccttggcactcctatacttcaaacacacttcttttctttttttttgagatggagttttgctctttcacctaggcaagagtacagtggctcaatctcgattcactgcaacctccacctcctgggttcaagtgattctcctgcctcagcctcctgagtagctgggattacaggcatgtgccaccacatctcactaatttttgtatttttagtagagacggggtttcaccatgtttgccaggctggtctcgaactcctgagctcaagtgatcctcccgcctcagcctcccaaactgctgggattacaggcgtgagccaccgcttccagcccttcacacacagtcctaacaaactcggtgacccatcttcttgcctcttgtcatttagaggtcacaaattagggccgagtaaactgtaagaggcaagcgcacaattggcaaggagaaaaagacagaaaaaatatttcctaacacaccaacttttaaaaattatacctgccaaggccttttggtgagaagtgaactaagccacactcttccatagcgcccaagagatcagcacagagcaggataactaatgcttttactgacaacgctgactgtcccagagaagtctgaagtatacttaccataccctaagaatatagagaaactttttttttttttttttttgagacagagtcttgttctgttgcccaggctggagtgcagtggcgcaatctcggcttactgcaacctctgcctcccgggttcaggcgattctcctatctcagcctcccaagtagctgtgattacaggcacccaccaccatgcccagctaatttttgtattttcagtagagacagggtttctctaagttggccaggctggcctcaaactcctgacctcaagtgatgatccacccacctcagcctcccaaagtgctgggattacaggcgtgagccaccacaccgggcctagaaacactttttctttttttaaattcaggtcgtggcaaacaaaaagccaacattcatctgtctgtaagatgtagcaatacagacctctatcttcccagtgacacaaggtaactgtgacacatgattccttatgttttatcattctttatctggaatttccagaaggcttaaagctgtgtctttgagggaaaaagaaccaagaaactacagcaagtggagccgagcagagggaaacactctcacctttccttccactcccacgccgcagtcagattcctgaatcatgctgacgtcattgcctccgtcccctgcgagccacacagaccagagagaaaagatgtttcattcttaccttaaccaagaatgtatgcttgtctttaccgcactctcgtctttcacggagcgcttgctgagtgcctggcctgccccgtccattccatctctccaaccccttgactaccaagatcctgtttcacaggcagagtggctgagtgtcagagagcccaggcggcttgccaagggtcccggcactgagcagcagcagtgggactgtgtccacataggcatttaccaccacctgtcctcctcggaggccgggataccccaggattaccatcagcagcaacttgtagtgctcttactggacgctttccatgcagcgtggcaagcacattttaaaggtgatcctttttaggctgagcagtggctcacgactataatctcagcactttaggaggctgaggcaggcagatcacctgaggtcaggagttcgagaccagcctggccaacatggagaaaccccgtttctactaaaaatacaaaaattagccacacgtggtggtgcacgcctgcagtcccagcaactcgggaggctgaggcaggagaatcacttgaacccgggagacggaggttgcaatgagctgagattgtgtcattgcactcccgctgggcaacagagtgtgactccgtcttaaaaaaaaaaaaaaaggtgaccccttttagtcttcatgacaccatttaaggaagccacaattattattcccattctaccataagcaaaccgaggctcagatgggtgaaagaagccacctggggcacccactggcaaaggccagtggaaagatttgaacccagatccaaccccacagtgtgtggtctccaccccctggaaggctgcactcttgagccactggcaaaggagtagaggcctggcacgtgcttatctactctccaagggaaatattaaaaataataacaaaaagagccaaagtctgagaggtggagaaaaatcatgacctgaacaaaggggcctggggaatttgaagaaagagcagcagtgtccaaatatccttagggaaagggagcctggtgcaccggcaggccagggccagcagcacagcctgagcctcgcctacctactgcacaggtgagcttgcccgtgcgctcctgaagcaggcgcacgatctgggccttctgggtgggggcacatcggcagcagactacggccgggcactggcaggccagctccatgaactcgtactcatagtacttgaggcaaacctgcagggtggagggagaggtggtgcgttggtggagggagaggtggtgcgttggtggaggtcgctgccgagcctgcagtgcccctgccgaagccgggtaagacccaggctgctgggaggactggctctcaggggtccccaagctcacctccagggagtctcccgagatgaccagggcacaatcatgcttcctgcggaaggcgttcagctcgaggtgagcctccccgcggttggtcacctggaagggaacagagatggggaaggaggcattgctctccggacatgatagaacaacaaacagtggcttccaggagcccacatgaagacaacggccaccccagccaagggtccctcccctcccctgccaccagaggcagcaccaaatggaatcctattggttgactctgcaggaatcaagagagcccatgtgccaaccaccacctacaatttcccccaggactaaaaatgcctgtactggccaagcgcagtggctcatgcctgtaatcccagcactttgggaggctgaggcgggcagatcacttgaagtcaggagtttgagaccagccttgccaacatggtgaaacccactctctactaaaaatagaaaattagctgggcatggtggtgggtgcctgtaattctagctacttgggaggctgaggcaggagaatcacttgaacccaggaggcagaggctgcagtgagccgagatcatgccactgcactggcagtatgggcaacagagcaagactcgtcttttaaaaaaaaaaaaggggggggggggccaggtacggtggctcacacctgtaatctcagcaccttgggaggctgaggtgggcggatcacctgaggtcaggagttcaagaccagcctgacccacatggagaaaccccatctctactaaaaatacaaaattagccgggcttggtggcacatgcctataatcccagctacttgggaaggctgaggcaggagaatcgcttgaacctgggaggtggaggttgcggtgagccgagatcatgccattgcactccagcctgggcaacaagagcaaaactctgtctcaaaaaaaaaaaaaaaaaaagcctgtactttcattttcggccaggtgttggatgatgcattcggtggatttttctcatttatttctcacaacggctctatgaggtgccaaaaagaagaagctctattttgcacctaaggaaactgaagcatggtgacatctgctaacctgactaaaggcacatggctagtatgctgtagcccaggtatgcagagccaggcacctagcagggactgggccacttttctgtaaaggaccagatgttaactattgtaggctttgaggaccacatggtctccatcacaaccactcagctctgccgttgtaatccaaaagcagtcgtacaccatatgcaaacgagccggtctgtctacactccaataaaacaaaatacctgctgtttagaaaaacaggtggctagcacataggtcattagtttgcaatccctgaattctagaacagacagtcaattctcattattcatagtagctatgttttctaaagtcactgtgaacactgaattagcaaatactaaaccatcacctgtaggggaaatacagggttaggtttttgcccctggttgcaatatcttcataaatatataaccttattttatgtgcgtttctacttaaagacacctggattcattaacattgagctcacagccaccagttctgtaactcatgcctgcaggaagctcatctaacacacgcattcgctccataagtcacatcaacagccttcctgttgatgtgacttatggatgttgggaagttcaagttccagaaaacaagccagcaaagaagcgctgtgtgcggccattttaaacgacaaactgccaacaaaaagcataaaaatgcaaaaaaccggatactcgatggactgcaaaaacgacactggttcgtcacacggggctgaaaggaggggggagtgcgtgagcttgttcagcctcaggtgggaatgtgtgtctcaggcagctaaaattttaagccactctaggccaggcgcggtggctcacgcctgtaatcccagcactttgggaggctgaagtgggagaatcacctgaggtcaggggttcgagaccagcctggccaaaatggtgaaacccgtctctactaaaaacacaaaaattagccaggtgtggtggcaggcgcctgtaatcccagctacttgggaggctgaggcagaagaattgcttgaacccaggaggcggaggttgcagtgagccaagattgcaccactgcaccccagcctgggtgataagagcaaggccccatctcaaaaaaaaaaaaaaaaggagagatttaagccactctacgtatgacagtgaaaatatcaagagtactgatttggaggtcacagataaattttgggaggaggagaattcacaaagaatctgtgaatgatgagaactgactgtacctgcctctatacaatactatgctatttcaaaaatccctggattttttgaagcttctgtgtgctatggaccaaaggcggggtgagggcgagacccccaaacatctagagaccctccagtggtttgccatcgtggctctggtttcagatcagtgggattactatatcctgccccaaagaggacccggtccccctacctccccaatgcaataaagcctagcacagtcctcactggcagcagttcctgatgtgcacattgtcttggtcaatgtctgccacaagggcgggcgatttctcatttgcccatccagttcacctccttcaaaaggctcctcaatggtcctaaatgcttcccctctcaggagggcagatggaccagtatctgtggcctggaatttctttcttatccaaggacttgactttcaggggttccgtgaaatcccaggaatcccatgcataatttcatgtgtatgagtggatctgcatctttcggggggagtgcctgactttcatcagcttctcaaagggaccacgacccccaaaaggttaagagcatggcattagcacagggctagaaggaggtactcccaaaccactactggaagaaactctccagccggcgcctgggtcattaatcatcccatccaaagcaaccgtggttgatgctccccaccctaggtaattcacatgctgcccctcccttcttaaggggcccactcaaggttaggaggttataggacaaatcgaacatcatccccacatggccctaacgcagaggacactttaccagccgaaaaacgtggatgtcttggtttctggtcaccagatgtgcattcttcgctgtgcacgtagctgtctccagcttgtcccctgtcagcatccaaacctgaaatcatggcgtgacagaggtcctgtttattagtttttgaggccggcctgtcatctgcaacagctgagtttccaacaacatggagctgaacttggtatgttccgtttacctcctgccgactcatgctgtccccaacacaacacagcaagcgccctggctgaagggctctgggactccaagcaaccactgctggtagcagcaaaaactggcagatgcttctagaaagggccatttggccacacactacaggaggtactatgaagctcggtccttggaccgcataattccccttctgaggatttttcttaaagtgataaatatcctaaaagaagggaaaggctgtacaggtgagggggcacttccctgtcctacaggaaacactcatttttgacgctgtggactttctatgtagttggatgagcaagacagacccttctggggtttaactcagcttataaaacgctgaccgtaaatgagtcaggttcttccgtatcgtgcattagctcacactgcatttctctgctgtgggctcagagagggtagatgacttgccccaaaccacacagctacctcttgtcctaaccaggcccagaatccgggtctttagagtcctcatggaatgtgcttcctgctctgtgattttacctcattaacccttttgttctctttgctcccagctgggagcagtcttggggctatcggtcaaagaaaatctggataggagggaaagtataggaaagaagatcatgacaattgtctcctgagtgtccactacgtgcccagcacccacgctgagctctctgttaccttcatgacagcttctggaggctggaaatggaagcgctaagagcttcagtcatttgccaagggtcacagaagaagtaaagggagaggtaggatggaaacccaggcagtgagacgggcagaaggaaggcaccgggcacctctcagggctgagcctcccgggccctctcccctagctgggtctgttttccctcaatatcccgcctgtcctaaaaataatattctttttggtgagcttcgtttagtcatagttctcagggtttgaggtaagagaacaaacactggggaaggaattgggaagttcaagttccagaaaagcatgaaaagaacgatcaggtgcacgacatggctaatgtcccatgctgtgatgaaggcaaggtactacaggaagggtccaagaccccagctccagtcccggctctgctgcttcccaatgtgagaacctggggaatggagacgcctcacttagcctcagtttctacatccatacaaggggctgatttagaaaatatcctgtgcagccaggcgcggtggcttacgcctataatcccaacactttgggaggccgaggcaggtggaccacttgaggtcaggagttcgagaccagcctgaccaacatggagaaaacccatctctactaaatatctaaatatacaaaattatccaggtatggtggcacatacctataatcccagctacttgggaggctgaggcaggagaatctcttgaacccaggaagtggaggttgcagtgaaccgagatcgcaccactgcactccagcctgggcgacagagtgaaactctgtctcaaaaaaaaaaaaaaaaagaaagaaagaaagaaaagaaaagaaaatttcctgtgcaagatcgtatcttagactttaattaccaactaacctgccccatcccaggcactcccctcctcctgtcatctaacaggaaactagaatggtaagtcacatgcacactctgtgaataaaatatctcgtcttgggctaacatagttttgagaaggagaaaaaccccaggacaaagatggaagcagaaaatggaaactccagaagtcttaggaatggccagggccccactgcagaccccacgatgaagcagaaatgggcctccagcggccagacttccggaagcaaggtcccgttggtgatttccttatgacgaaccaggcctgtgagccaaatgcaagcgacagaattgggtttacaaggaaacaggcacgcaggggtgggagtccccagtgggcctgaatgttgcctggcatctaacctgtcctcctgccatggccctgctgaaaggacaggccccaggatgcagcagagagccacttttgagtggaggccggtggcaggcacacgtttccaggagctccaggccaatgagtttggttgttcacacctcccttggtccactgaggaccaggtcctcacgcgccctctgctggcccctccagattcaactcctagtatttttttttgggtcgccactggtagagtgcaaaatgctaatacgacagtgtgatggcgctgacggtcactctgctgggtggtcactcactcacttggccacacggcagacagaccggcgtgctgatcactcaactagaatttaatcagcagccatgcacgctggacactgctcggccttgagcaccagggagcccagtggagtcaggggagtcatcggtacagtaaaggcaaacgctacacaagatgtcttccaaaatcagggctggagggccaggcacagtggctcacacctgtaatcctagcacttcggagactgagacagacagatcacctgaggtcaggagttcaaaaccagcctggccaacatggtgaaaccctctatctacaaaaatataaaaattagccaggcgtggtggtacgtgcctgtaatcccagctactagggaggatgaggcacaagaattgcttgaatccaggaagcagaggttgcagttaaccaagatcatgccactgcactccagcctgggcgacacagcgagaccccgtctcaaaaaaaaaaaaaaaaaaaaaatcacagttggaggggcagaaacagtgcctgtggcccattgcagataaggcactcctggtgtcctctgctgctcctcccaccctttccccctgtgatctccctgcactgctgagggataactggcattgccctggagtgcccttccctgcgggcagcccgccctaccttgatgccagcattcctcagggtctccagcgtgggccgcacatctgcctgcagctggtcctccacgcccgtcaggcacagcagttccatctccatctccaggctctcgatcaccgtggccactttgagggagcggtcgtgcacactcagcttggcctggacgtagcgggcctgggacacaccagcagatgcagtcactgcttagggtgaggagaggccaggctgactggccagtgccaagagtggaagggccacacccgatccccaccacacggggtgggggaccccagcaggtgagctggaccccacaggggtgacataggcttccagcttcctcacaagtcctccatgtagacactgcacagacctgagtcccaccctacactccacactcacctgctgggagacttccagcaagtcacttaacctctctgagccgtggccacgaaatggcaataacagcaccaacctcattgggttgtctcagggacgggcacaaccaagatctcaaaaaaacagtaagttctcccatacacaacatgcactttgtaagccaaactgtgggtcaccaggttttctaaagaccaagtcgagcttctgaagaccatcaacccaaactgccgcttcttctctttatcatgttagcaaaaacctggaggaaaaccagtcatctaatgggcccgcttgaagcacatgcttttaaaattaaaaggcaggtagcattgatcggggctaaaatgcttgttaaataatggcttacaaagaactcaaatatattaaagagagatccaggcagtttccccgcatggagcagggcagggccccacgaagcgtgtcccgcctccctcccttgcattcctgcacgctggatttaggccaggcaccagagacacggcagtaaacaagacgaggaccctcccctcagggaacacacaatctatgggatgggatgacaataagcaagtcaataatctggttcaaccccaacatttttacagcttaaagaaattagggaggccgggtgtggtggttcatgcctgtaatcccagcactctagaagaccgaggcaggcagatcacctgaggtcaggagtttgagaccagcctggccaacatggcaaaaccgtgtctctactaaaaatacaaaaattagccaggcatggtggcacatgcctgtaatcccagctacttgggggcttgagggaggagaatcgcttgaatccaggaggcagaggttgcagtgagcagagatcgtgccattggcactacagtctgggcaacaagagtaaagctctgtcacaaataaaaaaaaaaaaaagaaaagaaattagggagccgaaccagatgcggtggctcacacttgtaatcccagctacaaggaggttgaggcaggaggatggcttgaggccaggagtttgagaccagcctgggcagcatagcgagaccccgtctcagaataaatgtgcaaaaaaaaaaagagaaaagaaattagggctccaagagaatgatttatgccaaattttcccgaaggcataccatatgccaaggactatctttaactactaaggatataagaataaaccaggccaggcacagtggctcacacctgtaatccctgcactttgggaggccaaggctggtggatcacctgaggtcaggagttcgagaccagcctggccaatatggtgaaaccccatctctattaaaaatacaaaaattagccgggcatggtgacgggcaactgtaatcccagctactccagaggccgaggcagaaggatcccttgaacctgggaggcggaggttacagtgagccaagatcacaccactgcactccagcctgggcgacaagagcgaaactctgtctcaaaaaaaaaaaaaaaagaagaagaagaacaagaataagaagaacaaaccagacttgtaaagtccctgtcttcaaaaatattttattcccgaaaggagatggataagatgaatgttaaaaaaaaatatatgaacagggtcaagtttatattcttctggcctctccagattcaactcctagacatattttttggccccaaatggtagcacgcgatgacagtgacaaatgcaatgaacaaagtgaaatggtatgatggatggaaagtgagaaggagccttagacaggtggtccaggaagacttcttggaggacgtggcttttgagctgagacccaaaagaagcgaggaaatgggccatggggctctgtgggtgaagagagttccaggcagacagaacggcaagtgcaaaggccttcaacaacagtgaacccagtgtgcccagaaatgacatcagaatggctcgcataggatgagggatggtggaaggagtgactgggaggcaggtggggctgcaaaggcaatggaaaggtcccagaacaacttacttcaaagtcctgatactgctcctctgcaagagacttctttgccaccacgagcacccgcagcccttctcgggccatgttgccacactgaaaaatagaccacggtcgagtgggagcggtgctgagagctcctgacctcactggggaaggaccagtgcccaagtggatgtgcccctcccacagggtcagagaaaatggcaaatcagaaagttgctttcccctacggcaatcctccctggagcaagctttctataggggaagttgcagagaggcagccggtgagccaaacacagcccacccacaggtcgtcttcaactagcacatgtatgtttccaaatttaagtcaacattgtgcggtctcacacacaaatctggactgctgaatgggtggaaaaactgagcatctgacaaaaccaggtgcattttcccaaataaccacaatcaatgatggctgaggagcagtggcctccacgtgttcccaggaagtggaggtgtcaagtgaagaacactccagcacgttttacacgcaaagtgcaactctgctcaaaatcacaacctgtttgttcatttgcattaactgccaggcccctgtaggcatttgagtttgcaaccctcaaactgagaatcttatgcaaaatgtaaattccccctagagctaagagatgggacaaaaatggcctgaaaactgcctccctcctgctgctggccaactgtccacgtcacaaactgggttgtgcagcctctgatgtggcccctcctggaactcacattctggtataatcgcctaccctttgagtgtgtgctggacctagtgacttgtccctaacaaacagaatgggcaagagtgaggggatgtcacatctgagatcaggttagtaaagacagtgacttccatcttgtttgccctctcctgttccatcacctgctctctttgttgaagctagttgccaggctgtgagtggccctatgggagaggcccacctgcaaggaatagagggcggcctctggccaacagttggcaacaacctgagacccttagttcaacagtccaaaagtagctgaatgtagcccacaacaactgagcttgctcacaaatggatcctgccctggtcaagtcttgagatgagaccacagccccagccaacatctgaattacggccagtgggaggccctgaagcagaggatgcagttcagccacaccagcatccctgacccacagaaaccattatatattaaatgggtgctgctttaagcagctgcatttcagggtggtttgttacacagccaccgataacaaatacagagacccaccttaccatgcaaggggctgcctctgcagaacatgcttccaaggcctggtttaacttcctgcatcacacttacctcttcctccaaccagtcattgtactgcacaatgccagccatgaccacatctgctcccttcatgtaaaacgtaatttctccagttgattcatcctagagagggaggccggaaggaatgagaaactgaaaggaacaccctctttcagcggcaaagcccgcttcccatgacagacagtgtacaaagtgcacttaacagacaccaatgttttttcagttggctgaagatgaaaagcgagaaggggcctcatttaggggcaaaggctacagaaagtaaaaggaaaactcaaagcacttggaagattttcaatgatgaaagaaagatcaaatggatttaagacctttgttttgaaagttattactatttcaactggaatagactcacatgctatgattttagatttacacttgggactgcagatatcatcaaactgtggtccactgaaagaatagggaagataaggactagaacagggagtctcaacctcgtcactgtgaacatttggggccagataactctttgctctgcagggcccctcctgtgcactgtacaatgttgagcagcatccctggcccctacgcactagatgccagtcatacaccctccatggtgacaaccagaatgtctctagactttagcaaatgtctcctgggggcaaactgactgtctcagctgagaataattccagatccctaagtctaactaaggacttgcctagagatccaattacccagagtttcagttcaccctaaccagattttctgggtagtgggtagcaccatggcacaggcatcaaatgcttggaccaagtaccagtttctagttgtgtgcagctggacaagctactcctcttccctaaacctcagttttctcatctgtaaaacaggaatcaagcatgtagcacagagactgacacatggaaaggacccctcagtggtataactgctgctgggatgagagtgatttcccaagtcccccagccatactgtacgtagagaacaaggctcagcccagtactctcaacagggcaatgtggccctccaggagacatgtggcaatgtctggagacactctaggtgtcacaacgcaggcaatgtcctactagcatctgacgggtggaggccaggggtgctgctcaccctcctacatcacacaggacgcccccaaccaccaccaggaactcctccagccctaaaagtcaacagtgctgagactgagaagtcctagctctgaggaatgacggcgcagccacagatccttcccccattttcccccaatgattcgcgtcactgggaggtgggaggcagtaaagataagcaagaaaactgagcatggccatcaataccttgtgcctaaattttgctactccaggaagcccagaataaatgcccggaaagtcttcattgaatatggaaccgtggagacaaaagtgactgcatctcaagctgggtgtggtggctcacgcctgtagtcccaacactttgggaggctcaggtaggtagatcacctgaggtcaggagttcgagaccagcctagccaacatggtgagaccctgtctctactaaaattacaaaattagctgggcgtggtggtgcatgcctgtaatcccagctactcaggaggcaaggctggagaatcacttaaacctgggaggcggaggttgcaatgagctgagattgcaccattgctctccaacctgggcaacaagagcgaaactccatcttaaaaaaaaagtgactgcatctcaggtgcaaatgcgccatgctgacttctgattagcccagtcccatgaacacccccgattcctacttaattcaccgtccttcacataagaacatgtcaaccttgatgttatcgcacaaattacaggtgatgaaacatacagctttcttgcctctcctggaaggtgcccgtaattgtcctgctggggcacgcggaccctttccctgtggtataagccctgggtctagggagtaacagtatggacatccacctgttttcctgccgcccaaaactacacttctgtctgttcggctcccccaaaaaccacgcttctatctgtaagtttcccccaataaaacaccctttaacgacaaactggatttgcctgccttgttctttggtttcaggctcctttggaggccactttgtctatgcagccctttcatggaacagaaatatccaaaatcagattagtggtagagtttcctcttttagaataactttcaaatgccccttaatcaccaacaatcttttagaacaacatgctgactcataagagcacccccaggccaagacaggcacccacgtttaaaagcgttcaactgcacactttatctctgatagactgtggctatgcctgctcttgacgcaggccaaagagagctgtggggtctgcacattaaagaatcagaggttttattttttccttccccccgacaaccaaagggtgctcaacaacatgtggctgtaggaaatgatgctcccagcccagcttcctcactaagaaaagggcttgagtgagttcagaagttctgtccaatataaataccgcatcaacgatcccctcccatgagtcacttcctcccacggagttcatcacaagtttatttcgttcccatattatggcaagattacgccataaatttacagagatcggccggctgtgtggcattgtttgggggcctcatcttttcccaccgtggtctgcatctggcacctgctcaaaggcctcttttagtccagcaatgacagcgctacgatgatctacagccacgatccaaacccgtggctccacgtgggaagggggagaaggcactggaacatcttgtacgccacaaaaacaaaacagggacacaaccttcctgcaaaaagacatcacacgagtccttctccaaccttgcctgatttcttaagagacagacattcacacaaggaaatggccttgctttgtgggtgcaagaaggtgccatcttgcactgtgcgtgcactcacacatgtttaaaaaagagacaggggagacccaaactggggctgtccacagtcactaaaccaagtcaagagaatttttcttttttttcttattcttttttctttttctttatttttttgagacagggtcttgctgtgttgcccaggctagagcgcaatggcacaatcacgactcactacagcctcgacctcctggactcgagtgacctcaacctggacctcctgacctcaaccttcccagtagctgggactacaggtgtgcaccaccatgcccagctaatttttttgcttttagtagaggtggagtctggcaatgatgcccaggctggactgaaactcgttggctcaagtgatcctcctgccttggcctcccaaagtattacaggcaggagccaccgtaccaagcctaggagaagttttataactgaactaaaacttcctcacatcagataactggacagtcatttgcatagagcatttgggttatatgaacacatcataacagggtttctcaggcccttcctcaggtgggggctgtcctgtgcattgcaggatgctgagcggcatccctgctctccacctatgacatgccagtagcactctcagcctctggttgtgacaaccacaaatgttgccagacattctcgaatgcccccaggatgagaaccatcacattagaggagtgtggtgaggtttgtgccaaggggagaactagtccaaaagccccagaggcccagttccaccaacccaaccaaagataaagaggtcagaaaatgagaaaaaaatagcaaaataatacttatttcattaaagacaacctcaccaagatggacattcacagcactatttttagtagtcaaaaccaagaaaaaagcgaggcgcagtggctcacacctgtaattccagcactttggggggccgaggctggtggatcacctgaggtcaggagttcgagaccagcctgcccaacatggtgaaaccccgtctctactaaaaaatgcaaaaatgagccaggcgtggtggcaggtgcctgtaatcccagctactcaggaggctgaggcaggagaatcacttgaacccaggaggcggaggttgcagtgagctgagattgcaccactgcactccagcctggatgacagagtgagactccatctcaaaaaacaaaaacaaaacaaaacaaaaaaactgaaattgagaaacagcctaagcagccaaaaaataagttaatgaatgaaatagtggcacattctttcaacagaacgctgcacatgcgttaaaaatcattaaaatcagattttaataatacgaaaaaattctcatcgtatacatatagttcaatgagggaggaagtttaggaagccttctatggagttcagtgataattttacaaaaatgtgtgtggatatttacactcggatatgcttagaaaagagactgaaaggaaatcccttgaaaaggtaaaaggtcttttgttgggtgaaaatggagatgaactggtcaggcacggtggctcacgcctgtaatcccagtacttagggaggttgaagcgggaggacagcttgaggccagaagtttgagaccagcctgtgcaacacagagagactttggctctacaaaaaatttaaaacttagctgggtgtggcagtgcatacctgtagtcccagctacttaagaggcagaggcaggaggatcccttgagtccagcaggtcaaggctgcaatgagccatgttcataccactgcactccagcctaggtaacagagtgagactctgtcttgagaaagaaagaaaagaagagaaaagaaaaaaagggagggaggcaaaaaaaagaaagaaagaaaggacagaagaagggaaagagggagagggagagagacagaaagagggaaggaagggagggagaaaggaaggaaggaaggaaaagagggagggagggaggaagaaagggagggagggagagagagagggagggcagttttgatccccctctttacctgtaactttttgttctaaatgccttaactgtgaatgttttttaataacctgggaaggggggcatgccaggttaaaacaaaaatagatctgcccatctgacagcatcacagactctaagcacagagtccctgttcttcctgctggaagacacacgagccacatctcaaaaaaatataacatgtccttcacaactagctgaagagtggcgtatgccattcacttcttctaggatggctgacattagggactgctcaatgataagtcaaccctcaaatgaccctagcagagcccacagccctacgtcttgaacaacttcagactggaacaaaattaaagtaattcgataggagataatgacactcattccccaggaaacaccccacccacaggatctatgctgctgcttccagaccacagatgttcttgacatcagatgcacactcaagatacggtttagaagccagggatccagccaggtgtggaccagtgggaaaagcagcagctgtgtgggagagaaagctccctctccacccaagagttgccaaggacacaggtcctgcagagtctgaaagaacctattggcctctggacataaaaatcccctaacatagggccgagcgtggcggctcacttctgtatcccagcactttgggaggccgaggtgggtggatcacctgaggtcgggagttcgagaccagcctggccaacatggagaaaccccatctctactaaaaatacgaaattagccgggcatggtagcacatgcctgtaatcccagctactcgggaggctggggtaggagaatcgcttggaccccggaggcgaaggttgcagtgagctgagatcacgccattgcactccagtctgggaaacaaaaacaaaactccatctcaaaaaaaaaaaaaatcccctaacgtgtgatgtttcaaagcatattcatggtgtgcgtctctggttcctcaatacaagtgctcagtgccacctccatctcctcctgggcaggaagtcttcaaagtggctcgcaatgccccccacctcctggtactcatgctgtgtgtcagccacccccctggagtggagctgggcctagtgacttgcttctgataacagcatgaggctgacgtgaggggaggtcacctctgacagtgggtgacagaagactgtgactgccatctcattcactctcacctgctcactctgaacaggtagctgacaggggagctgactacagggaggccctcgtgggaaggcactgagggtggcctctggccaacagccaggaaagaactaaggccctcagtccaacaacccacccagagccaaactctgccaacaacactgacgtctgtatgtgggtcctaccaccatagaatcttagaccccttgagcccaggctgtgagagaccctgagccagaggacccagccaagcctgccacagaaattgtcctggccacaaaaaccatcagatagcaaatagaaaacagagcccccagttaggtgtggtggctcatgcctgtaatcccagcactttgggaggtcgagatgggaggatcatttgagcccaggagtttgagatcagcctgggcaatatggtgagaccctatcttcactaaacgataagaattagcagagcatggtggtgtgcacctgtagtcccagctacttgggaggctgaggcaggaaggttgcttgagcctgggaggtcgaggctgcagtgagccatgattatgccaccgcactccaccctaggcaacagagcaagatggacggaaggaaggaaggaaggaaaaagagaagagaaaagaaaagagaaaaggaaggaaacagaggaggggaggaggaaggaaggaaggaaggaagggagggagggagggagggaaaaaggaaggaaggaggaagggagggagggagggaggaggggaggggaggggagaggacaggaggaacttccttactccagggaaatacattttctggagtaagggaatgcatttccctgtaagaaagacaccaatggatgtctaagaccatgaataatactgaccccatatacactatgttttttcctacacatacatacctatgataaagtttaatttatgaattaggcacagtaagaaattaacaacaataacttataacaaaatagaacacataatatgctgtaataaaagtaaataagacttgcttgaacgcaagcacggcaataccacaacagccaatctgagggttcctgagtgactagcaagcaggcaggtagatggcgtgagtacactagacagatgattcatgtccgggaggatggagtgggatggcatgaaattcgtcacactactcacaatggcacacaacttaaaacttatgaattgcttatttccggaattttccatttcatatttttagactgcagttgaccatgggtaactgaacctgcagataagtggggattaccatattgctgttttaagccactaaatgtggggcaatctgttatgaagcaatacgtagttaatatcccaccctaacattactgtgggtcttttgtgagcttttcgatgtccctctcgtcacaccccagccctaacccccaagtcctggcgtagagagctgggagctggaagccaggcagcctggagtgagttccagccccactaattccagctgtgtgaacttggacaggtttcccagctcccctcaattccagctgtgtgaacttgaacggtttctgagcctccttccacttcaattttctcccctgccaaacatcagtcctaatggtacctacctcacatggttatgtattaaatgagttacttcatgcaaatcacttagaacagcctctggcacacaataagcccctgggcggggtaatcccaacactttgggaggccaaggtgggcggattgcttgatgtcaggagttccagacaagcctcgccaacatggcaaaaccccgtctctactaataatacaaaaaattagccgggcatggtggcgcacgcctgtaatcccagctactcgggaggccgaggcaagagaattgcttgaacttgggaggtggaggttgcagtgagctgagatggcaccgctgtactccagcctgagtgacagagtgaaactgtgtctcaaaaaataaataaatgttacttgtcattcctgtcattcttcttactactgctgctgctagtggctattaccatttctactactatcccagagctgcccatggcactaaagctacacggtaaatgatcaaggagaagagtggtgcaaagataggagggcgagaaaaagctgtgagttgtttattttaagtatcttatttgataacttccctaacattaaaaaaaaaaaaaaaaaaaaaaagacaactggctatcactgttgaatcctgctcacttcggcactgactgtgagtctaccgtgtgccaggcaggaaagctaggcacaggagacacgggaggaccaaaaggatcctggcccctgttctaacccacagggagaagacaggtggtgacaagcaaacccgcaggaaatcaagaatttcagtgtgatgaatgctacggaagaagaacgagatgctgtaagaggtggtctgaattcaaggaacctgtaaggctgaaggagaagttcacaagccaagccttagctgaaaattctccgccagcaggcagggggcagggccatgtgcccaacaacctatgttatcaatttctacttctacttgtgcactctgtttttttttttttatttccaaaggtttttggggaacacatggtgtttggttatatgagtaagttttttaacagtgatttatgagattttcgtgcacccatcacctgagcagtatacactgaacccaacttgtagtcttttatccctcaccgtcctcccaccctttcagccccctgactcgccaaagtccattgtattattcttaagcctttgcttcctcatagcttagctccctcttatgagtgagaacatacgacatttggctttccattcctgagttatttcacttagataatagtccccaatcccatccagtttgcagcgaatgccattaattcattcctttccatggctaagtagcatttcatcattttatatatatatatatatatatatatatatatatatatatatatatatatatatctcatagttcctttatccacttgttgactgatgagtatttgggctggttccatatctttgcaattgcaaattgtgctgctataaaaatgcatgtgcaagtatctctttcctccatgaggcatgaaacacttgggtagatcagggtggagaggattctcatttgtcaaggaaaaaaaaaaaaaaaagtccagaaaagatgaaagagccttattccaaagatccttaagatctgaaggagagttttctgcaacgaagctaaatgatgtgaggaaccaccccactccaacataggtgtgggactgaaccaaggaatcggtattttcaaagctccctgggaaaaatcagacaatcatgcagactgcagaacaaccagaccaagtggcatatgaacaccagattttccagcctccccacgacggaaagtgtgatctccgtgggtaaaaagagaaaacagagggatgggcacagtggctcacacccgtaattccagcactttgggagtcccaggcaggagaatcggttgaggccaggagtttgagaccagcctgggcagcacagtgaaaccctgtatctataaaaaattaaaaaatgagtcagccctggttttgcaagcctgtagtcctagctactcgggaggctgaggtgggaggactcttataaatacattcttttaataagaatttaaaaattaaaaatttttaaaagagccagtagaaaaacaacatatcaaatccaatcagactcttcagactggcaaaattttttaacgtgcccggccacaaggtttcttttttcatcattttgatgaaaatgttttgaaacatgagggaagtggtggctgagcaacactgtgaatggactaaatgccactgaagttttcactttaaaatgattatattatgtgaatttcacctcaataaaaaaatacatgttcaatattaaacaaaagagaatgagagatgtattaccaagaaatccccaatggacgttctctttaactttcactccagaaccagggacaccataagcggatcagagttacggggtgtgtccaatgaatgaactaatttcctttctgcttagggaattatattcccttgttagtctgggtgacagataccacagtaaagagggttagaaagaatgtcaacccacagggacacacgcagcacacctggggtacttaagcactttaagccatgaataaaaacgactcacccgcacgatgatgcccatacgtttgctttcataggtgaaagggaagatctgtaggatggtgaagttcaggatctggtcgccaggggtcctcagctgcatggaagactggtctcggcccaccagggttaagcccacactttccgtccactgtaccagggccacctaaacataacacagggtcgaaggtcagatgcccagccgagaatctgggttcacaggctgtgctatgaacacaaaggcagaagggggctcagagacaggggaatcacagtagtcactgcccttagggacgccaagtgctctgtgctggcccatgacagtgtctgttcctctgggtctatgagggctcccacactgaaagctgcccctctataaggcacaattcatcttttctaggctcaaaacaggctgcacaccagaggcatggcggaaagagatggcacagaattaagagtgattgtgactgggtgcagtggctcaggcctgtaatcccagcactttgggaggccgaggtgggtggatcacctgaggtcaggagttcgagaccagcctggccaatatggtgaaaccccgtctttactaaaaatacaaaaattacccaggcatggtggcggacacctgtaatcccagctacccaggaggctgaggcaggagaatcgcttgaacccaggaggcagagatgcagtgagctgagatcacgccattgcactccagcctgggtgacatagcgagactctgtccccgtccccaccccacaccacccccactccgaaaaaaggagcaattggcacaattacggatcactcctggaagtatctgcaacaagctaaacaataaaaaaaagaaggaagagaatgctgactgacacagcccttcgccttcaggctctcctttcagcctcacacactgcactgggggagtgtcttcagtggttctcaactgggtgattctgtcccccaggggacccgcgccaacatctgggggaatctgtacttgtcacaactggaaggaggtaatgctggtatccagtgggcagaggccagggatgctacaaaacgtcccgtaacacacaggacataccacaccagagactgatctggccccaaatgtcaatagtgctgaggtggagaacacgggtccacacagaagaggaaaccaaggctcagagcagttaatgaagttgcccaaggtgacagcgctggcatgtggcaaagctaggccagactggcacctggatccgcctggtgtaaagttccacagcacacactcttcccttccaagagtcatcgcacgggtgtcaagtcagaaccttctcatggcctcagccagacatactcagcttaaggtcaaaggcatgagggttgcaaactccaagacaggggccagagtgttgatacaaatagcaaagagggctgagtgggggctgtggcaagcaggagcccagccccagccaaaggaggctgctgccactatacacacaggtggcagttactgccctgcagggactagggccagggtggatggagcttccagtttctcaagaaaaaacagaaatttagacttctccccgagacggcctaacttttaaatgtaagcaattggccagctgctgtgactcacacttttaatcccagcacttggggaggttgacgcaggaggatcacttgagcccaggagtttgagacaagcctaggtaacacaaggagaccccatttctaaaaaaaaattttttaattattagggtggtggctcatgtctgtaatcccagaactttgggaggctgaggcaggcagatcacctgaggtcaggagttcgagactagcctggtcaacatggtgaaatccagtctctactaaaaatacaaaaattagccggaggtggtggcatgcgcctgtaatcccagctactcaggaggctgagggaggcgaatctcttaaacctggaaggtagaagttgcagtgagtagagatcgcaccaccccactccagcctggacaacagagcgagactgtatctcaaaaaaaaaattattattagggtggggtggtgcatgtgtgtcgtctcagttactcaagaggttgaggtgggaggatcacgatctgggaggtggaggctacagtgagccataatggtgccacactactcccacctggacacagagtaagaccctgtctcaaaaacataataatagagccgggcgcggtggctcacacctgtaatctcagcactttgggaggctgaggtgagtggatcacctgaggtcaggagttcgagaccagcctggccaacatagtgaaaccccatctctactaaaaaaataaaaataaaaaaaataaaaaataagctgggcgtggtggcaggcgcctgtaatcccagctaccagggaggctgaggcaggagaatcacttgaacccaggaggcagaggttgcagtgagccgaggtcgcgccattgcactccagtttgggcaacaagagcgaaactccatctcaaaaaaaaaaaaaaaaagataaaaaacacttccagtggaggtgatgcctcccaagtacccctctccctatcacctacctgcagcccctgtcaacaccctcctaaaacctgcctcccctactccccctaaagattaagctttatgagaggaaagtgggagggccttccttttcttctttcttgattttttgtagacactgtacctttggacttggatgggaataaagtgacagcttgtttggcattgaagttggaagccctcctgtattcctttcctgttgttgctgtaccaaattactgtgcatctgtttttttttgtttgttttgttttgttttgttttcgtgatggagtctcactctgtcacctaggctggagtgcagtggtgcgatctcggctcattgcaacctccacctcccgggttcaagcaattctcctgcatcagcctcccaagtagctgggattacaggcacctgccatcacatctgcctaatttttgtaattttaatagagatgggatttcaccatgttggccaaattggtctcaaactcctgatctcaagtgatccacctgcttcaacctccctcccaaagtgctgggattacagccatgggccaccgcaccggccagcatctgttttaaaatgaaacaaatagattttcttacagttctatagatcaggggtggacatgggatgagggtctcactgagacaggatcaaggtcgcttgatcaccattgctgcattgctgcggaggctctaggggagcacctgtagtcccagctactggagaggctgagatgggaagattgattcagcctgggaggcagaggctacagtaagctgaaaccatgccactgcactctagcctgggtgactgagtgagactctgtctccaaaaaaaaaaaaaaaaaaaaaaaaaaaaaaaaaaaaaacctggcgttcctcttgagttcccattccttttaccaagagagctctgcagaagccacaaggcaaaggtatgcagctctccacccctagtcctttctttctctggaacccctggatgtcatcttagctgacctgctataccccgaagaagagatcaagctggagctcaaaactggggttccagtccccgctctgtccccagcccccagcccccacaggcctctgcaaaataaagatcttggagtagatgactatttctcatttctgctccagctctgaaaatgtatctttatgcatccttagtctactatgctcagatatcgagttcagtttctgttgcttctattaactaaatttacattagcaagaaattatttttcaagactctcccttatttaagttcaagtcataatgagtcagccagcactaacgagctttgagctttgaccaatggaagaaactgtcatactgacctctacctttcaaagaaaggaccaatcaagtagtgggtttttctgtttttattttgtgtttttttagttttagtttttggctactggcctgcctaagtctttgaaaactcattcacttagttatttgtttaatttaatggctatgctatagactatgtttatgtcccctaaaattcatatgttgaaacctaatccccaatatgatagcagttggagatggggcctctgggaggtgattaagtcctgggggtggggttcctcatgagtggatgtgtgcctttatgaaagaaaccccagagaggtccctcgctccttctgctgcgagagacagagtgaaaagagggccttttatcagccaggaaacaggccctcaccagacaccaaatctgccagtatgctgacacaggacttcccagcctccagaactaggagaaataacttctgttgtttacaagatacccagttgatggtattttgttatagcaggccatgttatagcaggccaaacagactaagacactctaactttcaatatagccctgttttgtctgctaacaattgtcttccaaagtttaaaattaacaaatcagtaatgattcgcatatataaaatcataccagccaggtgcagtagctcatgtctgtaatcccagcactttgggaggccgaggcaggaggatcacctgaggtcaggagttcaagaccagtcaggtcaacatagcgaaaccccatctctacaaaaatacaaaaactagccaggcatgatggcgggtgcctgtaatcccagctactcgggagtctaaggcaggagaatcgcgtgaaccccagaggcagaggttgcagtgagctgggatggcgccattgcacttcagcctgagcaacagaacaagactctgcctcaaaaataaataaataaataaaaacaagaaaaaaaattatcccatctgtctatgtaaaaaagcttgggtgcagtgtagaaatgtttatagagtgatacacatggagagaattacttctagcttttacttctagctttttttttttttttttttttttgagacggagtctcactcttttgcccaggttggagtgcagtggcgcgatctcggctcactgcaaactccacctcctgggttcatgccattctcctgcctcagcctcccaagtagctggtgcccgccaccacacccggctaattttttttttttttgtatttttagtagagatgggtttcaccatgttagtcaggatggtctcgatctcctgacctcatgatctgcccacctcggcctcccaaagtgctggaattacaggcatgggccatggcgcccggccacttctagctttctataccaccgaaatgtttcaaacgtgtatacgcatttcttttacgtttaactttaattaaataaacatcccaatacaattcaaatattacaaatacctagttatgtacaagctaaaaaaccctgactaaatttatatccttccttatatacctattaagtaataaagtaaaaaaaaaaattattcttcaggtactttcaaacacttatggaaatgatttttttattcctattctcaagtagctattactttgcctgttaattgccctgaaaatatgtgaaaagtctgtgatactgggcttccaggagatacactaattccccaaaagcctgcttttaactttaatcgagaaagaatctgtaactccagaaccagaagtggcttccagggctgggcagcagaatcggccagcccagcatgcccagctacagaccccacaggttcatgttagtggaaacgttgaataactataacctgaaatgatcagaaatgacaaacgcttttgaggaaagatcaattacagctgtatgtaaacatcttttagccttgctttcttctagagcaagcctctcagtggagcttaggagcctacgacagctatatctgtagcccttccccacccctgggatccaccatcctaatcaaaacctctgcaggatctggcgaggtggctcacacctgtaatcccagcactttgggaagccaaggcaggcagatcacctgaggtcaggagtttgagaccagcctggccaacatggtgaaaccctgtctctactaaagatacaaaaattagcagagcgtggtggcaggcacctataatcccagctactcgggaggctgaggcaggagaatggcgtgaacccgggaggtggagtttgcagtgagccaagatcgcgcctgggcgacagagtgagactccgtctcaaaacaaacaaacaaacaaacaaaaacaaacaaacaaaaaaaaaacaagaacgttctcagtctctttgggagctgattccaacaggatctgagccctgcaggaagtctttccttctccccttccactctcctccattttagcttaagtcagtgttaatttaaagctactttctaacaggacacataacatcccccagagtcctactcagggaggaccagtttagaagtggggtactcactaacacctctcgattgtgggccagacaaacatctggggagtgagctgagataactgcattccctcccaaaacaaagtgatatacaacaaggttacttaacattctggcttctgttcaaagaaatcaccccgtaacacacaagatagaggatttcaggggcttgcatctcactgctgttaacagcctgagttagggtctcaataactgcaggtcaggccagcagcagaaaacacaacctcgttaaggtggatgaatgaacagatacattagacgcgagctggataaaatgctggaaaggtagaaagggcggggaggggatcctgtctcaggagtctgttgtgttttctcctttgggtgacaagaaaccaaaggggcagagcccacacctttccctgcctcaaatgcccatgtgagggactcaggccagaaaccatccgtgaaagggctttttcatcatttcttggccagcaataaaccacttgtgacaagtttttaaagttttctctttgtacctgggatgctgtgcttgggaaataagccagatcacgctcagtagccttgaattcttgtcaaaagcaggatacataccaatcatcagagcacgtatgatacgaggcgggaatgtgacatctgataaaaggggttatttggtggcattcaataagataaatacttaagctcacaaagagtcaccggtcagccctaatccagcctttcaaaattataaatctatccacagacacacggttttcttcactcaatacgaaaatacattcaaatgcaccaggcagtggttgcaggttcaaatgccgacaggcgttgggagagaagcagacaggcatagggcagggccatgtgggggtcagaagaaaactgaggcagcagctgcccagcttggccaaccactgccaggtagaagttgggcctactatttccagacctgatctttcttgagaaaaactaattttgacataaaatcaagtgatttttaaatactgcttcaatttttttttttaacatagcatgaaacaaacaaaacacagcctgctaggaatcagcggaagagacagtggcataaaaggtcacttcttgccaggcgcagtggctcacgcctgtaatcccaacaccttgggaggctgaagtgggcggatcacctgaggtatggagcctcaagaccagcctggccaacatagtgaaaacccatctctactaaaaaaaagtgcaaaaaattcactgggccggtgggtgcctgtaattccagctactcgggaggctgaggcagcggaattgcttgaacccaggaggaggaagttgcagtgagctgagatcacaccactgcactccagcttgggcaacagagcaagactccatctcaaataaataaataatagtcacttcttgatccaaatgtcttgtacttgaaattgaacttcctatcacttgactgataaaaataaatacttaagaagaaagaacagcatcatcttcctaaaatgtgatcattaagaaatgactatttatagaccgggcacggtggctcatgcctgtaatcccagcactttgtggggccaaggatggtggatcacttgaggtaaggagttcaagaccagcctagccaacatggtgaaaccctgtctctactaaaaatacaaaaaaattagccaggcgtggtggcacacacctgtaatcccagctactcgggaggctgaggcaggagaatcccttaaacccgggaggcggaggttgcagtgagctgagattgtggcactgtactccagcctgagcaacagagcaagacttcatctcaaaacaaacaaataaactaaaaatacaaaattagccaggcatggtggcatatgcctatagtcccagctacccaggaggctaaggcaggagaatagctggaacccaggaggcggaggttgcagtgagccaagattgcacctttgcactccagcctgggtagcagagcgagactctgtctcaaaaaagaaaaagaaaaaaaaaagaaatgactatatattaactctattctgagccaacactaatatcacatgggacagagcttttgcctctatggcccatggataagctaacaccaagggaggcacatctgacagtttcctacagtgtctgtaaaacactgtccagccctgctcaaacagcccccgctgtcttcttctgaacaaccacaatcctgttttgagaccccacttcggtggttaatcaataatactgatggaagaattcccctatagttcctaacctctgttctttgaccttaccccttgggtccaaggtcatggcaacgtggtggtaaaactccaacaccctcctaaatctttctgcttcacactccgagctcattcatgcacacatctgaatgctgtcattgtctggacctgaggctgaggctcaggctatacccaggcatggaggggaactgcatacatcttatggttcaccaagaatgtgctcataaaaaaacaaaccaaccaacctcgtagccgcagaaggaccgcgagattgcctgccctccccggcaccatgtacttgagctctccagcaggttttacactcacgttcagcaacaagattaagacgaggcaaaaggagacaaacgggaccttttacacacatggtcaaagatgtgcagagagaaggtggaaggcaatgcatcgtggcatgatttatgatagccaaaagggggaaacctcctaagtggtaagcttgggagatagaacaaatactctgtggtgtacgtacgcagaagaatattgtatagccattaaaaaacctcttattggcccaatgcagtgcttacgcctgtaattccagcactctgggaggctgaggcaggacagttgcttgagtttggagtttgagattggcctggtcaacatagcaagacccccattgctacaataaaatacaaaaattatccaggtgtggtggtgtgcgcctctcatcccagctacttggaaggctgaggcgggaggactgcttgaggccaggaggtcaaggctgcagtgagccaagactgcaccactgtattccagcctgggcaatacagcaagatcctacctcaaaaaaataagcaaaacacattaaaaaagaaagaaattctgtgacttgcagcaacataggtggaactggaagttgctaagtgaaacatgctcattttaattttcctttctaagggatgaatcctaatgaggtgggtggtaaaggcaagatactcagaaggtaggctgccagggtctggcagaaaaaggcttattttcaccaagctcggaagcttccccagatgagaaaagagggaagggaccaaagaataaaaataaaaaataaaaattccactgcacttggaagatgcagagtgtctgaacattacctccaaacagggcaccctgtttggctaaaaatagccagagactgtggtacttcatccagtatcagccctgagtctcccacacacaggcatcttcactctctggagcacttcaggagtttacaaagcactttcaagccatcatcccctggggaggaaagtggtattgtgggttgcatagtccagactctaggcatgggctgtctggttttaatcgtgccagctatgcgaccatgggaactttccttagccaacttacacttcatctacaaaatgggcacaatcattgtgactctatcataagaggggctcatagcccagggcctggcacagagcaggtattcaataggtgatcatttctcactgccgtcagtaccactgttatcaccattactacctcatctttagcaaggacctgtgaagtcaatggccctagtccctctttacctttgaggaggctgaggtgcagcaatgatttgcttaaaatcgcacagctaggccgggtgcagtagttcacgcctgtaatcccagcactgtgggaggccaaggcgggcagatcacttgaggtcaggagctcgagaccagcctggccaacatggtgaaaccctgtctctactaaaaattcaaaattagccgggcgtggtggtagatgcctgtagtcccagctacttgggaggtgaggcaagagaattgcttgtacctgggaggcggaggttgaagtgagccaagatcgtaccaccgcactccagcctgggcagcagagcgagaatccgtctcaaaaaaaaaaaaaaaaaatcacacagctgattgaattgaaagttacaagttaaacatggccagcaattgcactgcagaagcagggaaggccaatgtgatgccctcaccttccatgaaagtgagtagacagggtcttgaaatacagacatgcatttatgccactgggaggctacaggaacccacggcagatgtttcagtaaaactcagccctcgctgaggtcacagtgcaatgatattccatgtcctggcacatttgtaaaaactgagctactaaaagcaaagtgtaaagctgcatctataatttacagttgtgcttttaaattttaaaaaatactttaataggctgggtgtggtggctcacgcctgtactctcagcactttgggaggccaaggtgggtgagtcacaaggtcaggaatttgagaccagcctggccaatatggtgaaaccccgtctctactaaaaatacaaaaattagctgggcgtgatggcgtgcacctgtagtcccagctgctcgggaggccgaggcaggagaatcacttgaacccaggagacggaggttgcagtgagccgagatggtgccactgcactccagcctgggtgacagagtgagactccgtctcaaaaaaaaaaataaaaaataaaaaatatatatatattttaatgaagcgtgagggtaattctaatacatgcaaagaattatctctgcaagtatactcagatattaataacagcgggtgtcgcagaggaagaagcctgggagaatggaagtcagggaaggagagcaacaggcttctcactctgtgccatgagcatgtgctagccatggagacactctgcatgttacctagaactgctgattcattgctctggaattattcagctattcaagacccagtgaaatacagcaagcagctttcattcatacacacacatgtgcatccatgtgcacacacatactaacatggcacacaggaaaatacatcacacatacacacacacacacacacacgtatacctgaacacaagcgtaagtcctacagaaatgtgaaagtcatatgactttcttttttttaaattttttttttgagacagtctcgctctgttgcccaggctcgagtgcagtggtgcaatctcggaaagccatatgactttctaaaggaagttacttaattcaccctccttcctgtttaattatatgtactacagcatgattctgtactggtcctctctctctctctccatatatatatatacacacacacacacaaagtaaatattattttatatatttatatattatgtcaatatttaaattattatttacataatatatatttacataatatattatataatatatatttacataatatattatataatatatatttacataatatattatataatatatatttacataatatattatataatatatatttacattatatatatttctttacatatttataatatgtaaatatttacatattataaatatgcatatcatatattatataaatacacataaaataaaataaatatatatgtatatttaaatatgcatacatttagaaggagtctgagaaaatctataccagaacataaacagtagtagttatcgccaggtggcaagaatcacaggttattttttatcttctttttgattctacaatttctcccttttctgtagtgaagacattagtacttgtgattttaaaaccttttttggccaggagtggtggctcacgcttgtaatcctagcactttgggaggctgaggtgagtggatcatttgaggttaggagtttgagaccagcctggccagcatggtgaaaccctgtctctactaaaaatataaaaattaaccaggcatggtggtgggcacctgtagtcccagctactcaggaggctgaggcagaagaatggtttgaacccgggaggcggagattgcagtgagccaagatcacaccactgggcgacagagcaagactctgtctcaaaagcgcctggccaaaaaaagaaaaaaagttttttaaatatgaaaaattcatggaaaagacaagtgaatgagccatggacagagctgatcctagctgcttacaggacagcacctcctggctcaaaccaagaaacaaaggcttggaaagttgcattatcaccaaggcccccactgccactccccaccacccactctcgacactgtggaacatcctggaaatggtgggatgctgtcagggctgaggcctgctcgctccagcatctgagcagtgctccgctcctccgggtccgactgtatctatttcatttcctccgtgacttactgtacggtggcagggagggcccagcgcccccaggctgtaatcgatagctgaataaagacacttcaaggttccccaactggaatgtgcacaggaaacaaatttaggaaatcctgctttctgttacaggaaatgaatcctacgccaactggtagaaattactccagcagctcccaagtaaaatgcatactggtttctacacatgttccataaactgaccttgcctaggctagcaatgttttattgatattgaatttcaaaggcacgattctagagccagccaagtctatgcagaatcctacagggacttggaaacagtacggctttctgaaagatttcaccttaactagatttagcctcctctgagcctcatgaggcatttatataaacctatttgtatttggcagtaggcggcctctgaagtagtttttagaaggctgatcaggaagacattaacaatgactatacctttagtaagattatgggctactttttacttttctgatcaatgcattcatgtgttctactatagacataaaataactgtgcaatacaaaataataaaagttgtaaaaaaaaaaccacagcaaggccagtcgcagtggctcacgcctgtaatcccaacactttgggaggccaaggcgggcggatcacgaggtcaggagatcgagaccaacctggctaacacggtgaaaccccatctctactaaaaatacaaaaaaaaatagccgggcgtggcagcgtgtgcctgtagtcccagctgctggggagactgaggcagaagaatgttgtgaacccgggaggcagagcttgcagtgagccgagatcacgccactgcactccagcctgggtgacagagcaagactccgtctcaaaaaaaaaaacaaccacagcaaaaaggtaacactggcctctgaagacaccaaaggccaaaggaaagtagttctttttttttttctcaatcatgattcagaatcttagaaaaacaagacaaatctgatttcaagtgcaattcatccacagaagagataaagtaccattcactttgagaaaaagcggccgagaagtgcaaagcattccatgaaagatttatcctcatggaaaaatctttgcacagccctaaaacaaatacaccaaagtccagtgggagcagaggagtgggcaacgggcattaaagcctccagagatgccaacaggagcatcaggggcctcaggcaggacttgcttctcagatcatcagcatctggagcttgctcaaatttgaattccgctgggtgcggtggttacgcctgtaaccccagcactttaggaggctgaggcagagagatcacttaagctcaggagtttgagaccagcctggctaacatggggaaaaccctgtctctactaaaaatacaaaaatttgccaggcatggtggcgcacttctgtaatcccaactacttgggaagctgaggcatgagaatcgcttgaacccggaaggtggaggttgcagtgagccgagatcataccactgcactccagcctgggcgacagagcaaaaaaaaaaggcctggcacggtggctcacgcctgtagtcccagcactatgggaggctgaaggatcacttgaggtcaggagctcaaataaaataaaataaatttgaattccatcaaatacccacaggttactggttccaagtccatagctaccaaaaatatggccctctctgacatcgctattccacagtatcattcccaaagggaaaaacagactaaacctgccaagccacagaaagaagaaatgatgataaacctgaaattgtcacttactatggcacaagtccaagtagatcaggacaatcacccaaacctaccctccctccccctctctctttctgcacacaattcccatctcagaaggtagccaggggtgtacaacatttttcactcctaaaaagcctggttcaaatgtcaacagtcacggatgaactgggttttatagcttgagctattccacaaacaccctgcaggctggaaggaggagtctcccaggtgacaaattccactgcccaaaaaagggagaaagaagcaccaggacacagaagatgacactcaagcgttcttccatttgtgaactttgggaaagatgttcattgtgccatcccccaaccgccaggaaccgcaggctcactgatacttgcaaattggtccagaactttaggagccccattcttcctaaaatgggttaaaaaaaaaattgggattcctcccaatgttggtacaagagttaaatgtttaaaaaaaaaaaaaaattctgggaagcactctggccatagttaccatgagccttatgctcatttaaagccgggcatggtggcacacgcctgtagtcctgactactcaggaggctgaggtgggaggatggctcatacccacgagttcagggctgcagtgagccatgattgcacctatcaagagccgctgcactactccagcctgggcaacatagcaagaccccatctctaaaaataaaatactcattcaatttgacccacaagatatactgactgcctacttggggcttcacaacagccccactgtgggggttccatggcacagatctggaggcacagcaagcataagtaactgcccaagtgtggagctggatcccgggagtaagtcacacactatactgtgtcacacaagcctcctccctaggggcctggggctgtcttgttagcactaatatcacagtgttagtctactcaaaagtatctcttgaattcataaacccaatcacgccacttctagaattataaggtgtaaggatgttcattgcaaaatacttataaatatcattgctaaaaattaggaataacctaagttcctacagtatgagaagttccaattatgagaatagttaggatattagggtatatgcataggtagcaattcttaaagaatgctttcaataatattcaagatgattagaaaacagaaatgataaaatagtaagtgaaaaaaggaggatacaaactatatcaataggaaaattcacgttttaaaaagtaaattaaaagatattgaaaggtggccgggcgctgtggctcacacctaaaatcccagcactctgggagatggagccgggaagatcgtgccactgcactccaacctgagtgacagagcaaaacaaaaacaaacaaacaacacctcaacaacaaaaagaaaaacagacaaagtgaaaatggataaaggatatggatagacatttttccaaagaagataaacaaatggccaataagcatacgaaaagacgctcaacatcaggggccatccggaaaatacaaatcaaaaccacaatgagataccgctccacactgactagaacgtccagaatccaaacaactgacagtaacaaggattgaccgagatgtggagaaacggaaactgtcatacgttgctggtagatacgtaaaatagcgcagccacttttggaaaacagacagacagctcctcaaaaggttaactatagagtcaccatatgacattgccaacccactcctaggtatatacccaagagaaacagaaatctacacccactcaaatacttgtacacaattgtccatagcagcattatctatatagacaaaaaaaaaaatccaaatgtgcattaattgatgaatggataaataaaatgtaatatatccataaacagattattattcagtgataaaaaggaatgaagcattgatgagtgaatatgcatggatgaatcttgaaaacatcacactaagtaaaacaggccaatcacaaaaggccacctattgtatggttccagatgtttggagtgtctgtcataggcaaatctatagaggtagaaagtagattagtgggtgctttagggctggaggaatgaggaagacaagggagtacagcaggaaagtgggtatagaatttcctttggggtgataaaaatatcctaatttgattgtgatgatggttgcaaaaaaaaaaaaaaatcccaaaatatactaactatattaagaagccatactcaccaacgcagtgactcacgcctgtaatcccaacactgtgggaggccaaggccagtggatcacctgaggtcaggagttcaagaccagcttggccaacatggtgaaaccccatctctactaaaaatacaaaaaattagccgggcatggtggtgggtgcctgtaatcccagctattcaggaggctgaggcaggagaatcgctcgaaccccagagtgggtggttgtagtgagccgagatcacgccactgcactccagcctgggcaaaagagtgagactgtatctcggggaaaaaaataaaataaaaaagtcatactttaaataggtagactgtatggaatgtggagtttatcttaattaagatcttaattatttacatcttttttaaagtatgtggtttaaatgggaccttgtgccctgttatgctggccttttgagttacaaaacaaaatctctaactttcctaattcagactatacctcaagtccaaggctattctttttagaggaaaggcgtttctttcttgtatttgaaaatgtgtttcccagcagccctgcatcatcctggctcctgtctgccctgacacattgcttccttagaaaacgcctaattccagcacagagaaaacaagcagggcctccccatgccttgctgcacctgcccaggtttacctcatcggggctggatgcctggtatacgcggcaggagtcttcgtactgcttctcggcctcagcctgatcagtcacaccgttggactcatacacgggagtcacgttgtggcagagcgcgatggccttcacggcttcgtgcacgcggctgctcatggtccgccggaccttagtggtgagcgttgggcccttctgagccggtgggtcctgggattgctacaggaaggagaaatgaacaaggaagatgaccagaggcaggaatgatttggagagtggaagaacagccgtgcagctattgtttcttttttctactgttccaacacacagaacccttagatatatctacaatgatgctgcaaataaatgacatgcaattttcagggtttgtcatttatgctcggcaaaaaaaaaagaaaaagagacagaggaaaaaaaatacaatttaatgaacgagaacgattctacctgcagattgagtgaatctatcctccctggggtggtgtcgggggcttttgacagaatgaggaccccactgcactgaaagggatcccggtagttcagagcagggcttccccacttgggtactcctatgttgggggacattatatagggtgttcagcagcatccctgtcctccagccaccagatgcgctggacgccagcagcactcccctagttgtgacaagatatgtcaccaaatgtccaatagaggccaaaatcaccctcggcttagaaccactgtttaagctcacaatcttcttggtttacaacagaaggcaacaacctcatctggtaccgtatgcaagtaacaaccatcagcaacaagcaatccagggcagtccagcaaggcgtcaggaacagccagaggaaaccttggccggatgggactcactgcaaaacggcacctggctccccactgaagctagactttcgggtgtaatggtaactgtgctcaagttttgccttgcaggctgactttagaccccagctcttgcctgagaggcagctccatggcatacaactggccttctccatcccttcctttccaactggcaacacagctcagcccctgaaaggccaggaatgggttaagtcttggaaaaatggttttgagcaacatggtaaaaagagcactgaagggtaaccaaagctaagccttattcttggatgggtggcaagcagctaggacacctgcagcaagtggtgtctgtcctctgaggctgtttcctgtcaacgagaggagtggccgggcacggtggctcacgcctgtaataccagcactttgggaggccaaggcgggtggatcacttgaggtcaggagttcaagaccagcctgccgaacatggtaaaaccctgtctctacaaaaatacaaaaattagctgggtgtggtggcactgtaatcccagctactcgggaggctgaggcaggagaggagtgaactagaggtggttttcaatccatgctccacactgagccccaggaatcctgagaaacccgctcagcaccaccaactgcagcaggatgggagatgcagcctgcagctccgttcctctgtcacacatcgggtgccacctatgcttccttttttttttttttttttttgagacatgagtctcactctgtcacccaggctggagtgcagtggcatgatctcagctcactgcaatctccgcctcctgggttcaagtgattctcctgcctcagcctcccgagtagctggcattacaggcgcccgccaccaagccctgctaattcttgtatttttagtagagatggggtttcaccatgttggccaggctggtctcgaactcctgacctcaagcgatccgcctgcctcggcctcccaaagtgccgggattacaggtgtgagccaccgtgcccgacccccacctaggcttcctttgaagaaagggttctactgctttagaatataatgaaaattaagaccactggcgggggggggggggggaaggctcattgttgaacacaagccaaatgccctcgcatctgatcaacacctgcctgcatctccagctgtccctcatgccatcttcctcccgttccctctgctccagccatgctggcctttctgttctttgggcactgccaagcttcttcctgcctgagggcctctgcacttgctgtgccctctgcctggaaccccatcccccagctcactgcagggctggcttgctcagtctcatcattcaggcctcaattcaactttacctcctcaaagaggctcttcctgggccccccagttcatggcactccacttgccttcccgttgcaagtcacattttggcaacaccctgtgtgttactctcttcattgtctaaattggcctatttacctgacggttccctctcattagaccatagaaacagaaggctcacctgagtgagttactcatcactgtattcctagtatccagggcagtgtctggtatgtaacagatatttgctgaacaattaaattaataacttaatagtcccaaggtggtggtagggagtcctcaattgacatgcattttttttcattttcaagaagtaacaactatgaaatcgacatcagtttcagattttaaatcacagatttagacaaggggtcacctacaacagtcttactgaatccacagccaactgaattgtggaggctagaaatgtgtatggagttaccagattctacattctattaaaaacatatttatccaacaggagagaagtgatctgatcctttaaaatgagtcgcactttacacccatgacacccgattgcccaaaatagagaacagatgggttacaagaaacaagaaaatgactttcacttaattttttaatactatttttagtattagcattagactcctcaggtaattagacaattactaaattattctggtcactgcggggacacagcgctctgccttcctgctctgttaacctctggtgtcaggagcacacgagtttcacttccaggccaaagggcactgcatggtaacaataattagagtaatgaatcagaactccggtttaaatgaatcattatttgccgagtgcttttaattataaagaatttaactctaaaattataaagaaaagatttacagaaaggttctctattggagagactaaatcgagaaccctttttttaaaaaattctataatttaggttctagccacgaacacgtgtcttcatttctgtccgcattcctcagcacctggaccaaatcgttatttaacattaggcgcaataacaagacctttgacaaagtaattactgtggttggcaagtttcagtatccacggatttaaatgaaaagctgtactgagggcatccttcatgaacttctggattttgtaaagcaatctgctttcatatctacaaaagtcaaatgcttccactaatatttcaaacatgggataacacagagccatgggattttgtattccaggtgaaacaattcccaagcaaggcaaaaagagaaccacagacggtcagatgttgacaaaggcctcactcaggagaccatctgacaacgaatgaattagaagactactatgatagcctgaccaacatcacaggccacaggttcaatgcctccacccacatatctttctctcttaaattaatactttcccacctttcctactaaaatgttccaggaaggagaggaaatactcattggtgctgaaactgcttcttttaattgttaaataaagtctcatttgcacaccaaatggtcatgcgcatacatccttaaggcactgaaactgaccaggggctgtgtttggatgatgcctgtcttaggcctggccttcaaacatcctcacattccccatatggaagagtttcacattgtacagtgtttatctctaacctcctccccataggccctttaacctacacacatttcttcttacttaaaaaataccaggggaaaacaaaaacagatgtggcatccacagaggcaggttatgactctttttgccctggggaaaaaccactggtccccttatggagggagggagggcagaacagctccacacgaggtcagaagtgacttcagaaccaagcacaggtcactattgggagaggaattaagatctccaaatacaaagggccctgacttgggcccctgggcgggtgtctcgaatcctataaagcccctgagtcatttatagcatcccagccaataaatgagacaccaaggcagggaaaataggcttccctttcccattagtaatccacagctagggccatttcctgacaagaactccagcctgttattacagaaaagattaatacaaaaattaaacgttgagtcaccaggaatgccagttttctttccaaatgcagttaaaacttcaccacatatgggcattcatactattaatggatattaggaatgggttgcaattgactgaaatacacttttttttttttttgagacagggtctcactctgttgcccaggctggagtgaagaggcatgatcacagctcactgcagcctcaaccttctgggctcaagtaatcctcccacctcagccttctgaataccgggaccacaggcgtgcaccaccatgcccagctttttttttttttttttttttttggtagagacaaggtctccctcttattgcccaggctgttttctaactcccaggctcaagtcaacctcccgcctcggcctcccaaagtgctgggattataggtgtgagccactgcacccagccagaaatacactattaaagataaagaatttctgttatgataaccctaactaacctgccacatcaaaaaagctcagagctgatgactcactcacctcaaagggccaccatcaaagagacaggctcagagctactacctccaaatgaatcagctgagccacaggctgattaagtgactaagtaaatccaatgtttactgttttagagcagacatcatctgcaacacaaagtcaataaatttaaatgtacccatatatcatcatcattctcaacttggatgattttgaccctcatttggtcatgtctggagacataattggttgtcacaactgtgaggggacaggggtactatagaaatctgtagcatgctgcttaacctcctacaaggcacaggacagcctcccatgacaaagaataatccagccccaataatgagaagcctgacagccactgaaactataaatccagggcttaggaccagggtgagttagcgcaactgaactgtgctagcacaaggttggatcttgccttcatttaaaatttcaatatactgttcttcacgaatgttttgcgcttgagtttttaaaatattgcactgcgccaggtgtggtggctcacgcctgtaatcccagcactttgggggaagacgagtggatcgcctgaggtcgggagctcgagaccagcctggccaacagagtgaaacccagtctctactaaagatacaaaaattagctgggcgtggtggcaggtgcctgtaatcccagctactcggcaggctgaggcaggagaattgcttgaacctgggaggcagaggttgcagtgagctgagatcacgccactgcactccagcctggttaacagagcaagactctgtctcaaaaaaaaaaaaaaaattttttttcaccaaagtatgatttgctttatttattttttttttggcacccggttaaatttgctatgtgagttcctcacttgtcttactctagtctggactgtgttatgaaaccattaaaaaccttgacatgagtgaaaagaaggaagttaaatagtgttattctggcagtggttcttaaccaggaaggcttctcagaataaccaataaagattttttaaaatatacacgccgggcacagtggctcacacctgtaatcccagcactttgggaggctgaggcgggcggatcacctgaggtcaggagttcgagatcagcctggccaacatggtgaaaccccgtctctactaaaaatacaaaaattagctggcatggtggcaggcacctgtaatcccagctactcaggaagctgaggcagaagaatcgcttgaacccacgaggcagaggttgcagtgagccaagatcacaccactgcactccagcctgggcaacaagatcgaaaactccatctcaaaaaaaaacatttttaaaatatacatacttaagatccagacccaaagaatgccgtacagcccaggcatatatttatatttatatttttaaaactttacaggcaattctggtggtcaactctagttaaaaaagaaaggaatatgatgggttctcattgaaaagaaaacagagacagagagaaataaagaacgcatctatccagacacacaaaggcagagcatttggcgttttgtccacccaggtgttaatactggttactgccgaatgatatgaatacaggtgaattcaatgttttgtctttgtgcttggccgtatgatttattttttctgcaaaaaaaactttcataaataccagaaagttttttcaatgagtaaaaaatgaagtaggctccatgtcccagagaaaaccacactgacaaaaaaaattcttcctcaagagaatgtaaactcggtggctcacacctgtaatcccagcactttgggaggctgaggcgggcggatcacgaggtcaggagatcaagaccatcctggctaacatggtgaaaccccatctctaccaaaaatacaaaaaattagctgggcatggtggtaggcgcctgtaatcccagctacttgggaggctgaggcaagagaatggcgtgaacccgggaggtggagcttgcagtgagcggagatcgcgccactgcactccagcctgggaaacagagcgagactccgtctcagaaaaaaaaaaaaaaaaacaagagaacataaactgaactttgtatctgttttctgtggatgcagaaagtaagaagaacgctctctggcagtcagtactgatgaactgagtgcatcctgtgtatatatgttgtgtgtagaaaaataaatcacaaactcacacgctcataaaaaaaacaactcagtaaatgaaaaatgacagttcacagaccaaagtatgtggaataatcccaattatggtttgagactgtcttgctctgtcatccaggctgggtgcagtggcatgatctcagctcactgcaacctctacctcctgggttcaagcaagtctcctgcctcagcctccagagtagctgggattacaggcatgagctaccacgcccagcaggaaaagttttccaagtaccttccatctatatatattgatctttgtataaatattgtattgtactactgaacattacaaaacaagaaaaaaaattctaaaatcctatgataaaaatgaaaaacagggctggctgcagtggctcatgcctgtaatcccagcactttgagaggctgaggtgggctaattgctggagcccaggagttcgagaccagcctgggcaaatggtaacaccccctctctctacaaaaaatacaaaaattagccaggtatggtgacgcatgcctgtggtcccagctacttgggaggctggggtgggaagatcacctgagcctgaggggtcaaggctacagtgagctgtgatggcaccactgcaccgtagtctgggtaagagagtataagactctgtctcaaaaaaataaaaataaaaataaataagaaaacaaaatgaaaaatagcatttctcacacaattagctaatatctcaaaataacatatacttggggtaaggaacactgagaattatagatttaaacttaaatttcttttttttttccttttgagaggagtctccctctgtcacccaggttggagtgcagtgacgcgatctcagctcacttcaacctccacctgccgggttcaagctattcttctgcctcagcctcctgagtagctgggattacaggtgcccgccaccacccccggctaatttttttttttttttttgtatttttagtagagacggggtttcaccatgttggtcaggctggtctcaaactcctgatctcgtgatctgcccgcctcggcctcccaaagtgctgggattacaggcgtgagccaccacacccagcctaaacttaaattttaaatcatcatacctgttattcagctacaaagaggaataaagtacatacacctgctacaaccggaagaaccttgcaaatactctgctaaacggaagaccggccagacacaaaaggtcacatattgtttgattctatttataggcaatgttcagaataggcaaatccagagacagaaagtagactgacagctggggggatagagcaggggggtttgggaactcaagggatgtgggctttctttttagggttgataaaaatgttctaaaattagacagtaccaatgtttgcacagtattgtgaacatattaaaaactacagaatcatatgcttaaaagagcaaattttatggtttttaaattgtatcccctttttccattaaaagtactagtaaattgccaggcgtggtggttcaagcctgtaatcccagcactttgggaggccgaggcaggcagatcatctgaaatcaggagttcgaggccagcctggccaacatggtgaaaccccgtctctaccaaaaatacaaaaaaaaaattagccaggtgtgttggcacatgcctgtgatcccagctactcgggaggctgaggcaggagaatctcttgaacccgggaggcagagtttgtggtaagccaagatagcaccactacactccaggatggggcgacagagtgagacttcgtctcaaaaaaaaaaaaaaaaagtaccagtaaatgaataacccaggggaaaaaccatcacaagtccttagctggttatagttttctctcctaatgtgttggccattttcttactgtttacttggccttgtattaataatctgaagctttcctgcaggaatcttttaaaaccacctgctctctttatgagtccagtttagttcaaccacatccttagaacaagtcacctggacactcataaactgcggcctacatttcaacactgggaaaataaacaactgtggaattccagccccttccgcaggacacctcaaggaccggacctgacaagtacctgtctgatacatggagtgagggcccctgggtcaacctcaatagtattagtaagattttaattttgcattaattttggagatggaactgaaatgtaaagagtcgcttcctgtaccccagtgggtcatcttgcaaactcttccttggagtccacaggtttagatacccatgctctgaacagggatgaacctcagtttcacagcagctgttctccaatgctactgtactctggaaacacctggttcacctgttaaaactgcaggtctgggcaccactccttgtgctcctgactctggcccaagtgatctagcccaggggttccaaaggctgtactttacgaaacactgggccaggcatggtgactcacgtctgtaatcccagcactttgggaagccaaggcggacagatcacctgaggtcaggagtttgagaccagccaggccaacatggtgaaaccccgtctctactaaaaatataaaaattagccgggcgtggtggcaggtgcctgtaatcccagctactaggaaggctgaggcagagaattgcttgaacccgggaggtggaggttgcagtgagccgagatcgcacccctgtacctcagcctgggcaacagagtgagactgtgtcttaaaaaaaaaaaaaaaagaaagaaagaaaaagaagaaagaaccactggtataagaaccccttacgaagctctaaggtgggaggcgtgactgcagtgggagcaggggtgatgtgcatatttgggatggttccacagctgcaaatttactaaagtcaccacactgtgtattcaacatggctgaactttcaggtatgtaaatcatccctcgataaaactggttttaaaaaagcatgcaaaagcttccatatgtcccatcacacacgtggtcctgtgcttatgccaggatgtttagacatcacgagagaaagatgcacacactctcacttgggtagatctgtactggaattgtgagttcaccccagcctcgcacagctaaccctaaccccacaacacacagctgtgtcagactcaaggccgggatgggcaaactgatttatgagcttcccctaaggaaggagtatgaggtgaggttcacggtaagaagtgtggttttctgaatttcaacactttacaaagagtgttatctgtgctaagccaaaaatgaaccataaaagctaaaatacacaaatatcctgagaggggacggcttccgtaaacaccaggagctcttaaaaataccagcaacatggcatgggtgtaactcccaccggatgtacacaccaccacctgtgaagctgtctaatataaccatcaagagtcaacacgactgagaaggggctgcgagtgatacagacatgtagctgggtgctgatatgcatgacaatccaatcaatgagccccccaagaaggagcctggtgggcatttggggttggtggctccgagggaagggtctaatttgagacacagaaataaggcagctcaccctgcctggaaggctgaaacatgggaaaggggaggggatgaagaccaaggctagatcccactgcaagtctcagactccaccacagagctgatggtaccgagaggctcctgagaggacagcaagaaggaaagccgggcagctactgtgcagggggtcacggcagacaggcgaggaagggggtcaccttgctgagtgagtgagaagggatgaagacaaaaggccaaaggtggctgggcgcagtgcatcatgcctgtaatcccaacactttgggaagcctttgggaggtgaggcgatcacttgagcccaggagttcaagtccagcctgggcaacacagtgagacctcgtctctataaaaaataaaccaaattagccaggtgtggtggtgcatacccagtgcacacttgtagtccgagctacttgggaggctgagatgggaggattgcttgagcccagaagtttgaggctgcagtgagctgtgattgcaccactgcactccagcctgggtgacagagtgagaccctgttacaaaagaaggaagggaggtgggggggggggggggcggaagggctgggagtgggcgaggggctgggggaggggagggagggtaaggaaaggaagggaagaaagggagaaggaaaaaaaaaaaaaaggccgaaggggtgatctagtgatcgggtgggagcaggtactggagaaggggcagtggctgtcagctggggtgacgagggtaccaggatggagggcgtggtgtgcactaagacaagcagccctgggagagaataggtttaggagatgagggaagaaagtcaggaggggtcccaggtacagcatccttatgagccacatgcagcaatgccaaacattcggctacgttataatccaaagctccaggtcaggcctagagatggagatggagacagagccatcagcatccacagagcgatggaagcagggtgaggggccatccggggaacaacataacagagtccagcaccgagccccagagacaccaaccccaaatcaccacacagaggaagacggtcaaagagacagaaaggaaacgggggctgtgcggctcatcctccctgtccagggaagttcctcgtgatttcttaatagtgctaaagtacatctttgaaaaaggtccatggatccatttggagaccagccatgacgcctccccatggagcctggaacagcaacaagggctttgttgctggttgtagatgatgacaagaactgtgtcaagtcagctgttctaacttaacatccactcccactgtcacactgtcccctgctctgccattttcaggagacagcctggaaatccagcccactgacaaatgttccagaaaattaaatgtcagttatgaccgtatcaagaagtattcagggattctgcctttaacctgtatacagagataattcattcatatttcttactggtcttctgactatgggaatgttctctatttcgacgaatttaagcaaaatatgacctccttattctcttgttatctccaaacaagtgctgcaacatggagctggtctaacgcggtctggctcagccttggatgtgcctcagaattagcaaggggtgtgtttgtcttacttttaaaacccaaagccacgccctgccctaagtcttaatgagtaagaatctccagggtatcaagcccaaataaatgtctcgtttttgttctgtgttgttttgaaactccaccagcaattctgacacacagccaagatggggacccaccggtctaacactttaggaatattaggatatttgccagtaatactttctctgaaaagtgactggttttgggaaacttggtaggaaaaataaaggtaggaacagataaactgcaagttatctctgatgaactaatttcttcctcgtgattgttgagttgaatgtagatgagaaactaaaggtaatcagtaacgtcatgattatttcacaagcagaccatttgttattggtgctccgggtcatagccagggaaagggaaaacatcaacgtggtcgtaaacttgaagtataatcaaccagcaggttccttctggttctatttattgggcatataattttctcacaggtttttcctaatgtccatcagcacttcagcagagcagattagccctgaagatagggaagatggggaaggaccccaaatgcaattttattcaaagtgtaaaggaagtgtgggtgtcatgggtatagaagggaggtattggggagtgactgctgatgggtagagggcttctttttggggtaaacataaaatcgattgcagtgacagttgctcaactctgaatatgcttaaaaaaaaacaatgaattgtactcttgaaatgggtgaattgtacggtattgtgaattacatctcaatatagctgttaaaaaaaaaaagtcaaagaattgttttgggtgttgaaatggaaggctttacctgggtgtaaatgctgaaaatgtggctttgtacttcgtccattgagtcgaggccgtaggctactgttccgagatggagccgtttgaaaatcatctcgttctgggtaagagtgcctaaaacacaagacaaatgagtggccggcctgtctctcaggatgtttgttattattaacagtaatgacagctgccatctttggagagtttgccctatgtcacacactgcagtcagtactgtccctgctggggaagacacctgcagcattttgcctgcctagaatcccattccccttttgaaaatggcttcctagctttcccaggggaaattaaccacaccatgcccattacctaaggtggcccaagaggactgtcaatcaggggcctggcccattccgttggccaagagggtgacaaatgacatacactagagcaatcagattctatctcgaaggattctgacccttgagtagaaagatacatccctaatggcagagccctacagagaccacctggagggtcctaatgctgacttaaccagaactttcctggtggctctccttccagaaacctcatttttctctgatttggtgagccgcccaggatctttgcattagcttcccttctaccccatggacattaagcagtagagatgaggctgaaaccagatcttccccctcccaatccttgctcttcaccactctgatagcctaatgcctggacaagcattaagttgtgtagcagtatcagggtgtggtcagagatcaggcctgactgcctgagttaaagcttgcttcggctactatgcgcccgtgacaagtcacttaccctctctgggccacatttcctcatctgtggaagcgggacagaaacactacctaactcacaaggttcaggtgaggactgaaggagtgaccgcactgaaactccccagaattgtattctgcacataattctgttatcatcatcttcatcaccaaagaatcttcatcaaaagatgaagggaataaaatagcagcaacacgcatctctcatatgtccagagagagcccaagaatttcagccaaagccctcaggcatcttctctcaccaggaatcctgcgcaggtcccagaaagcagctcacctgtcttgtctgtgagtaagtacgaaatcctgcccagctgctcaggaatcgtgctggagcgaaccacggtcccggggattttcgagtcccttcgaatcacccagctgtacacgatcttgcccatgtccaggttcacacgcaaactaggcacaaaaccagagcaaacaggctaacaggacagatgtaaggctccttgtatctttataaaaacatggactctaaacacatgtgccatcgcatccggactcactccctgcagaagcacactgccagagctgaacgcacagactcagcaagagccagcaccaccgtcaagtcacacacggaacaaatccattattgtcacaaagctcatgttatggactgaagtcacttaaaatacagaaagggtagtggtttccatctcaccttttagaaaaattactgatcccttaagctaatatatttttgatgctatattcatttttttaattgtggtaaaatatacataacaggaaattgaccattctatagtactgagcacatttacaatgttatcagccatcagcatcatccacctccgtaattctttcatcttcccaaactgaaattccacacccattcaacaataacgccccatcccccaccaaccctagccctggcagcccctggcaaccagcactctacttacatttctatgaatttgactacttttttttttttgagacgaagtctcactctgttgttcaggctggagtgcagtggtgctatttcagctcaccacaacctttgcctcccgggttcaaacgattctcacacctcagcctccagagtagatgggattacaggtgtgtgccaccacgccgggctaattttttgtatttttagtagagatggggtttcaccatgttgcccaggctggtctcaaactcctgggctcaagtgatccacccgtcttggcctcccaaagtgctgggactacagacgtgagccaccacgcctggccggaatttaactaccttagacactgcatgtaagttgaatcatacactttttctgacttttgggggggcttatttttctggcttattttgcttagcataacgttctcaaggttcatccacactgtaaggtgcattagaatttccttccttttgaaggctgaagagtattccattgtatgtattatactcattttgaaatttaattttactgcacaaagtaaatagaagtcttcacattaattcatcatcctataaactaatcaaactgcttgccattttactggctagccctgggacaaatgaagagtcgactcaccaatttttaatcatgttacatgtagaactttgaaggctaccacgtcacttagattgaatacttgttttgctagcagtcaagtcactaaagtggatgtatttatcctctgaatccaccatccagagcatgctgacttgggcacagtccccctgtccctgtcacactgttttacacaaaacgacaatctctgtccccagaaaaagacaaattctcaccaagatgatctaaatatataaaatagcaagacaaaatataagataatatatcaagtataagacagagtataagcactaaaagtttcagggaaaaaatatgtaatttaatatttactaattatcatggggaaaaagtagaagcaaacagaacaatatgggggaaagtagactgctaacccacatcacagagcagctctaaaaaatgatgggacacacatacaagtgatgtgaaaagttattcaaaacactgctccaattttttgtaaaggcagattttagtagaccaaactcccctttttctaaaatcaaaagcactctagaaaaaagtatatcccatactattaacaatgattatcacttggtagtgagagcagaggtgatttatattttattcttttgctaatacaggccttcacttttttctactatgaaaatctattatttatatcactttaaaaaaccaggccaggtgcagtagctcacgcctgtaaccccagcactttgggaagctgaggcgggtggatcacttgaggtcaggagttccagaccagcctggccaacatggtgaaaccccaactctactaaaaatacaaaaattagccaagcgtggtggcaggagcctataattccagctactcaggaggctgaggcaggagaatcacttgaacccaggaggtggaggctgcagtgagctgagatcgcaccactgcactccagcctgggcgacagagcaagactccatctcaaaaataaataaataaataaataaccatttattcaacctccaaatcaggtaggcaaaggactggcatgtgccaccaagctttcattgcacacctacagcagacactgctgtcaatcacaacaccatttccctttgagcccagatgcaggctcaaaatccttctcaacacagcagtcccaacagccactatcaaccttgcagagctggctgatgacaggagctctaaatggcatccctagcatagggaggcaaggcaaggaaagatctctgattcaagaaaggatggcttgtggaggaatgtgatcttctggtgctagagcctcagtgtggttcacactcctgactgattgctcttggtcctcactctacaaagagatctgctccttctaaaagccgatgggcgcggtggctcacacctacaatcccagtaccttgggaggctgagtcaggtagatcacctgaggtcaggagttcaagacaagcctggcaaacatggtgaaaccccatctttactaaaaatacaaaaattagccaggcatggtggtgcatgcctgtaatcccagctacttaggaggctgagacgggagaatcacttgaacctgggaggtggaggttgcagtgagccaagatcgcgccactgccctccagcctgggcaacaagagcaaaactccatctcagaaaacaataataataataaaagccacagaaccatcatctttgaatgagtaaagagaagaagatgtcacggcagccaaactcaagctcgtcgcctgcttacctaatggggatgatgttggaaaacaagaggaggaagcggatgatctgcaggtaccaacggcctgcaaagtgctgaagggcaaccatgaccagcgagaccaccaccagggcaccaaagaggatcttggtgaggcagttcacttccaagtcgaacaggccgatctgtgggacgaagcacaaaccagggcttgagatgagctggtgtaactaatctcaaacctaaaccaggaggtggaggctgcagtgagctgagcctcactgcactaactcagcctgccggagagctggtccttcccctacaaacacctctaccccaggtaggacagtgggatccatcgatcctcatatctttggtctaagaacactgcttccatgggctggtgttcataacaggcatccaagggaactcaaagaattctgaaaactcaaaaaaatgtttacaactaaagaagatttacacttggaaatgtatcagcgagttactgctgtgctggctgggtcgtgtgctgaatagcctccaccaccctgcagagtgcccttggccttgtaaaacaactcagatcctaaactctcagcaccctacccaacaccaactcggcagtgcctgaaagtctggggcgcacaccagtggtggcacccgatttttaggtggtgcattaatggacattattttattatttatttatttagagatggagtctcgctttgtcacccaggctggaatgcaagggcacaatcttggctcacacctcctgggttcaagcgattctcctacctcagcctcccgataagctgggattatggcgcccgccaccacacccagctaatttttgtatttttagtagagacggagtttcgccatgttggccaggctggtctcaatctcctggcctcaggtgatccacctgcctcggcctcccaaagtgctgggattacaggtgtgagccaccgtgcccggccctggacattattattttaataataatacatttatcttcatgtctagtcttttaaaaagtaacaaatcatatccataacttcatagaaacatgccccaggataaggctaaaacattaaacaaacgattttatagttgtaatgatggctgtaacgtctaatggtggagcgaccatgactgaagtttaggagacacagcattccttcctgctactgacaaaagacaattattctgtaatgttctgactcttaaaaattggaggaggggtaagctgtgatggtgggtcacggtttgaatcacatgggcctgccccgtcctcactgtgtagcctggacagggcacggtgcttcctgaagccgtttctcatggataaaggaagcatgcactcacagggctgttatgaagatgaaatgagatgcacgtgaagggtgaaacacaaggcgtgcaaaccgtacgtgctccacagtttaacctaaaagcacaaaaaatgctgggcgccatggctcacgcctgtaatcccagcactttgggaggccgaggagggaggatcacttgatgtccggagcttgagaccagcctggccaacatggtgaaaccccatctctactaaaaatacaaaaattagccaggcatggtggtacacgcctatagtcccagctactcaggaggtggagttgggaggattgcttgagcccgggaggcagaggttacagtgagccaaaatcaagccactgtattcctgcctgagcaacaaagtgagaccctgtctcaaaaaaagaaaaaaaaaaaaaaggcacaaaaaagtcatatatccacaaacatgtaactacatatttacgtactgtattatatatgtgtattgtatatgtatttattgcatacacacacacacatatgcataaaaagataaaatgtctgtataaatatcactcttaggtgttcctattttaatatctcgtcactcacccaccagaaccaaccagcccacagccggtcaatgtaccccatgacctcgtacacaccttacttcggggatttgaggtattcatgacactccggagttctctgccagtgtaaagaacaacacccacaacagtacctaaaatggaaaaaagaaaaaaaaaaaaagaaaagaaatattaatacagacaggcaggcttgcaaatagaagagtctgatcctcttgagagactgggttcttttttttttttgagacagagtcttgctctgttgctcatgctggagtctggagtgcagtggcacaacatgggctaactgaaagcttcccaccatgttcaagcgattctcctgccttagcctcctcaataactgggattataggcgtgcaccaccatgcctggctaacttttgggtttgttttgttttgaggcggagttttactcttgttccccaggctggaatgcaatggcgtgatctccgcttactgcaacctctacctcctgggttcaagcaattatcctgcctcagcctccggagtagcttggattacaggcacctgccaccacacccggctaatttttgtatttttagtagatacggggtttcaccatgtaggccaggctggtcttgaactcctgatttcaactgatccatctgcctcagcctcccagagtgctgggattacaggcatgagccaccacgcccaacctcaatttttgtatttttagttgagatggggtttcaccacgttggccaggctggtcttgaactcctgacttcaactgatccatctgcctcggcctcccaaagttctgggattacaggcatgagccaccacgcccagtctcttttttttttttttttttttttttttttgagagagggtcttactctgttgcccaggctagagtgcagtggcacaatcatattaatagctcactgcagcctcaacatcctgggctcaagcgatcctcccacttcagcctcccgagtagctgggaccacaggcacatgccaccatgcttggctaatttttgttttttttgtagaaatgaggtctcactatgttgcccaggctggtcttgaattcctggattcaagtgatcctcccaccttggcctcccaaagtgcttggattacaggcatgagccacctcgcccaacccaacagccacactatgagaacatcaaaggttttacattagggccaaaccaatgatctgcggctacactgaccaaaagaacagtcactaaccactgaaaaccctttgagtttaaattcagttaaattaaatacagcgcccaccctccctagccctgtttcatggccatataagctagtagctacctcatggaacagagaagacccagagccttctccttttaccacaaaacttgtactggtgaatgctggtctacggggcccagcggcttctaatggaaggtgactggggaaaggcgtggcttgccgtttgtgcctctggtcatacaggcttccagaggtgcctagaacattcctaccttcattaactattatggaaacttggaaacagatgcttctttttagagcacattcttcctgctaaacctgatccctttcagtctaacttgcccatttggggatgtctgtcccaaggacaactctttcctaagaactcccccaccccttctatcctccagacacagtaagaaaaggcatgaatccttcgaaagtcaacaatttactcaagaaatcaacatggccagtgaacaagaggaaaatgctcaatctagtaaataatcaaaaaatgcaaaatcatttttatcccaattagattggcaaaaatcctgtggtacacactgctggctgacgtgcacactggtgtgatctattttggagagaaatttggcagtatctgtcaaaattttacttctctccccttctcagtgtgtgccaagaaaatcaacacagcaggaaagatagacagtaaagaaggaaaccaagaaacacggcatcacagggagtgagtggcgctaggctgaaagtcaagtcaagcggagaaacatacaggactgggtggcagggcggggggaagggggcagtggggggcaggcagtttgtactgtctccattcacatcatctgagccaaaacttggaacacgaaggagccagccctgccaagctctcagggaagatcccaggaatacaagcaatttggtctctgccagaaagagaaaacacctctttctctgtgctctctccccctcactctcaggaatgccactgtcaggagatacaaaaatccgaagaggctgaagcacatctgcagtaaagagcccgcccccaaatgcactgaagggaccacgtcctggacaaagagccctaggaggaggcgctgaagtccttcaagggtctaacacactcagccaggcaaacaatgttctccagcacaatgcagttcccttccaaggaggctcccggcagatggcaggccagggagagcttgcggtggcttctcggcagatggcaggctcctgtgaacacaggcagccctcccttcaggcccctgtcaccacagcagatggctggacagtgggaaccgagcccgggctgagcttggaatgaccacacgaccgctgcatccactcctatgcagatgcagctcagcctcaatccccagagcccagggtcagagagggccccagtaacaagggggaccccaaagggagtgccctctacgtctggcctggctaacctcgatgccatcaaatgctgctgaaaatggcctttcccatcccatgccttcttgtgctcaggacacaggctctgcctccacaagatccaaaccccagcctcatcctcagtgagaccaccaaccggagaggacgcacacaccggatgcgccttggcttggtctgcacggtgccttcaaggttctgaataactggccacttttaaattcaggagcttgcctatctaaaaaaaaaaatgaggccgggcacggtggctcatgcctgtaatcccatcactttgggaggccgagacaggcagatcacctgaggtcaggagtttgagaccagcctggccaacatggcgaaaccccatctctactaaaaatataaaaatcagccgggcatggtggctcatgcctgtaatcccagccacttgggagactgaggcaggagaactgcttgaacctgggaggcggaggttgcagtgagccgagatcacgccactgtactccagcctgggtgacggagtgacactctgtcaagaaaaacaaaattctaaaaaaagagatctctggcttttcctggaagtgtggaagatctgatgacactgagtccacgttcctcatgctacacccagggagtgctgaggaacaaccacctcttagacaggcacgtgctctgagctcaccatggtccccatccaccactatccactcctttaaatcctctgcccaatttgtaactgttgacccgaaagtatccacccccaggcctctgatcccctccttcccctgctgtcacctctgcagcccctccttgctctcaaggttctcttcactcccaccctctgcagcctgcaggccacgcagccctttccattctcccagccagtgtccatctggtttctccaaaaggccaagaggtcatggtcaggcatttcacggagttctaactgactctctggaacagtgtggtgctgcctggggtcagggctattctgtgacccctttgttcctcatccacaacaaaataaatgctgaacccgagaatcagcgtttggaaatttttatagcaattaagtattgctgcaatattcgagcatgtgatcagagtagtcgtctcatcaaatggggtatagaccatggaggcactatcaaactgttgtgggctgagcacggtggctcacgcctgtattcccagcactttgggaggctgaggcgggtggatcacttgaggtcagaagttcgagaccagcctggccaacatggtgaaatcccgtctccactaaaaatataaaaattatacaggcgtggtgatgggcacctgtaatcccagctactggggaggccgacgcagaagaatagcttgaacccaggaggtggaggttgcagtgagccaagatcgcaccactgcacgccagcctgagcgacagtgagactgtcttaaaaaaaaaaaaaaaaaaaaacttgtggcaaggtgcacatagtgtggctgcatattactcatgcacagaggcaggaccacaaatcgatcttctacacattaggggaaaacccaacaaactggtccctctccactaaaagtttgagaagaactgggctagagcaccagttcttctcaccttctaagaggtggctgttcctcaacctgggctctgtaacatccaggccaccttctctgccaagctcctggtcctcctccatccctccccttatccttcactcttgtgctgcctcagccttgcagccctgcattggctaccatggcaaccacatcttctacagattaatgccagctgatacagacggacctcagcactgcctggcaagcttttttattttttttcaacttccaacagataatagcagacctgttaaccgagaggcaagagttacagcctatagggaacacagaagtgaaatctcacataattaagatgactcttgctggctgttcctggcgttgagaactagaaggaaatggcttgggtttacattagaatcagagggcaattagatgtctactcagtgagatgcaggggaaactgaggccaattaaggaagcagtcaatgcccagctgctcatactgactccaaatcatacacccactaagaggcagggcaggcaatgccatcagatcactgctgtgctctccctcccctaccgcacccctccccccaaaataaccgagcacacagagaggaattcagacaagtgaaaatgtatctttaactccacaaggcatctcccatgaactgtctgaaatatctttcttcttcaagatgccaatatgccttccactctcctcctcccaggagatgacctctccaaggcatgtaaccttgaacaagttgcttaacctgagactcagtgcctcatcccattaaatgtcctcatgtaatgttatgagaccaagttaagagaatggcagcaaaacacttcatcaattaaaagtaagtgataagtgaagacttaattagtattgctcatctctgagactaagactgacaagcccttccaacattgctccttccacctcagatttctctgcatttgcagctcagctcaactgttttcctttttactgattttggaggaaatacataaaactctctcccatttcctctatagcccatcctaaatttctttttttttttttttgaggagtctcactttgtcgcccaggctggagtgcagtggtgcaatttcggctcattacaacctccgcctcccaggttcaagcaattctcctgcctcagcctcccaagtaactgggactacaggtgcacgctaccacacccagctcatttttgtatttttagtagagatggggtttcaccatgttggtcaagctggtctcgaactcctgacctcaaatgatccactcgcctcagcctcccaaagtgctgggattacaggcgtgagccaccgcgcccagcctccatccgaaacttctaataaactataaatcccatgttgtgggcacatgcatctgtctcctaaggcactaccacagtgctgggaccggcaacggacctcagcaccgaacaggtgcgctcttgctgcatgaaaaggaggacggaaggagagaagaaaatcaccagatgaaaaacaaacaggcatatgaaaatgcatttattactgaaatgctaacattttcagtagccaaggtggtggttacccttgggcaggtgtggggcagctagaagggagtggagggagcttcttcgggggtggacggtgataatatcctgtttcttgatctgggtgctagtcacacaaatgtgttacctgtgttaaaatccatcaagcatagggtggaaggagggtgaggatcagaaaacactacctattgggtactatgcttactgcccgggtgacaatatcatctgtacactaaacccccgcagcatgcaatttacccgtgtagcaaatctgcacatgtacccccaaacctaaaataaagttggaaagaaaaaaatataaatccaccaagcactatgtttaggattttctgtgtacgtactatccttccacagaaggcttagaaaagaagaatggtgaaccgtccacaaaaaatgaagtacgtcctattcacgtggctgtctagtaaggagatgagcacatgacaggtagtcatgaacttccagccctgcctatgccagatgcaacgggacatgacaactttaaccccatcttgttctcattgcctttaacgcctctttattccacccaaagagacaagcatttgacccagacatcctctgctctaaagtgtgttgcttttcactgtatcttttttttttttttttttttttttttttttgagacagagtttccctcttgtggcccaggtttggggtgcaatggtgcaatcttggctcactgcaacttctgcctcccaggttcaagtgattctcctgcctcagcctcctgagtaactgagattacaggcacgcaccaccacacccggctaattttttgtatttttagtagaggcggggttttaccatgttggccaggctgatctcaaactcctgacctcaggtgatccagccgcattggcctcccaaagtgctgggattacaggcctgagtcaccgcattcaagaccagcctgaccaacatggtaaaacctcatctttactaaaaatacaaaaaattagccgggtgtggtggtgcatgcctgtaatcccagctactcagaaggctgaggcaggagaatcgcttgaacccaggaggtggaggttgcaatgagcagagatcgcaccattgcactccagcgtggggacaagagcaaaactttgtctcaaaaaaaaaataataataaacagcgtctttctctgtcacccaaactggagtacactggtgatcacagctgactgcagccttgacctccaagctcaagcaatcctcccacctcagcttcctgtatagctaggaccaaaggcacacaacacaacacctggacgtttgtttgtttgtttgtttttattttttttgagacggagtctcgctctgtcgcccaggctggagtgcagtggtgctatctcagctcactgcaacctccacctcccaggttcaaacgattctcctgcctcagcctcctgagcagctgggattacaggcgcccaccaccacgcccagctgattattattattattattattattttatatttttagtagagacggggttcaccgtgttagccaggatggtctcgatctcctgacattgtgatccacccgcctcagcctcccaaagtgctgggattataggcgtgagccacctcacctggccatgtttttattttttgtagagatgggttttcactatgttgcctaggctggtctcaaactcctggactcaagcaatcctcctgccttggtctcccaaagtgctaggattacaggtgtgagctactgcacccagcctcgttttacactttcattccccataaggctgcttgttcacacggggccagaaacacagactgggcctaagagtctggagcctggagtctgacctgaggtaatattcccttgcctgttagttctcctaactctattccttaaagcaagtattttaatgtaagactatataaacactccaaaaaaagtcagtggatatttttataattttagagcagggaaaattttcttagcatgacacaaaaaacagaaaccacaaagaaacaaaagatcccagcctgggcaacatggcaaaaccctgtctctacaaaaaatacaaaaacttagccaggcatggtgaggtgcgcctatagtcgcagctactcagaaggctgaggtgggagaatcatttgaacccaggaggtcgaggctgcagtgagccctgatcatgtctctgcacaacaacctgggtgacagatcaagaccctgtcttgaaatgaaaaaagatcaacaggtctgactagataaaaactgcaaactttagttccaaaaaacaaatgagaccaagtgaaacagtcattgcaattaaggcaacaaataaaatattaatattcttatgacataaacaattcttacaaattattttttaaaaaccaacctataagcagaaataatgggcacaggacacaaagtggtcattcacacatatatttaagaaaatacggccaggcgcggtggctcatgcctgtaatcccagcactttgggaggctgaggcgggtggatcacgaggtcaggcgattgagaccatcctggctaacacggtgaaactccatctctactaaaaatacaaaaaattagccaggcgcggtgccaggcacctgtagtcccagccactggggaggctgaggcaggagaatggcgtgaacccgggaggcggagcttgcagtgagccgagatcgcaccgctgcactccagcctgggtgaaacagtgagactctgtctcaaaaaaaaaaaaaaaaaaggaaagaaaatacaggcctgggcgcggtggctcacgcctgtaatcccagcactttggtaggctgagacaggtgggtcacgaggtcaggagatcgagaccatcctggctaacaaggtgaaaccccgtctctactaaaaacacaaaaaaattagcctggcgtagtggcaggcgcctgtagtcccggctactagggaggctgaggcaggagaatggcatgaacccaggaggcggagcttgcagtgagccaagattgtgccactgacctctagcccggaccactgagcgagactccatctccaaaaataaaaaaaaaaaaaaaaaaaaaaatacaaataaatagtaaacataaaggaagatgtctgcacaaataatttttctaaaggcaaatcaatatgctaaaatttgttcaatgtctatcacatgggcaaaaattagaaagccaaacacactgctggctagatacacatgtaagttaagtttatcaggagcatgaagaagaagaggcaagtttcctgggtgaatcgaaacataaaatgtatatggccttccaacagccatcctgtttttatgaaaacataggcacacgcctgtaatcccagcactttaagagactgaggcgggtggatcatgaggtcaggagtttgagaccagcctggacaacatgatgaaaccccaactctactaaaaatccaaaaaaagttagctgggcgtgttggcgggcccctataatcccagctactcgggaggctgaggcaggagaatcacttcaacctgggaaggtggaggttgcagtgagccaagatcacaacactgcactccagcctgggaaacaagaacaagactcagtctcagaaaaaaaagaaaagaaaaaagaaaagaaaagaaaaacagacacgaaaaaatgctcatcatcactggccatcacagaaatgcaaatcaaaaccacaatgagataccatctcacaccagttagaatggtgatcattaaaaactcaggaaacagcaggtgacggagaggatgtgcagaaacaggaacacttttacactgttggtgggactgtaaactagttaaaccattgtggaagacagtgtgttgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccatcaatgatagactggattaagaaaacgaatagaatactatgcatagaattctatgcagccataaaaaaggatgagttcatgccctttgtagggacatggatgaagctggaaaccatcattctcagcaaactatcgcaaggacggaaaaccaaacatggcatgttctcactcataggtgggaaatgaacagtaagaacacttggacacagggtggggaacatcacacaccggggcctgtcgtggcgtgggggagtggggagggatagcattaggagatatacctaatgtacatgacgagttaatgggtgcagcacaccaacatggcacatgtatacaaatgtaacaaacctgcacgttgtgcacatgtaccctagaacttaaagtataattaaaaaaaaaaagaaaatgtaggcaataaaaaattttaaatttctatatggtaaaagaaaataaagcccatcacaaacaaaaacaaaaaacaaacaaaaaactgcaaaaatatgtataacccacaaaaagtgaaagtttgatattctttcctctataaagcattctaacaaagtaatgagaaaaagaagaaccacaaaggaaagtagatagaccagaatattaagaattagctgacaggtagaaagacattcaactatatttgcaattaaatcaaaattaaaacagtaggctgggtgcggtggctcatgcctgtaaccccagcactttgggaggccgaggcaggtggatcacctgaggtcaggagttcgagaccagcctggccaacatggtgaaatcccatctttactaaaaatacaaaaattagccaggggtggttgcacatgcctgtaatcccagctactggagaggctgaggcaggagaatcacgtgaacctgggaggcggaggttgcagcgagccaagatggtaccactgcactccagcctgggccacagagggactctttttttttttttttaagccaactagtaacttacaaagaaacaaaagagacagatgcaaatatgaccacctgccaggtaatctaggaaattcaaactgaatgagataattatttttcagtcaaattatcaaagaataaaaagagtaattaattattatttgttaataaatgacttgaaagcaagaaaaaattggttcaggtgacatgggtggaaagtggcaaggaggggcaggatgtgaacgtctgcatgctgcgtcccctgggtggctgtgcccaggcgtggcccaggcatgaccgtgcagaatttctcgctctttagtcatcagggggactgagagacgtaccaaagtatgatgaaaataaaggcaggcagtggaaataaaatgtagcagaaaaaacctcaagggagagtgcacctctgcctatttgtattaagtagtgcatgtgtggatggtgacacacggtactccagggatagtttgtgctgcttcattccctctccttgccacacaggatcctaatcgagtgtctactactgtactagagagcaacaaagaaggaaaaggcaaggtggtttacacctatgatcccagcgttttggctgaagcagaaggatcacttgagtctgagagtttgagaccagcctgggcaagagtgagacccccatctctaaaaaagtatttaaaaattagctgggcctggtggcatgcacttgtagtcccagctgtttgggaggctgaggcaggaggactgcttgagcccaggagttcgaggctgcagtgagccatgattgcacccctgcactccagcctgggcaacagaatgagaccctgtctcaaaaaaaaaaaaaatgaatgaatgaatgaatgaatgaatgaaagagagaagcaaccagcagagtaaaacggcttgatggtggggagtggagaatactatgtttgaagagaggaaaaaattgattcatctaatagtaaagacagaaagtcaccagcagtagaattataatactaactatactattaagttaatgatatcacgaaatgtaagaaaagtgatggctacacagtaagttctgtttctggagcaaaatgcctaggttcaagttccaactctgcctttcacctgctgtgtgacctcagagcaagttacttaacctcactcagcctccgttccgtcatctgcagaatgagcataatatgaataatagtatctaccctcatggtgccgttaggagggttaagtgcagtgtgtaacacacataagcacccagcacagggcctgacacatgggctgcatgccgctgatgttaaccactgctatcgggggtcatattcagcccatgcagtcctgatcagtgtcatcccagcactgaaagacaccaatgggccaggtgcagtggctcacatctgtaatcccagcacttagggaggctgaggtgggtggatcacttgaggtcagaagtttgagaccagcctggccaacatggtgaaaccccatctctactaaaaatacaaaaattagccagcgtggtggtgcgggcctataatcccagctacttgggagactgagacacaagaatcgcttgaacccggggggcggaggttacagtgagccaagattgtgccactgtactccagcctaggtgacagtgtaagaccttgtctcaaaaaaagagaaaagaaaaaaaaagagaaaaagaaaaagaaaggcaccaatatccacttcctcttggtgtttaaacacagaagctccagctcaagcccatgccctttcctagggccccagtgctggcagtcccagcgcgacataccctacaaacacagcctccagccagaacatccaggctgcctccccctctggtacagattagaatgtcaatctgaacaggcaattagagctactgccagcatggacgctgcagaaaggtccacaggccacgcgggcttctcctccaggcatctctaagtgtccgagctgcaattagatgtcagtttaattccctggaggtgtcggaacaagtggaaaatgccatttgaccgagcactcatttttccaactgacagatgattattctaattacaaaaggattttctttccttttcaaattgctaccacattcctcaaaacggcgcctcacctgatgcgaccacagtgccagcccacagcgtgttctctatgctcaggctctcgctgatcggggggtcgctgtcttcctggaaaagaccaaacggacacacgttcaccccccaaagcttccccagaatccacaggctgcttctagcatggtccgctggagatagaaagacaggctccccccgatgaacctggaagcccagtttggaagccgacggctccaccatgaggggagggccaagctcttccactactgcccttggggttttcatctcccacagaaatatgtgaaaaagttggcctgtgatttaagaagcgcaggcctcttagcactgaaaaatgttttatgaggttaagaatcaaaacgtaaaagcaaaccaatcaggctgtttgcaggccagctttgtttgtggcttatagaaagagaatgtggacaatgtaatatgggttctagaaacctgttgacccatattcctaaaataatttttttttttttgagatggagtctcgctctgccacccaggctggagtgcagtggcgcgatctcggcccactgcaacctccacctcccaggttcaagcaattctcctgacctcaggagatccgctcacctcagcctcccaaaatgctgggattacaggtgtgagccaccacgccaggcctcctaaaacaaattaaatccaaattaaatttctcttctgaaaggtctggaagtggcttaaaaattatgaaaatggcagataggatttgtatgaataaaagaggacaaagtcaggtgtggtggctcacacctgtaatcccagcactttgggagatcaaggtgggtggatcacctgaggtcaggagttcaagactagcctggccaacatggtgaaaccccgtctctactaaaaatacaaaaaattagccaggcgtggtgatgcacacctggaatcccagctactcaggaagctaagacaggagaatcacttgaacccgggaggcagaggttccaatgagccgagatcgcgccactgcactccagcctaggcgacagaaggagaccgtctcaaaaaaaaaaaaaaaaaaaaaaaaaaaaaggccaggctcagtggctcatgcctgtaatcccagcactttgggaggccaaggcgggcggatcacaaggtcaggggatcaagaccatcctggctaacaccgtgaaaacccgtctctactaaaaatacaaaaaattagctgggcgcagtggcgggcgcctgtaatcccagctacttgggaggctgaggcaggagaatggcgtgaacccgggagacggagcctgcagtgagccgagatggtgccactggactccagcctgggcaacagagcaagactccatctcaaaaaaaaacaagaggacacagatccatctgaaggacagagaaagaaaaactctttcagacgccagcgttcacatgaattgcagcaaatgcttcctctaagttgtcaggtcatttaagctgttccaaggccagaagaaaattccagttgtgtcgaccttactgagaaacaatacgctggctttcaaggcggtgccttctttatgtccccacctggcatgaaacaacttcctgacaaagaactgtcagtacttcttggccttcatttcatcccttacacactcccggtgacaggatcccatgtgaaggaagctcacttactcgggtaaaagttcccacgaagttgtgaatgtcaatatttggctcttctgcgtacacatacgatcgaatctgaagaaggtcctgttcaacagaaggcacattcgggagtcaaagtcagttcacaatgcaagacttcaggaggcatccactatgtttccaaagcaactatatttcccacacacagcaaatggcccctcaaaattacaggggaggtggaaagaagaggaaagtcctctgttaagtaagttgaggagtcgcagcatacagtatctcaaagcaccctgacagactctacagtgaagaccctcgtttctctgtttactcagccctttccagacttgatggggtgatgctacacacctatgaataccctggaaagtggcagaccctcctctgctaaattctggcttgcaagacttgtttgtaccattgaaaatactcattcaggccaggtgcagtggctcatgcctgtaatcccagcactttgggaggctgaagtgggcggatcacttgaggccaggagtttgagaccagcatggccaacatgttgaagccctgtctctactaaaaatacaaaaaaattagccaggcatggtggcgcgtgcctgtaattgcggctactcaggaggctgaggcaggagaatcgcttgaacccaggaggtgaaggttgcagtaagctgagatcgcgccactgcattccagcctgggcgacagagcgagactccgtctcaaaaaagaaaagaaaatactcattcaacaaatggttactgggcatctactctgtataaacctctgggaagagctgaaaaaagtaagaacgcctcccacccgtaaggatggctgctatcaaaacaaaaacaaaaacaagtgtgaagatgtggagaatgtggaggccctgtgcactgttgctgggaacgcaagatggtgcagcagctatggaaacagcacttcctcaaaaaattaatcagaaaactaccatataatccagcaattccacctccggctatatacccaaaagaaatgaaagcagggacttgaagtgatcatctgtccacccatgtacgtagcagcattattcacaatagccaggaagtggaagcaactcaaacaagcatcagtggatgaatggataaacaaagtgtggtctgtccatacaatggaatattactcagccttaaaaaggaagaagttctgacacaggctacaatacggatgaaccttgaagacattatgctaagttaaataaaccagtcacaaaaagacaaaaactaggtgattccacttataggaggaacttagggtagtttaattcatagagacagaaaacagaaagatgcttgccaggggctgggccaaggggggaatgtagttactgcttaatgagtccagagttccagttttgaaagatgaaaaaagttccgaagatgaacacggctgatgcctgcatgacaacgtcaatgtacttcatgccactgaactgtacacttaaaaacggttaggacgatagattttatgttatgtgtattttagcacaattttttaaaaagcaaacaagaagtcaaccttaggtgataagaaagcccaaaagtgaaagatcttggcaaaaactacatttcaaagcagcatatgtgaagtggcgtaagacaggcacagtcagggggagcagcagtcactgttagaacagtgagtttctaactactgtctaggagcccctggggacttgtagcagccaccatcacgtgaagtggggctggagggggagcgtggggtcctggagagcccctgggaggtggtggctcgtgcctgtaaccccagcactttgggaagctgaggtgggtggatcaattgaggccaggagtttgagaccagcctggccaacacggtgaaaccgtgtctctactaaaaatacaaatattagccgggcgtggtggcgggtgcctgtaatcccagctactcaggaggctgaggcaggaaaattgcttgaacccaggaggtggaggttgcagtgagccaagatcatgccactgcagtccagcctgggtgacagagcaagattccgtctcataaataaataaataataaaataaaattcctggtttaaaattaacagtaataatggtgttatttcactttttattatccatgaaaaatcattcatagggtggctacatttcttgttacgtcaatcccgccaagacatggaactttcctcctccctcaggggacacagtaaggagtggcttcgatccatgtgacgtgagcacaggggaagcttctgtgttccacttcatccttccagaccacagtggggcatgccactcaccaggcacttaagttacacatggccaactactgcggccatcctctcagccagggcctgcgccccatcatacacactggggatacggcagagaatacaacaggaagaacccacccgcagggatgctgcctggaagtgagtgaagcagggatgcagggagaggtgggcagaaagagcctctccgataaggagaatcgtgagcaaaagctcagtggagtgcggagatgccctgccaggcagactcgccagggatcagagggctcccagtggaggaaatggcaacagtaaacatccagggacagaatgacagacccgacaggctggtaggcagaggagagagggccaggcactgaggtcggagcctctgcagagagacaaatgggaaggagctgaagacgacagcaagcaccgcagaactgattctcagtaagatgagaaatctttggagggttgttttttttttattttatggttattacttttattagatacaggtgtcactatgctgcccaggctggagtgcagttgctattcccaggcacaatcatggctcactgcagcctcgaacccgcaggcttaagcaatcctcccgactcagcctcttgaggagcggggactacaggtgcatgccgctgagcctggcctaccttcgtaggttttgagcagaggaatggcatgctctggcttaccttttcaattttggtgaggccccttggcaaggctccttatggtttttagcttcccgcaggagagctcactccctgcactcggggtctgctttggtcacgtcaggaaagccaactaggcccaggggctctccaggaccccacgctcccctactggccccacttcacaagttgccatcccatgcctggccccccaggtatgagtttgagaaccctgctaagataggttgcccgcatgggcttctgcagggaaagctactcacggcggccgtggggagcctctgcgtgcaggccacgggaagccgcagcttccagtccgtctccccatccagctgatccgtccgcaagaagcatgaccctgtggaaggaagtcgggtgccgtcacctgcacctcaagcacccttcccttggcagctctgggcagcgtctgctctggtccttgtaaaaacagccaaccaatggccagcgaccacaagagaaaatacatatcctatctcctacttcttccataataagctctggggtcaaaaagctcagagttcaaatcctcactccgccactccctctgagtgggatccccagctagtttcttggacttgtcaagctttagtgtctgtaaaacgtggagaaacgcagacttcgcaagcttgctgtaaagattcaatggggagatagaacggggacgagcacaggttgaccagcattccgagccgtctggccaggcatcgccagcaccttctcaggacccaaaccacctgagtgcaggtccaggctctgccacgtaatagctttgtgccctgagagttgcctatcctctctgagcctcagtttcctcgtgtgtaaaagtggagataggaacagcactgaccctgtagagatgttgtgacaattaaagagctgattcgtgcgcagagttcagaacaggactgatcgatccaggcaagcactaggtcattatgggctggcacatttcagaggtgtatctttcagtctgacatacagatccgtgcaagtagtcagctgtatactccatcagatacagaacataccccattcactgccactgcagttcagtctttgagaactattaatgtagaacactcataattttggtttgtttgtttgttttttcaagaaaaaaagagcatgtcaggggccctactccataatgctctgttttcactaaataggacacaagaacgaatttaaagacaaagctgcagtttttcaaaggctgttttaatctagtgccttttatctcctgtcctgattacatattagtataaaattttacttgtactttaattctattcataatgaaatacgttgcagcatcctcaaaggaatacgaatgtaaatttttcatgtattcaaaaaacctccgatcatgccagataagggaaaaacagccttatttcctcagaacagcttaaataacaaaaattaaaactaaggccattttggccaggcgtggtggctcacacctgtaattccagcattttgggaggccaatggatcacttgaggtcaggagttcgagaccagcctggccaacacggtgaaaccccgtctctactaaaaatacaaaaattagccgggcatggtggtgcacgggaggctgaggcaggagaatggcttgaacccaggaggcagaggttgaggtaagccgagatcgtaccactacactccagcctgggcgacagagcaagacccggtctcaaggaaaaaaaaaaaaaaaaaactaaggcaattttagtagactcatagggtgggcaggcaatgacagctgccaccctagggaacaactgcaaggagttaagggccttgtaggagacttcagagattcccaccccacaaactcaggctacaataaataaatcaataggtgctataggcaaggtcccctgactcatgaacaaagggcagaaaagacgcccacctctccccagtttctgtactgcccccatcatgacacatctgctggtatcagcttagaagagaaaggatttctgtttacttctacatggtagagacacttcctcgtcccaactcctgaggttgagcttaacacagccgggagaggaaatccaaagccactgtatgcgtgactttaccagctgtgagtcagccggtgttccacaaactgtattttttaatgatcacaatctattgacttttaaaacaccaacaacactgtttaaaaagcacggtctatttaaaaagatgcttttgatttgcctccatggctccaaaatgataatctactttgtgacattttcaaatgattattttgccaaattaccactgaaaggttaatggttattttccaaattgatctcagatgtttaccgtttttttctgatgtcctcaggaagatcatgtcggcagggacccgctggttctgtgttatgaaaagaaagactgttactgtgaatgaatgaccgtgtgctgtgcggtggggaggggggcttccgcccccacccccaacccctcggtgggttggggcaggggggactgaaactcacagactcttttacgtttctgcctttgtcaaagacagatttggggatttattttgttttgaatctgaaaaatcttgcacactgctgctactttactaatcccctatcaaaatcttatcttggaaagagagcttctagttttctggcacattcaaccattacctcccaaaatcccaaaagcctgcctccccagctggctctcttccaggctgtctgctgagactcaagacagaccctcctctctcgctttctgcttctaccaacttaccagcttgatgtttggcttttagtggattttaataaggaaggaaagtagtaagaagcaacaaaagccattctaaaaaaaactggggggtgtggggagccagtagcccccatttaattatgaacagaaaagtatgtgataacatagatgggggttgtgtggttcttctgagctgccacccaaaagagtttcactttaccttaaagcagctttgagttcttggatttaatccctttaaaagagcatagctcaatttctacagaaacaagttaagacacaacccttttctaatcaaatattattccaagcctctccagagccacccctcaaaatccaataccttccaaatatacacactagaaaaagacatgagtgtttgctaaagtagcaaacatactgacacggctattttttaaaatgtatttttggtctttttactgttctcaggttacacttaacccctgctccccataaaataatagacaagcacaatggttaggtcaggaaatgcaagctaaaatggctcaaagggtaaattagataaatattttaagtgtctatgtagtaagcagacttctaggaaaaactttatgatattttttatcccaaaataataagcacatcgaacaggaaatcaaaacttgtacttgtgtttgtaagcaggatttctggctaaccaacgcatataaaccttgaaaaaatatttgtgtgtgtgtgtgtctgtgtgtgtgtgtgtctgtctgtctgtctcacaggaaagagatttttctccccaggcaaagtttttggatagaatcccaaaattcaacattcacttcgtctaccagatacacaaatgacacattaggacccatgaagtggtatccacacacaagcttccagattctgctcaccttttcaacgatgataaggtctccaacttggatgttagaactcttcaccttcactgtgcctgcaaagcagcaggttcaagatacatcaccatcttaattcatttcaattcaacacgtctttacagagtgcccagcctgcaaacacacaatacacccagaagtacacgctcccacacacagctgccagtgactccagcaccattatttcctgcctctccaggaaagggttcaaccgctacagaggccgttgcagaaataaatgcccacttcacagggcactggaataacttcagcccttcatgaaagatcatttatttgccttcagagtgacttagatggaaagtagtggggggaaaaaagtcttaattttcaacaccacttaacagtgacttagatgcaaagtaccgggggaaaaaagtcttaattttcaacaccaccaaaaagaaagaagctaactaattccaaatgactgatttactttttaatttataattgctacatgctttgatttataggattatgatcagactatataatttttgctggatgtttagataaacagtaaaagctaacattaaatgctaattctgtgctcagcactgtacagattttgaaggtttcatttaatcttcacaatagccctcagaagaaggtagttccatctccagctttcagacgaggaaaggagactcaggatgtcccaccttcccccaaagtctcagagttagaacaggtcagtgctgggattcacacctgcatctgactccacagtacagaataaaagcagtgagttccattcaacccaaaaaacatgactgggccaggcacagtggctcacatctgtagtcccaggactttggaaggccgaagcaggcagatggcttgagcccaggagttccaaaccagcctggccacatgtcaaaaccctgtctctaccaaaaacataaaaattagctggatgtggtggcacatgcctatagtcccggctattcgagaggctgaggtgtgggaggatcgcttgtgcccaggagatagaggctgcagtgagccgtgatcatgtcactccggcctgggcaacagtgagaccctgtctcaacagccagacagcatttactgaacgcctgctgtatgccaggcgttctaagggctggggatacgtgaaactcaattccagtggaggggaggaggcaataaacaaataatggatgaaaggggttggagaatcagaggggtggctgtcaacaaactctgtgggagagttgaggccagaattagacagacgaaggacactgtgtttaccaataacagacgaaaggcaccctgagatgtgagaaagtgggacaggtgaatagctaacagcatgcacacggccaaaggctagaactccttcagcaagacgtaaagcatcaggaaagcagggaacagcgagagatgaaagtggaaggggccagttggggccaggtggccccacaccctgtgagggagcccagagaggaagagagaatttattctggtgataggtgaaattcacatacaggagcaacaccacaaaatctttatgatgctgctatcttgtaacaagcccatgtaacttacaaatgttcagctaagagagagataaaaagtaattataggccgggcaccacagtggctcacgtctgtaatcccagtactttgggaggccgaggcaggtagatcacctgaggtcaggagttcaagaccagcctggcaaacatggtgaaatcctgtctctactaaaaatacaaaaattagcaaggcatagtggcaggcacgtgtaatctcagctactgaggcaggagaatcgcttgaacccgggaggtggaggttgcagtgagccaagatctcacccttgcactccagcctgggcgacacaagcaaaactcaatctcaaaaaaaaaaaaaaaaaaaaagaacttaaagacttaaagacacgaaataatataagtgcacaactctagacttttagtgtctcacatattttacattttaacataatttaatatcatttattttttaagtatttcactaccattgagatttttcagagcattccaatgttttcctattgaaacaactctctttaatcggttccataagatttgtttttaactaatttttgtgtgtcgttaaatcttgtcattaaacaataagtagaactggcatcaaaaggtctgatataaacactactgacttctgacttctttttttttcttttttagacggagtctcgctctgtcacccaggctggagtgcagtggcatgatctcggctcactgcaacctccacctcctggattcaagcgattcttctgcctcagcctcccgagtagctgggactacaggcacccaccaccaagactggctaatttttgtagttttagtagagacggggtttcaccatattggccaggcttttctcgaactcctgacctcgtgatccacccgcctcggcctcccaaagtgctgggattacaggcatgagccactgcgcccggccaacactactgacttctagaaagcactcaactaacaatggcgagctgaactaaccctcgatcgctggtaagacttctggactctcctagtgtgagtatttcaccctactaagtgagcatctagcatctaatggcacctcattttcataaaatgtgatgctaaactcaattcagtgaccggagccctggcctgctagagagagatccactggcctcctttcattatgtcttgggctttggtcaatacatttacagagagactggagaacatccaattagatgattagaaatgggtaaagaggccggacacagtgacccaaacctgtaatctcagcactttgggaggctgagacaggtggaccacttgagcctattagttcaagaccagcctaggcaacatagcaagaccctgtctctacaacaaacacaaaaaatcagccaggtgtggtgatgtgcacctacagtcccagctactccggagactgaggtgggaggaatgcttgagcccaggcgaccaaggctgctgtgagctgagattgtgccactgcacggcagcctgggcaaaagaacaagaccctgcctcaaaaaagagagacagagaaagagagagcgccgggcatggtggctcacacctgcaatcccaacactttgggaggccgaggcgggcggatcacctgaggtcaggagtttgagaccagcctgaccaacatggagaaactccatctctactaaaaataccaaattagccagatgtggtggcacacgcctgtaatcccagctactcgggaggctgaagcaggagaatcgcttgaacccgggaggcggaggttgcagtgagcccagttcgcaccactgcactccaacctgggcaacaagagcgaaactccgtctcaaaaaatagaaaacagagagggagcgaaagaaagagagaaatgggtaaagagacggtctaattggcagaacgatttcatggcctgaaccactcttcttgctccactagggggcaaaaggaaaaatgaacacagacctgtcgtttttctgggagctcaggaaggtattacttgaaggaagaccgtaaattcaacgtggccctcagcgccaatgaacttttccttcacctgagcttgccccaactttcccaaacataaatttacacattgtctttggttttattactaaaatttatgctgctgacctggcccaaatgatcacacccgggttcagatcttcaagctctagttacaggttccctcttaaaatctaactcatagaagagcatgtgttttcattcttattaaataataattgcctatgtatatgtgtgtacattagcaggacagaggacaaaatcagggagatttcactaaaaggatcagcagggctttctctggcacatatattttccaaatttttcacatgaattgtttttccattaagcgtaaggttgctttcctaagaagaaaaaaataataattaaaattagctcaaatttttaagtgaccagacccagatttttcccttctgcaagtgagtgctgatttatgatccattcatttgaactctgcctctctctgtccatctgttctgcctcaacaaaaacccctttaatcctctgtgtttgcagagcagtttctgagtaaccccagcaggccaatccttcatgcaaacacacctactgtacccaactgtccatcagccaacagggctcttgctccacctctaagggaggaagcaaggagccacaccatcatgaggtcacttgggatttttagccacggtcattcattagcattgcagtgttttgaggggatgagcctcggatctgcagcttgaacaaacacagattcccagactctccccttctgttgagctactgcagagtgctgtcaatttggacttcttgccccatgttgtcttttcttttggtgatcaaaaacacgtagtttggctgggcacagtggctcccaatcctagcactttgggaggccgaggcgggtggattgcttgagcccaggagtttgagaccagcccgggccgcatggcaaaaccctgtctctattttttaaaaaagttaaattaggccaggcgtggtggctcatgcctgtaatcccagcactttgggaggccgaggcaggtggatcatgaggtcaggcgttcgataccagcctggccaacatagtgaaaccctgtctccactaaaaatatataaaattagccgggcgtggtggcaggcgcctgtaatcccagctacttaggaggctgaggcaggagaatcgcttgaacctgcaaaggcggaggctgcagtgagccaagaccgtgccacagcccgggtgacagtgcaagactctgtctcaaaaaaaaaaaaaaaaaaattaaatatctatagatacatagtttgggccttcatgcttcatggtgtgtgtgttcgtgtgtgtgtgtgtgtgtgtgtgtgtgtgtgtgtgtgtgcatgtaatgagagaaaatacaaataaaaccagaatgaaaaggagaaaaagcagcaagaagaaaagagataaaaaagcagatactgttatttacattcccatatttactgggagttttccaccagccaggccctaggcttggctgtcagtatttgactaaaatgtccctctccaaggagctctcaagttggtagggagaaagagggagagaaaagagagaccaaagttagaagtgaggaatcactgggcattcagtggtcagaactgactcccagaatgaaaaaatcggtaagggtgtggaaagggcccaaaacacatgatttctaacttcacagcaaccactattctgagtcttctacgaacattgttgcaaaaaaggggaagaacaagatacggagaagtaacctaacagaagggttcttgtcttcctaagaaagtaacagcagaaagaaaaaatagcacattgatagcaattattaccaatctcaaaaaagggcaggaactctccctacaattgatctgacagaaaagaaaatgccctcctaacaggcctccggcaggcacacttcccaagcgctccttggtttttttgttgttgttttgttttggtctcatcttccccagagactcctaagatggaaaaaggaccaatacactcccagcttgggcgatgcttcactgttaatgtcttaaaattcttggtcagttttgtgtttttttaaactcaagatctaaccacctgatcttaatactttttgaacaaccccacctcccaccacaattttcatttttcactgggtcccacaaattatgtagctggtccagaagggaagtaaaaacacccaataatatcttcttataaagtgcacaggaaaacctggccctgtcctaagaaccgaggccacagaactctgaacttttcctgtaacaccccatctccaatatcgaggctccaagatttttaaacgcatttgcagaaattctacaaaggtaagagatttttgcaaaagttaagcggaaaattctctgcctgccacatcctaaatcattaaaagtcttctaataaatctatccctttcagctttcgccacttcacccaagtcgtctctcaatcagagtttgtaacggggaacaaatttccaattattagagctgtttatttctgtagcgatggacccccaagcctttcataagcaaacctattgagcccaaaccatgcctttcatggatgacagcttcagaataagagcagtttgtctacattgcagggagaaaccagatgtttcccttgagtcgaaacaagcaaatgacaattcagtcaaactgcagaatagcctaccaaaaaaattttttttaataaattccagggcagtaatatgtgtgggcctattttttgaccctgaacacctccatctatacttgtatttttcattgttcatgcagggcactgattgcttttgtagatctctaacaacaatctccatgcactaaccctggttaatgtattactctttaactcacactctaatctaactgtgacagtgatgagttgtaaattctgcttcatgtgtacatttcctgaggttgacattaaaacgcctctgcagacccagcagagttcagaggtttaaagttgaaattttcatattcaaatagagttgtctgcattccccaaagccaaagaaaagactgttatttgaaaacaggcaaagagttgaaaggattattataaataatcactaccacttcctggggcttttgtttaaatagtgggaacttaaaaaaaaaaaaaaaaaaggctgcagtttaaatgtaacaagtttatacccaacagtggcttttaaaataaatatataaatggtcttgccggtttatggtgcccagaaatgatgaagtagacgaacacccttacaggggggaaataaataccttttgggaataacagtgcaatttgcaagtttgagtttctggtgttttgttgtttttttttttaattaaacaatagatcagttcaccaatgacttgtactaaaatgaaattgagtactttgaaaggaaaatctgaactttgtggatcttaaataactttatatctgggcggggcacagtggctcaggcctgtaatcccagcactttgggaggctgaggcaggcagatcacctgtggtcaggagttcaagaccagcctgactgacatggagaaacaccgtctctactaaaaatacaaaattagctgggcatggtggcacatgcctgtaatcccagctactcgggaggctgaggcaggagaatcgcttgaacccagaaggcagaggttgtggtgagccgagatcgcgccatcgcactctagcctgggcaacaagagcgaaactccatctcaaaacaaaaaacaaacaaacaaaaaaaaaactttatatctgtaccaggcagtatgaaaaagtattcagcaaaatctgttataagtaagattcacttgtacctgctgatgctctgaatctcagacaagggaaatttgggaagggaattctttgctcactgaattgtctttgaggtccttagtgaaggatctttgcagcagttttgctgcagtaacattgaaaagtctatccataccattctcttctttaaaaaaaaatcataatgcatatcttagtgttctccatgtctggacagagcttatactttgaaacataagtagtacttgggtttaggaatataaagtttcaatttaattattagctaaacaattccccattaatgaatgcaccttccctacattattataccttctgattaaccacaatgacatacaactccaaaaaagaaaaaggtgcattcttaggtcttgaaatttaagtcacattaattgcaatcctagataatggtacaacatgggttttgtgctacactgaaaaatttgttgtctcttgttactcaagagatccttgaggttacaggtgattctgtaaatgagaaagagtaagcagagagcatcactcaactatctagaaagaagtggaaaaggaaagatatcaggtcgattttttataccacatatgtaggagaaagctgaagatacgcaaaagagcatagatctttggcttatgacttatggtcagcctgcccagatgtccccagcaggaaagaagcatcagcaattgtgttaattatgcctctgtttgcacttctttcaaggctaattgtccgcttgcttcatttagtccttgatcagaagttagtctgggaaagcattcctggtatgaacacccatggaattcatcttgtgaaaatgcaaatcccattttcctcaccacctgtgataatcgaggcaaccccccacccccattaaacttttggtttggggaaggcaagtataaagagaaataattccttcactaattattcttttccaatccaacccaattctcttgagtaacaaaactaagttttgctgggtctgctacatctccaagatcttctcctttctggctttatttccagtgccactgaatgctattaatttaggaagacagctctataattaaaaccataaaaactcataaaggtctaagaactgctcttaagtctctgatgtttaaatgtgaatttgtaagtaggaggaaagggatgcttgtttatccaaaagcactaccccatgtggttttcaacagtttgtccatctgacaatgaggaggctagattgataggtttctttggactcagagatgtgttttaaaatgactcaaatcttaaaagcacccctgtagcatatgtattaaggctgaacgctgtagcagttgttgagatattatatgcaaaagtgctgagctcacctcctggcacatagtaggtaacttgacttaaaggctaaggttttacatgcaaacaagcctgggttcacattccagctctgccttttgctagctcatcatccaagacaggatgcttttcctctattttgttataggggcctcagccatgaacctagcaatgagtgagagaaagaaatgttttccttccctacatccacacccataaaagctaccttcacagggctatctagaagactacagactaggctgggcacattggcttatgcctgtaatcccaacactttgggaagccaaggcaggaggattgcttgagcccaggagttcgagactggcctggtaacttcatctctataaagaattaaaaagttagccaggtatagtgacatgcaactatggtcccagttacttgggaggctgaggtgggagaatcacttaagtctgggaggtagagactgcagtgaactgtgactgtgccactgtactccagcctgggtgacagagtgaaatcccatttcaaaaataaagaacgaaaagaaactacagattaaaccttatctagcacctggctagctgatggcaggtagcctttcttcattttttctcctgcttcctaatttgaacagcagtttttcaaacagctcagtgccacctttttcctatagcatgcctgtactgtatatgaattcttcaaacacagaatcaacccttccatagcctcaggttctcactggcctgtgtggtcttctctggagaggctcaggaaacttcgcctaattgggaacagcaagctgctgttggaacctggggttctgtagcctgccaccccagccgtcacaggctgcagctttgcattcgacttgatgctctttttggagaactctttaccagggcatgccatctgggtcctggcctgagttccatgttcaggtgggtcccgtacttggtttaatgccctgctgttgccatcttgagattcttaataatttctgaataagggtcccacatgttcatttgcattgggtcccacaaatcatgtagccagtcctgctctcttccctcctctaagactcaagatgaaggtcacctcttctggaaagacatcaccagattctctctgatggactcccatcacccctggctcatacctccattaatccacccactgacacttaagaaatgcctgcttcaataccatccacactggcctctctccaccatgccaagtcccaaggcacagtgctgagctcttcccatgcaagagcttcacttacagcaaccctttaaggtaggtgctattattttccctgatgtagattcatttactgagaacttaaaggatctacccaggtggaagcaggactcctgaaccctggcagagcaagtttggagccactactttcaactcctgggaacgatgctcagaaccgagaatgcagtggccagaaaagggacattccttatgaggatcaccacacttattccactttttgtaactatctgtctacaggcctgaacgcctcactggattataacttcctgggaccccaggctctcacgttcatctctgtgatgcagaaacctagcatagacttggtacatgatgaagtctcaactgtgtttgtgtgtgtgtgtgtgtagcgtgtattttagagatggagtctggctctgtcccccagtctagagtacggtgatgtgatcatggcttactgcagtgttcaactcctggcctcaagcaatcctacctcagcctcccaaagtgctggcattacaggcatgagccactgtgcccaaccaaatatttcctaaaataatgactaaaaggtcatttccatgtagatagctaatttgattatcaaagtacttcaaatacattttattaagccatggcagttgtatcaaaaattaatccaattgatgttgttcgagatacaccttggctgggcacagtggctcacatctgtaatcccagcactttgggagggtgaggcgggtgccatcacttgagctcgggagttcaaaaccagcctgggcaacatggcgaaatcccatctctatgatttaaaaaaaaaaaaaatgatacaccttgattgaaataaaattatctaaaatgttgaaaactaaaacaaagcaacaacaataaaaaaacctgtcatccatttttcctcccaataatgagttcctattaatgaggattttaattcagctgtttaaaattactggccaggcatggtggctcacacctgtaatcccagacctttgggaggccgaggcgggcgggtcactcgagcctaggagctcgagaccagcctggccaatatggcgaaacctcgtctctattaaaaatacaaaaattagccaggcatggtggcgcacacccgtaatcccagctgcttgagtggccgaggcagggagaactgcttgaatccaggaggtggaggttgcagtgagctgagatcacgctactgcactctagcctgggcgacagagcaagactccgtctcaataaataaacaaataaataaataaataaatctagttttgaggccacatccaacaaatacaaatggagggacaggatacaaagtaactgccttgaaactggcctgtcctcttcgaaatgtcaagatcacgaaagacaaagaaaaccgaggagctctgccaggctagagaccaaggagagaggacaactaaatataactgacaaacctggtctgttcctgaactaagaaaaaaatgctatcaaaggacattttagggacaaatagcaaaattttaaaaaggattgtaaattagattaatagcaatatattgatgctcaatttatttgattttggtaattgtacataactgtgttatataagagaaacgtccttcaaggaattaagcacttaagtatttaggcacaaaagggaatgtctgcaacttgtctcaaatgaccccagatatacctatatgtatatggacattgggggaaacaaaagtattaaaaagcaactgtggccaggcacagtggctcacacctgtaatcccaacactttgggaggctgaggtgggccaactgcctgaggtcaggagttcaagaccagcctggctaacatggtgaaaccccgtctctactaaaaatacaaaaattagcagggcatggtggtgcacacctgtaatcccagctactcgggaggctcgggcaggagaatcgcttcaacccgggaggcagaggttgcagtgagccgagatcgcgccattgcattccagcctgcgcgagggggttcggtggggaagaaaaaaagcaactgtgcagcctgggcaacatggcaaccccatctctagaaataaaaaatagaaatttagcagggcgtggtggtgtgcacctgtagtcccaactactcggaggctgaagtgagaagattgcttgagcctggaaggcggaggttgcagtgagtccaggtcccaccactgcactccaacccgggtgacacagtgagatcctgtctctaaataaataaataactgtggtgaaatgtcacaattcatgaatctgggttaagggcatattggaattctccatataattcttgcaaattttttgcttgttaggaattattgcaaaaacaaattttaaaatttaactacaataatacaagtactgctattattattcatcataaaaggatgtagcaggtaggtaaataccatggtctataatctagtgatcaaggcattctgactcctggccattttcaccccacaaaatactgttgaaaagaacattttaagacctcatgtgaggccgggcacagtggttcacacctgtaatcccagtactctgggaggctgaggcaggtggatcacctgaggtcaggagttcaagaccagcctggccaacatggtgaaaccccatctctactaaaaatacaaaaaattagctgggtgtagtggcatgtgcctgtaatcccagctactcaggaggctgaggcaggagaatcgcttaaacccaggaggtggaggttgcagcgagcgaagatcgcgacattgcactccagcttgggcaacaagagcgaaactccgtctaaaaaaaaagaaaaaaacttcatgtgatagaaagaaaacagtccatcatgaatatactcatacatacttatttcattttgctttggaacttactaagtgaagatggtgaagtttttgctcaaggaaatattatgaaggaattcgacaggaaagtcaaaaaaggcttctttttctccctcttccctgcaatctcccagtttaggtttgctactctggccctccccccaaaagcgtatcaaataactaaactcgcctcgatcactttccaagctgacagtttcttcagtgttttgctgggctttcacaacaaactgcagcgctagggtctgggttaatattcagaactgtgttctgttttccctagagtgggattggcataacaatggacaccaggggccgcaaagagagacccacaaaggaagacaagtttttaatgctagagccatctgccaattctccttaggactttctcaagagctgagtgaagttgaagcaagagctgggaaggggcgtgcagtggagggcagaaaaatcattcacgggaaaagcaattgcaatatgaaaagaaccaaaggagggtcgaagcccggatggatgaatgaatggaatccgaaggcctcttctcttgagctctgaagagatccaccgcactctctccgatggggcttttgttggttgccaagcgttttaaatgttatagtaagaatatgttattaagggaggatttaatatacacgaaccacacacaaaaaaagccctccagaagggtcttctgactactcacgcagaaagcccaagccacctgcctctgcaaagattacactgattctttttcttttggtagcaacatgtcctaaatacagtagtttagcatgaataaagcatttctttaccaactctaaattcccccttctcccagagatgtgcatatttttaagaccaccaaccacgacaatgtattcaaataccctaaaacaaagtattttcatacccttgggaaatataattaaaatctgcatttttttttagcccaaaacatacacctttgacatttttcccaaaaggaaaactctactgaaaaccccgaaggaaccatggatggactgcttccttggaagcataaagcacttaaacagcagttcagaccttggctcaggtgctaagtcccttggcatctaaccatcttatctctttccaaattctcaatttcctgaaggcaaggcatagcctttattcccctccacctctttaaacagcattaatccctgaatgggatcagtcatcttaggggacaatcgaatagactttccttggccagattagcaaactttaggtaacattctctcatttctgaatgcaaccttacagtaaatctattgtagtcagacacagacatcaacaatggctgggttgttttgtggcttttccaccgtgtgtttcagtgggtttttaagttctagcatttaaaatgcacatatcttgcaagtggggggtcagtgattaaagctttttcatatccctgggaaatattattaaaatttcaatttcaattttttttttttttttttttttgagatggagtttccctcgtcacccaggctggagtgcaatggcgtgatcttggctcactgcagcctccgcctcctaggttcaagtgagtctcctgcctcagcctccggagtagctgggattacagatgaatgcaaccatgtccagctaatttttgtatttgtagcagagacagggtttccaccatgttggccaggctggtcttttttttttttttttgagatggagtctcgctctgtcgcccaggctggagtgcagtggcgcggtctatgctcactgcaacctccgcctcccaggttcacgccattctcctgcctcagcctcccaagtagctgggactacaggcgcccgccaccatgcccggctaattttttttgtatttttagtagagacagggtttcaccatgttagccaggatggtctcgatctccggaccttgtgatcagcccgcctcggcctcccaaagtgctgggattacaggcgtgagccactgtactgggccaaaatttcaattttttgtttttgagcccaatacatataactctgacatacacaactggtcatttatttttggatcagactccatgctctgcaggcctcaatttccaggatttataaaatgccttcaaagaaatcttcatggatgcagttatttatctaaatcggttgcctttctaaaaactaaagtagcaacagtttaatcactgccaaaagagtatctttgaaaacagtttgcagcctctcatttgaacagcagaggcgccctacttccctcttcagccaggcggcagaacgggaaagggattagccagctgggatgccagcacacaaaatgtaattccaggtttatgacacataagttatttgacaagaccaacaccaagaggcctgtggatgctgccagggcctggtgggaccccgtcaacctgtcatccagggcagatggaggcctccctggtgctggagtaaccaagcgactgttccgccacgtggcattcccacacctgcggcccgggccttgaactcttctcccctgactgtcagcggcccgtgattgagctgcaaccctgtggcccaggagccagaaggctgacctcgtgctgtgagccggctgtagacctgggagttgacttccttgtcccgcacgtagcatcggatctcctccaccgcctcacggatgacagtgacggccagcacgaagccctgcagagacagacgacagtgagtcttgctacaggcagtgagccctgctgcagccaaccgtcccctcctggtgccaggggcaggaaaggcgagaggtcacttgggagggcaggggggcaggacctgtgagttattccaaatgcacacgccgctgcaagccccctctctgaatctgtcttagggaacatgcactcccaaacacaacctgtagaaacactaccctagagaaacactcactgccacacacacacaagcacgtccacattcaccacctcagggtgagggtgacacacacaggaatactcaaactgtccctccacaagcaaacgatggtgactactaatactgtctctcacccaccatgtgctgggcagtattggaagtgcacttcatcctcataacaaccctgagatatgctcctataactgagatccccatgcagatgaggaaactgaggcacagagaggctgagtaatcttgcccaaagacataaagctactaagtgataaatgggaactgcaatgtaggaaatcttaatctttactgccactgtatctagagaaacttaggtggatggagccagtaagagggaccaccaggcaacagttaaacagaataagatacatccattgcattcacagagccaagtggaaaaaatccatctttcaggacatacactgcaaccccattcatataaatagcaacaaagattctatacaattaaatgttttccaatttccttaactacaggttagatttctctgccgggaaggagactagaattaggatagggagggactgaaaggtgcttcagcctatctgtaatgtcttcagttttttgttttgtttgtttgttggagtctcactctgtcaccaggctggagtgcagtggctcgatctcggctcactgcatcctccacctcccgggttcaagcgattctcctgtctcagcctctcgagtagctgggactacaggcacgcaccaccacgcccagctaatttttgtctttttagtagagacgaggtttcaccatattggccaggatggtctcgatctcttgacctcgtgatccgcccacctcagcctcccaaagtgctgggattacagggcttttttgtttgttttgagatagggtctcgctctgtcacccaggcaggagtgcagtagcatgaccttggctcactgcaatctccacctcccgggctcaagagatcctcctgcctcagcctccggagtagctgggaccacaggtgtgtgcgccaccatgcctggctaatttttgtatttttggtagagatggtttgttgttgttgttgttgtcattgttacagagtctcactctgttacccaggatggagtgcagtggcaccatctcggctcactgcaacctccgcctcccgggctcaagcgattctcttgcctcagcctccccagtagctggtattacatgcccacctaatttttgtatttttactagagacagggtttcaccatgttggccaggctggtcttgaactcctgacctcaggtgatccacccgcctcggcctcccaaagtgctgggattaccggcgtgagccaccacgcccagcagagatgggtttttgccatgttgcccaggctggtcctgaactcctgagctcacgcaattcacccacctcagcctcccaaaatgctgggattacaggcatgggccactgcgcccagctgttttaagtttttataaggaaactctattaaagtattaattgcataagtagaaactaataaaaattttaaacttccccaactttcctctgagttgggaaccccaactcataatatctggttgggtggagggagtcacccatagcagaatctacttccaatctagatttttttcctcttgtaatcaataaagccaaaatcattcatttattttacttacttgtttacagtcattcgttttccttgtcattccttcccctatccccttttaaagcttgccaggacagttattttttaaatacagtcagcataaccacccaagggttagcagttgtggttcttggagaatttcactttcatagtttaccctgtgaaatatattaacttcgattcaaaggactttaaatctcttatgtaaatctatccagagatgtgctgctttgtgaaactcctcccaatgcccatacatctttacaatcaaaggattactcctgtttccaatcagatgtaaagtacacactgcagccaaaagaaactggtacatttcagaatcaaagcataaccagaccacatagggagtgagagaaaacctgttctgtgaggagcacgtacccggtgtgcagggctgccccctccactatgctgctattttgttgttctgtgccaaaacccaagttttcgttgttgtttgttttttcgaatgttccagtttctatttctctctgcgtgggcctggctaaatcccattgatgttcatggaaagtgtgtgctcatacaaagacaggagccgctcactaacctccctgctgcaaataaataccacctcctaaattatcacgtctcccttcacatatacacacacagttctcattaatcctaggggccacgccatgccttagtatttttactagagacagggtttcaccgtattggccaggctggtgaaattgccttacaaagagatgcaaatgtagtccaggaataaattccaaccatccaatttaggaggtccttaatatccattcacagatatttagaaagaagctttaatgggcaggggaaggggggctgttgaaggaggcagctgttggagctggtgaagaatcataggcagtgacaactcacagacaagcaactctgaaagtgcaagcctcttttgccaagttgtacctcaaaaataaattcactaaagcaaagctaatctatgggagatagaaatcagaaaagcagttgcctggggtggtgggggcgggtggggtgataggaacaggcactggggaacttcctggggtgatggaaatgttccatatcttgattgaggtggtatttatgtggaggctgacaaatgtcaaaactcaatgaactgaaaactgaagatctgtgtattttatggtatatagattatatctcaataacaaaaatactccacatttatttggtcatcatataatgttacagattatttctgctctcctgagttacttctcccctaacatattagtaccaagaaaaaattattaaaagctaaaacatggctgggtgtggtggctcacacctataatcccagcatttggggaggctgaggcgggaagatcgcttgagcccaggagttcgagaccagcctgggcaacatagggagaccccatctttacaaaaactacaaaaagaatcagctggtttctacaaaagaaaatagaaacctgaaacagaaaaaaaaaaaaaaatagctgggcatggtggctcgtgctatggtcccagttactcaggaggctgaggcaggaggattgtctgagcccaggaggcagagattgttgcagtaagcagagattgagccactacactccagcctgggcgacagaatgagactctgtctcaggggcaaaaaatttaaaacttaacaatgaaaaacatgtcattagtggcagaatttaaaaattaaaatcagaatgtttcctgagaattctatacagccacatgaagcatttttacttgcagtaattcatttaaacctcccaacaaaccaaggcagtagaaaggatcattcctttttacagatgacaaaactgaggctcagaaaagtagccttggttcaaattacacgacttctcagagtcagctgtcgtggctcacacctgtaatcccagtacttcgggaggccgaggtgggcggatcacctgaggtcaggagttccagatcagcctagccaacatggtgaaacccccacccctattaaaagtacaaaaattagctgggtgtggtggccacctgtaatcccagctcctcgggtggctgaggcaggagaatcgcttgaacctgaaaggcggaagttacagtgagctgagatctcaccactgcactccagcctgggtgacagagcaagactgcctcaaaaaaaaaaaaaaaaaaaaaagatctaaacccaaaccacttggctccacagccctcattcagaactgctgcacttaagagttgggtttgaaatgaggcaactttcagagtggctagaagacgtttcaaaatgtcttctagccaagaactgaaaattgactctctacataaaaatctattaaggaaatcagcgatggtcacctagaagtagatgctgtctaatttttcaccacaaacccttttttctgtagctgttggaaagagaggcaacaatacaagacaaatatcccccaacttagccatcacaggaaaagctgactaaaaagggtctacaacgtggagaccaactgctggaggtgccaaaacctagaaacaagctattaacctgcctggcttctatcctaagctatagtcaaagggaaaacaggccagtcaggagacagcagaggtgggagtaggggcagagaaggcctcagtggaaataaatttttaaaaagtcataattgccgagtgtggtggctcattcccataatcccagcactttgggaggccagggcaggcagatcatgaggtcaggagttcgagaccagcctggccagcatggtgaaaccccgtatccactaaaaatacaaaacttagccgagcatggtggcgcatgcctgtaatctcagctacttagggggctgaggcaggagaatcacttgaacccgggaggtggaggctgcagtgagctgagatcacgccattgcactccagcctgggtgacagagactccgtctcaaaaaaaaaaaaaagaaagaaagaaaaggaaaaatgtatgccaaacatggctaaggtctcctcctaacatgcataccaatgatagtgtaaatgaggctgcagggctgctcatgtctgtaccccaagacattgcagccagggcaatggataaggggaggcggcagagaccagactgcacatcacgcttgagatataaaaggcagggagacggagagacacatggctgccttcgaggacaccttgggatcccaaatctataaaacatgcatctgcagaatatatatggtttatgtaaggtaagttatagtatacataaaatacatgcataagtaagaaggcactggaaggaaacacaccagaatcataaatgggatattttagggtagtagctacacaggtgattttcatcaccctatgtgtgtgtgggggggggttgtttgtttggttgttttggtactttaaatatttctccaatatcatgcgatcttttctatttgaaaaaagaacagtgaacaggagcagctttggaggagtggggggcaaaaagaatggcaggatctggcttttaagataattcaaaagatgtggcttgagtcgagcgctcacacctgtaatcccagcactttgggaggccaaggtgggcggatcacatgaggccaggagttcgagaccagcctggccaacatggtgaaaccccatctctaaaactacaaaagttagccaggtgtggtggcccacatctgtaatcccagctactggggatgtggaggcaggagaatcacttgagcctgggaagcggaggttgcagtgagccgagatcgcaccactgcattccagcctgggcaacagagcaagactccatctcaaaaaaaaaaaaaaaaaaaaaaaaaaaaaaacaggccgggtgcagtagctcatacctgtaatcccagcactttgggaggccaaggcaggtggatcacgaggtcaggagttcgagaccagcctgaccaacatgatgaaaccccatctctactaaaaacacaaaaattagctgggcgtggtggtgcgcgcctgtagtcccagctactcaagaggctgcggcaggagaatcgcttgaacccgggaggtggaggatgcagcgagccaagatcgagccactgcattccagcctgggcgacagagtgagactctgtctcaaaaaaaaaaaagagagagagatgtggcttgagagatggggtctggagcattccttgctgggggccagggaagggcctcctgagcccagaagcacaggggtgaggtaatatgaaagtccctcaccttcaacaagagcagagaggacaagggacagcctgaacatacagaccacgaggaaaagggatgggtccaattcacatactgctttaaattgttattaatgagttgttgatgtttaaaaatcaagagaaaaaatactaaaaatttttaaaaatgattaaaaactatgtgtatcttatttttttcctaaaaagaagaaacatgggccaggcgcagtggctcacgcctgtaatcccagcactttgggaggccaagatgggcggatcaagaggtcaagagatcaagaccatcctggccaacatggtgaaaccccgtctctactaaaaatacaaaaattagctgggcgtggtggcacgcacctgtagtcccagctacttgggaggctgaggccggagaatcgcttgaacccaggaggcagaggttgcagtgagccaagatcgcaccactgcactccagcctggcaacagatcaagactctgtctcaaaaaaaaaaaaaaggggggggaagaagaaacgggctgggcacagtggctcacgcctataatcccaatactttgggaggccaaggcgagaggatcacttaaggtcaggagttcgagaccagcctggccaaaaatggtgaaacccccatctctactaaaaatacaaaaattaactgggcgtgatggcacacacctgtaatcccagttactcaggagactgaggcaggagaatcacttgaacccgagaggcagaggttgcagttagcccagatcatgccactgcactccagcctgggtgacagtgagtgagactctcaatgaatcaatcaataaaaagaaagttgtaagaatttttattcattgtactttgttcataagcaactctggagggaaggacaagaaatgaaagtattgcaaaactggatggaagtagattcttcaaaaggaacatttgtatatttcttgagtcatgtgaatgtactacctttcaaataactacactttaaaaagataaccaataaaaggcagtatgataaatgttattttatatacattgtagaccaactttgttaaagtaacttatggtttgatttttatgtaagtatacagtaaacagttatggaactaaaaaactaaaatgaagttagagtatttcacataaaactatagagtttgtaactcttgggtctggcaactcctggtccctgtttgtacctgactgggcagagtagccgacaggagcttctcattctcccagggctttactgcatcagcccagctctagggcatctcagtttataaggtaaagcccaacagtttcctaggcctagcgcagtggctcacacctgtcatcccagctttgggaggtcaaggtggacggatcacttgaggtcaggagtttgatagcagcgtggccaccatggtgaaacctcgtctctactaaaaatacaaaaattagccgggtgtggtagtggctgcctgtaatcccagttactgaggaggctgaggcatgagaatcgtttgaacccgggaggtgatggctacagtgagccgatatcgcgccattgcactccaatctaggcgacacagcgagactctgtctcacaaaaaacaaaaacaaaaaccgtttcctgatgatcacaatatcagtgcttaaaggcgcaggcaccacctggcagttggttaagcatgccacctgatacaggcaggaatgtctgttatcagaggggaagggatgcttggataaagggcctctctagctctcaggatgctacttcaccccaaaatgactcagagcagaaaagaactattctcgtcatttcagaagcacctgcattgtttgtgtggaagaaatgacctcccttcctcttctcagggcaagagctgctggcatcacttgtctgataacatggcacgtacggcgtatgcacgcccactccctggtccctgagcatctggcttcctccactccacaagcacgtctacaccaaatccttatcatccctcacctactgccaacagcaaaaaggtttattgtttttgtttctttaaggagagcctaaatcttttttatgtttacaactttctcttagtcaaaaaaatttaataagttgggcgtgtcggctcatatctgtaatcctagcaccttggaaggccaaggtaggtggattcctgagcccaggagttggagatgagtatgtgccacataatgagatcctgtctctacacaaagctttaaaattagccaagagcatcgttcttcacagaattagaaaaaacaattcttgggccaggcgcagtggctcatgcttgtaatcccagcactttgggaggccaaggtgggtggatcacgaggtcaggagatcgagaccatcctggctaacacaggtgaaaccccctctctactaaaaatacaaaaaaattagccaggcgtggtggcaggcgcctgtagtcccagctactcgggaggctgaggcaggagaatggcatgaacctgggaggcggagcttacagtgagccacgatcacaccactgcactccagcctgggtgacagagcaagactccatctcaaaaaaaaaaaaaaagaaaaagaaaaaagaaaaaacaattctaaaattcatatggaaccaaaaaagagcctgcatagtgaaagcaagactaagcaaaaagaacaaatctggaggtatcacactacctgatttcaagctctactataaggccatagtcaccaaaacagcatggtactggtataaaaataggcacatagatcaatggaacagaatagagaacccagaaataaacccaaatacttacagccgactgctcttcaacaaaacaaacaaaaacgtaaagtgggggaaaggacacccttttcaacaaatggtgctgggataactggctagccacatgtaggagaatgaaactggatcctcatctctcatcttatacaaaaaatcaactcaagatggattaaggacttaaatctaagtcctgaaactataaaagttctagaaggtaacattggaaaaacccttctagacattggcttaggcaaggatttcatgaccaagaacccaaaagcaaatgcaataaaaacaaagataaatagttgggacttaactaaactgaagagcttttacacggcaagaggaacagtcagcagagtaaacagacaacccacagagtgggagaaaatcttcacaatctatacgtctgacaaaggactaacatccagaatctacaaagaactcaaacaaatcagtaagaaaaaaacaaacaatcccatcaataagtggactaaggacttgaatagacaattttcaaaagaagatacacaaatggccaacaaacatatgaaaaaatgatcaacatcactaatgatcagggaaatgcaaatcgaaaccacaatgcgataccaccttactcctgcaagaatggccataatctaaaaatcaaaaaacagtagatgttggcgtgtatgcagtgaacagggaacacttctacactgctggtgggaatgtaaatacaaccactatggaaaacagtgtggagattccttaaagaactgaaagaagaactaccattgatccaccaatcccactactgggttctaccctgaggaaaagaagtcattatacgaaaaagatacttgcacacacgtttatagtggcacaattcacaattgcaaaatcgtggaaccaaccccagtagctgggattacagacgcccgccaccatgcccagctaattttttgtatttttagtagagattgatgcccatcaatcgacgagtggataaataaactgtggtatatatattcaatggactactcctcacccataaaaaggaatgaattaacagcatttgcagtgacctggatgagactggagactattattcgaagtgaagtaactcaggaatggaaaaccaaacatcatatgttttcactaatatgtgggagctaagctatgaggacacaaaggcataagaatgatgcaatggactttggggacttggggaaaagagtggggagggaggcaagggataaaacataacaaatagggtgcagtgtatactgctcgggtgatgagtgtgccaaaatctcacaaatcaccactaaagaacttactcatgtaacaacataccacctgtaccccaataacctataggaaaaaaaatgaattaaaaaaaaaattatccaggcatggtggcatgtgcctgtagtcccagccacacagggggctggggcaggaggattcctttagcataggaattcaaggctgcagtgagctatgattgcacactgcactacagcctgggcaacagcaaattcttttttttttttttttttttgagacggagtctcgctctgttgaccaggctggagtacagtggcgctcactgccacctccgcctcccggattcaagcgattctcctgcctcagtctcctgagtagctgggactacaggtgcatgccaccaagcccagctaatttttgtatttttaatagagacagggtttcaccatgttggccaggatggtcttgatctcttgacctcttgatccgcccatctcagcctctcaaaatgctggaattacaggtgtgagccaccgtgcccggcctaaaagcaaattctttaattaaaaataaaaatagagccaggtgcagtgtctcacgcctataatcccagcactttcggaggccgaggtgggtggatcgcctgaggtcagtcgtttgagaccagcctggccaacagagtgaaacccatctctactaaaaatacaaaaaattagctgggcacagtggcgggcacctgtaatcccagctactcgggaggctgaggcagaagaatcgcttggacccaggaggcagaggttgtggtgagctgaaattgcgccactgcactccaacctgggcaataagagcgaaactccatctcaaaaataaataaataaaaataaaaacgttaatgagatttatgaacagagaatccaagcgttccccccctgggtcccacttgttgagaatataaacagcaactgcatttcataatacctcagtttggagaaaaaagggtatctattctgccctctccatagctcagttacattggacctctttctgtttctcaaatgctctaagcacatgcctgctgcagggcctttgcatcactgccccctggaatagtctccttcccatcactcctcaggaggcctttcacagccacacaggctaaggctgccccttcacatctcctacccttcaccttcattcatgtaaaaaatactaaatgtatctgggataccccatctgtcctacgaccttattctgttaccttcagagcacttttcacaatttgtaacaatttcatttactggtttattgtctatcccttctgaatgtcagccccacagggcagaaatatttgtctactctgttcattgctgcacccccagaacccagcacagggcctggcacacagcaggtgctcaaccaccatctgccaaatcaatggagaaagaaaaggaggcgagggaaggaacagaggggctactcggttctgctacacatcgcatgcacaaaagcatagattctgctacttttccaacccctcacactcaaatactctacattggttaaaaagaaaatgtgatcccaggaaacaattcaaatacaaggtgagcatccctgatgcagaatgcttgggagccgaagtgtttgagattgcagatgtttccagattgggggacatctgtgccatccttaccagttaagcatctcaaatccaaaaatctgaaatccaaaatgctccagtgagcatttcgtttgagtcccatgttagtgctcaaaagttttagattttacatttatttatttggaatttttttgtttgtttttgtttttgttttgagacaggtctctctccatcacccaggctggagtgcagtggcgtgatgtcaacttactgcaacctctgcctctcaggttcaagcgattctcctgcctcagcctcacaagtagttgggactacaggcacgtcccaccacaccccactaatttttatatttttagtagagatgggtttcaccatgttgcccaggctggtctcaaactcctggcctcaggtaatcctcccacctcggcctcccaaagtgctaggactacaggcatgagccaccgtgcctggccagattttagaccatttgagattttggatttgggatgctcaacctgtgatataatccatgaggacaggggatttgtctttctcatttacctctgtgttcccagagtctagacttgtgccatatacaataaacatacaataaatccttgttgagataatgcaagacccaacagctaaatgaataaatgaacggcacaggctttgctatagtttgatccaggcggtatatgaaatggagcttcaacgttaaagtctcagagactcccaatgtattggcctaagggcatcctttcccttacaaggccaccatcccattccagatgcctaagtgagagaaacaaagaactttctgtttccaaacctctaaggttactgaacaaacaatgccgattaacttaccaggggaacccagtaggtatagagtgcaccaagtctcatttcgggaacaaactgagagcaggcaagaagtaagaaatagaggttgaaaaagtatttgaactggttgaacagcacctggaatggagggagacaacagagaaagacattcagggcttgtctgatgagatctggaacatttggtgggaaatgaataacatctaaaaacattcctgcagccaggcgtggtggttcacgcctataatcccagaactttgggaggccgaggcgagcggatcacctgaggtcaggattcgagaccagcctgaccaacatggcgaaaccctgtctctactaaaactacaaaaattagccaggcgtggtggcaggcacctataatcccagctactcaggaggctgaagcaggagaattgcttgaacccgggaggaggaagttgcagtgagccaagatcgcaccattgcactccaacctgggcaacaagagcgaaactctgtctcaaaaaaaaaaaaaaaaaaaaaaaaaaatcctgctttataatacaatttacactatacttttcacatagagcttaaacacttccatatgttgtttagaaaaacatacatgggtaataaaagtatcatttgtaaaagaaagagtaaataatgatatacatggaaattgtaaataccaaattcagaagagtagttacttcctggggaaggggtaaaatctaacatggaggggcacacaggggcatcaactatgttatgtgtgttttggggtttggttttgttttttgagaccaggtctcgctctgtcacccagcctggagtccagtggcgtgatcgtagctcactgcagcctcgaattcctgggctcaggcgatcctcctgtcacagcctcccaagtagctgaaaccacaagcatgcaccaccatgcccagctaaattttttgctatttgtagagacagggtctccctatgttgcccaggctggccttgaactcctgggctcaagcgatcctcccacttcagcctcccaaagtgttgggattacagacctaagccactgcgtccagactgtgttatttctttttttttttttttttttttttttttgagacggagccttgctctgttgtttaggaggaggtttttgcggaaaatgcttatgctataaggttgagtgcaaaaagaaataaaaagttatgtccagccaggcgcagaggctcacacctgtaatcccagcactttgggaggctgaggcaggcggatcacgaggtaaggatatcaagaccatcctgcccaacaaggtgaaaccccgtctctacaaaaatacaaaaaattagccaggcacctataggctactcaggaggttgaggcaagagaatcgcttgaacacaagaggcagacgttgcagtgagctgagatcgcgccactacactccagcctgggtgacagagcaaaactccatctcaaaaaaaaaaaaagttacgtccacagcatgtccagacgtggtggtacatgcctgtaatcccagcactttgggagggcgaggttggcaaatggcttgagctcaagagttcgagaccagccatggcaacatggtaaaaccccatcactacaaaaaatacaaatattagccaagagtggtggcatgcacccgtagtcccagctactcaggaggctgaagtgggaggatcaattgagcccaggaggcggagatagtagtgagccaagatcatgtcactgcactctcgcctgggtgacaatgagtcccccacctcaaaaaataaaaagtgaaaccccatctcaaaaaataaaataaaaaataatttttaaaaagttaaatggccgcacacagtggctcacgcctgtaatcccagcaatttgggaagccgaggcggatgaatcacgaggtcaggagttcaagaccagcctggccaacatgatgaaaccctgtctctactaaaaaataaaaaaagtagccggacatgggagcacgtgcctgtaatcccagctactcaggaggctgaggcaggagaatcacttaaacccgggaggtggaggttgcagtgagccgagatcacgccattgtgcaccagcctgggcaacagagggagactcagtctcaaaaaaaaaaaaaaagctatgtccacaacatgacctcaactccataaaataacacagtcaaatcctcccctggggagcagctaggtgctagtgtggttctgaccattggcatgcacccgagagtcagactgagaccacatgactagtttgggccaataggtaatgaatggacgtactgtgtctcgttgaggctaaggcagctaagaaccattggtgcctcttgagccactctggtgactttggtggccacatagtccaggtgccatacccaggaaatggaggagtgtggcccagtctgcatcagactttccatgaatgagaataaacctattcctcacttgaggtactgagagttggggggagttgaggaaaccagcaatgaatatagtcaaaatcacccttaaaaacattcacggctgggagcgctggctcgtgcctataatcccagcactttgggaggccaaggtgggtggatcacctgaggtcaggagttcgagaccagcctggccaacatggtgaaactccgtctctactaaaaatacaaaaaattagccgggcgtggtggcgggtgcctgtgatcctagctacttgggaggctgaggcaggagaattgcttgaacccaggaggcggaggttgcagtgagccaagatggctcactgtgctccagcctgggcgacagagcgagactccatctcaaaaaaaaaaaaaaaaattcaaatttctgtttgggaggctgagagaggagcatggcttgagcccaggagtctgaggctgcaataagctctgatcatgccactgcactccagcccaggcaagacagtgagatctggtctcttaaaaaacaaattccaattgaccttgaactcgactatataatagatttgtgcctctgcactatcactcaatatctaacactaccattatgttcctttctgcattggagctgattgctactgctgcttctcaaagtcaactggtgtgtgtttggaggcagtgctggataaaaatagatatttaatttatgtgcatgttggggagaaggtttgctgagtacatgtccacagatttgtgtaagttaatgtggaagtgttatgccaccagaaacatttattattagcaaaaatactaatgaaaattctctctatagatggtaagattaaaatgcatctttattttttctcctctaagctattatctcccaacttgccaatattgactacatgtgtcatgatggggggaaatttaagcactgctgacattcttttctgctgttttggtcataatgctaggtccccagaatgtctttttcattcttaggcttagcacaccaaatacatgtgaagttactctaactgagcaggtggggtcacagccttgcagagagaaggcaggtgccccctccaccccaccccacctccaaccccgccactacccagtgctgaacccagggaagatgaacaaccagggactaaggtggcacagaaaagtcactgacatctgccacagggaactcagtcttttaagactgtaccggcgggcaaggtggctcacatctgtaatcccagcactttgagaggctgaagtgggtggatcacctgatgtcaggagttcaagaccggcctggccaacatggtgaaaccccatctctactaaaaatacaaaaattagccacgcgtggtggcacatgcctataatcccagctactcaggaggatgaggcaggagaatcgcttgaactcaggaggcggaggttgcagtgagccaagattgcgccactgcactccagcctgggcgacagagtaagactctgtctaaaaaataacatgacatgacataacatctgtaccaatgcatgtatttgtgatggaaaaaagaaaagagcacggtccctgcctgcacgtaccccaggaagaaaggtgaagaaattgtacttctgattgttgatgacattccgaggatacctctggtctctcttctcggggtgccccagccagacagtgcggggcctggcctcccctccaccgcagcatctcagccactcgcagcacctgtgggaaagaaacccacgcatcaaggccacgcccacgcatcgaggctgtgctcatgtctgcccactcttcgcagattgcttttctctacagcatcttctctggctcaggaccacagccatatttgaggcttcatctttcagtgaaacaagaaaacagagcagaagctcccacgaagctgtggtccaaataaaagatgctttgtcctggccaggcgcggtggctcacacctgtaatcccagcactttgggaggccgaggtgggcagaccacaaggtcaagagatcgagaccatcctggctgacatggtgaaatctcgtctgtactaaaaaatacaaaaattagccgggcgtgttggcacgtgcctgtaatcccagctactcaggaggctgagggaggataatcgcttgaaaccaagaggcggaggtcgcagtgagccaagatcgcaccactgcactccagcctggcgaaagactgagacttcgtctcaaaaaataagtaaataaataaataaaaagatgctttgtccccaatcccaaattatttacagtcttgcattgttaagcgacaaggatacgctctaagaaacgcattaggccatttcggcactgtgggaacattctagagtgacttacacaacctggctgccatcacctgctatgcactaggctgaatggtacagcctattattcctcagctacaaacctgcacagcatgagactgtactgaataagacaggcagtggtagcacaatggtaagtacttgtgtctctaaacatatctacatatagaaaaaatacagtaaaaatacagtattctaatctaatggggccactgttatatatgtggtctgtggttggttgatatgtcattatgtggcaaaagactgtgttccaaaaagtaagattcggccagccatggtggtttatgcctataatcccaacactttgggaggccaaagcaagaagatcatttggggccaggagattgacaccagcctgggcaacaaagtgagactctcatctctattaaaaattaaattttttagccaggcacggtggctcatgcctgtaatcccagcactttgggaggccgaggcaggcggatcatgaggtcaggagttcgagatcagcctgaccaagatggtgaaaccccgtctctgctgaagatacaaaaattagccaggcatggtggcaggcgcctataatcccagctactcgggaggctgaggcaggagaatcgcttgaacccagtaggcggaggttgcagtgagctattgccactgcactccagcctgggcaacagagcgagactccgtctcaaataaataaataaataaaaataataataattttttaaaggtaggctttattttagaataaaaggatttaagaaaataaatatatcacagtaagtactattattacatctatgcttcacagataagagagaagcttgggccaggcgaggtggctcacgcctgtaatcccagcactttgggaggccgaggcaggcggaggtacctgaggtcaggagttcaagaccagcctggccaacatggtgaaaccccatctctactagaattacaaaaattagctgggtgtggtggcagacgcctataatcccagctaccagggaggctgaggcaggagaatagcttgaactcgggaggcggaggttgcagtgagccaagatcatgccactgcactccagcctgggtgacagagggagactccatctccaaaaaaaaaaaagagaagcttggaacagctaaagcacccaagtttgcagagacgtaagaaacagctgggtctggccttgaactgtgtcagccttattccaaagcctagtgtcttttccccaccccatgctgtcacagctgctagttccaccaagattgctatataaaggaaaagggggagcgggggaatctcctctccacccccagctttccttttcagcaacacattagaggagcaagccacaaagatgatgtctcagagctcgatataacctggagagaagccagcacaccagctgtcggcagaacgaccccaagggcgcccccaacgtggttttcccaagaggacagctcattggtgccaacatcagcacccccactcccaggtcaccctcccacgaggcaaaggaacacctaggaatctgggctgctctggcaaaacgaggtgctctgaggaccccaaaaacggcagcttgtccttcaggagagctttattaaacaaggcactctgagaagtacaagctcccgaaaaactgcaacaaaaacgtccctcgctggaccgctcacctcaccgccccagcactcaaaggctgaggcaaggtcccagccctgccagccccctgggatgtcgccagctaaggtgaaaccaacaactcacatattactcgtccaccacagaccttccttcttcccttgttcccacagagcaggtcctggtgggtgctggggtacagagctaagaaaacacagcctctgtccatcaggaccttaaagatgagcgagccagcaggctgcctgctcagatgctcaaaatttccatgatgaaacacaatgctctttcttaaaaatagcatcctcattccagtaaaccagcattcatggtggagtgtggctctgctaaggtttcacttctagtaactcattcttgttggcccctttctaagttgtccaaaagccagagacacacacagaagcctcaaggagtccaaccactctcgccactcctgtttccaagtgcaaatcacccatgctggccatcagtggacactcactgaatacattttgaatgaatggaggaagcaaagagggagggggagaggaaaaggatgggagaaaaaggggaaggaggagaggagcgaaggaagattcatttgacagaaagcgcatcaccgtatttgcagaaaccttactggatggtgaagactgactcctctaagagccagtaattctctccctatcctataataatctagtaatgactgtcttcatagttgtacagttctaatgaaagatgaaaaatgaatttaagagaatcacaaactgtcaggttgactgtttatacaaaatttttgttctgttttgttttagcagaagtttccagacatcaagctatccggttacagttatgctatttattaattacttagcctatcacctttgtgcatatgcacaaagtacaggtcactcactgcactatgggagcaagagattggaaacaaatctaaccatttgtttcagtcccttcccgctactataacaaaataccttagactatgtaatttacaaacaaggaaatgtattgctcatagttctggaggctgcaaagtccaagatggagacaccaatagattcagtatctggtgaggcccattcctcatgcctttttttttttccagacagagtctaattctgttgcccaggctagagagcagtggcacgatctccactcactgcaacctccacctactgggttcaagccattctcctgccttagcctcctgagtagctgggattacaggcgtgcgccaccacacccagctaatttttgtatttttaagtagagacggggtttcaccatgttggtcagactggtcttgaactcctgacctcgtgatccgcctgccttggcctcccaaagtgctgggattacaggcgtgagccactgtacctggccttttttttttaatttttttttaaattaaaaaatctgtattacccaggctggtgtacagtggtacaatcacagctcactgcagcctcaaactcctgggctgaagcaatcctcttaccttagcctcccaagtatatgggactaaaggcatgtgccaccatgcctggctaattttttaatattttgtagagtgagggtctcactatggtgtccagggtggtctcaaacacctggcctcaagccatcctcccacctttgcctcccaaagtggtggggttacaagttgtgccaccatgcctggcccctcatgcctttttcttttcttaagatggggtctcactctgtcgcccaggatggagtgtagtggcatgatctcagcttgttgcagcctcaaccttccaagctcaaccaatcctcccacctctcagcctcccaagtagctgggactataggcaagcacaatcacacctggctaatttttgtaattttttttttgtagagatggggtttcaccatgcagcccaggctggtctcaaattcctgggctcaagtgatctgcccacctcatcttccaaagtgttgggattacaggtgtgagccaccccactcagcccctcctgcctcttttataagggaattcatgaggattctgccttcatgacccaatcacctcctcagtgcccaacttcatacaactatcagatttagggagaagggatacattcagaccataacaccgttcatcaaaggaagactggttaaataaacagggataagccataaatgaaattcctaaccccctctaaagcataaggtcctcttccggttccaggcacttcgggagctgtgggttcggtgcagacatgtccaagtccacatacaaccacacacaaccaggcccgaaaatggaacagaaatggcatcaagaaatcccagtccacgtgtatcccattttggtttttttaagaagaaatttaaaaaagaaagaaagaaagaaaggaagaaatcccagtcacaaagatatgactttcttaagtgggtgaaccccaagttcctgaggaacatgcactttgccaagaagtacaagaagaagtgcatgaagaagatgcaggccaacaccaccaaggccctgagtgcacacgccgaggctatcaagacccttgtaaagtccaaagaggttaagcccaagatctcaaagggtgtcggcagcaaaattcatcgacttgcctacattgcccactccaaacttgggacgcatgctcatgcccgcactgctaagggtcttaggctgtgctggccaaaggccaagaatcaaaccaaggcccagactgcagctccagcttcagttccagctcaggctctcaaaagtgcccacgcccctaaaaggcttcagagtagagatctccatctgcaaacatgaggacagaaggattggtatgacctctgggctgccgtctgcatggggttggtatcttcctgtgctatttgtacaaataagcctgaggcagggggaaacaaacaaaaaaaagaataaaatagcgctgtgtgcacaaaatgacccaatctgcaaaatacacaaaaccgaaaagcaaggggctaaaaggtgtgtgtaggatgctattctttgcacgaaagcaagaggacatacatgcagggagacgcttgcatgagcacagacaatctccacgacgagctaataacactggctccctttcaggaagaaggagtagggagaacttttcctgtatattcttttagtaagatttgcattttttacattctacacatattgtctatgggactaaatgtttctgcagctaaattcataagagtaagcattattttattaagcgcttacccggtacaaagtactattctaggtcctctgggaccaaacattggaacagaatccttgccttctccttcctcacaatctcattgcaaaactggagtgtttggcacaggataaaataagaactttgtgttacctgagccaaaagcccatctcatttaaccaatttgattgttaccacattcattcagtcttcacctgcactgaatataacttacaccttttaatacaggacttatttgactttcaagtcaatagatactgaacacttagtaacaacaacaaggcaagtaatagcagcttcctttttgtcactcctccattcccaaagtgtgccctgagtgtttgcacagtggccagccctcgcctaggcaccgggcattcagtagcgaacaggacagacaaggccctcctcccatggaccttgtagcctagtggagggagacagtaaacaacttccaaagaaaataaggccaggggccagagagtgaatgaggaaggggtgtggctccgggaatgggtggccagggaggtgaggggacagtttagctgagtgccaagaagaagctgccatgcacccatacaaggaagtgcaatccaggcagatggaactgcacaggcaaagatccggaggtgggaggcagcctggcactcgcaaagcatgcaaagactggctgcagcagaaatgcacccatcacggggagaagataaaggacaaggagggaggagatggggggcggacaacacagggctttgtcaccagggcaaggagtctagatgttactccatacacagtgtggatcatttgaaggttataagcaggagagtggaatgatctcatttatagttttaaaaggtcccccaggccactggtcagagaaaacactgcagtgagcaagagctgaagcagataatgggtatagggtttctttttatgggaatgaaatgttctcacattgtagttactcttatttttttttttgtcttttgtttttgtttttttttcctttttctggagaacgaggtctcgctatattgcccaggcaggtctcgaactcctgggctcaagctatcctcctgactcttgcttccctgagagctgggattacaggcgggagccaccgcgcctggccctcacattgtagtgatagctacacaactctacaaatacactaaaacttgctgaattgtacactttaaataggtgaattataaggtatatgagttatgtctcaatgaaactgttatattaacaacaacaaaaaaaacagaaacaggaattatttatgaggctggtgccatcatccaggcaagactatagagcagtccagactaaggggggtggcagtgggggagtgaggagtagggtactagggtacagactctcgatatgttatagatgtagaaatgcacaatctctaaaatgtcaaaaatgaaaaagaaatgcactgtctcatttaatgttcacaacaatcctacaaggtactagcaccattcccattgttacagtggataaagtgagccccagaggactcagtgacctgcccaaaatcatctgctacatccgctctctctcctactaacgggtagaagcaggaatggagcccaggcctgtctgatccagaccctgggctaagagctctctgcatcctgcactaccatgaacagcctcacctgcacaattctttcacagcaatactttttttcccagtctctcagttcacaaattggaagcgtctttggggaccatcaagagtgactgttcggtccatgcaggagctctcttgccccgtacccattcacctttgagccacttatcaatttactccctctcagtgccaacatcacccttgaatacctgctctgccacaatggacagatttcctttatgcctctctcccttatgaattatttcctttgctaattacacagattactaatctaccatgtcactctttgcacacgtgtggggcccaatatatatacattcagccttaccaaaagtacgtaaccccagttggactaagaagcgtattcacagaaaaagaatacaaaagatactactcacagtattattgctggggagtgaaaaaagagaattgttggatgaataaagtcacttgacttgtactttttgctgtacccacttctgcatattttaatttcttatgaacatgtattacacttttcaatattgattttaaagatgatattaactaagcaaaaaactaagcagaggtactgtggtcctaaacttttgaacttgtatgcttcaaggactcatactacgggatacaaaaccaaacacctccacgggacaggcaggtaaaataagtaagcgaaagagccaggtgtggtggcgcagatctatatcctatctatatgctatactctatatcctaagtatctataatcccagattcttaggagactgaagtgggaggatcacttgagcccaggatttcgaatccaacttgggcaacatagcaagactcagcctctaaaacatttttttttttttttttgagacagagtctctctctgttgcccaggctggagtgcagtggtgtgatcttggcccactgcaacctccacctcctgggttcaagcgattctcctgcctcagcctcccaagtagctgggattacaggaacccaacaccacgcccggctaattttttgtatgtttagtacagacagggtttcaccatgttggtcaggctggtctcgaattcctgacctcaggtgatccacccacccgtgacctcccaaagtaccgggattacaggcgcaagccatggtgcctggcctaaaaaattttttaaaaagtaagcaaattgaactgcatatagattggggcaagtagggcagcacaagctccatcgaaagtgtatgcctctcggccaggcgcagtgactcacgcctgtaatcccagtactttgggaggccgaggcgagcagatcacctgaggtcaggagttcacgaccagccttgccaacgtggtgaaaccctgtctctactaaaaatacaaaagttagctgggcatggtggcgcatgacacacctgtagtcccaggtactcgggaggattgacgcaggagaatctcttgaacctgggaggcggaggttgcagtgagcagagatcacaccactgcactacagtctgggcgacagagcaagactctgtctcaaaaaaataaataaataaaaaacaaagtgtatgcctctctcctttacagtgctccagtgttaagctttctcagtagagaatgctggagggaggctgggcgcggtggctcacgcctgtaatcccagcactttgggaggccaaggcgggtagatcacttgaggtaggagttcgagaccagcctggacaacacggagaaaccccgcctccactaaaactacaaaaattaaccaggcgtggtggcaggtgcctgtaggcctgagtcccacctattcaggaggctgagacaagagaatcgcttgaacctgggaggcggaggttgcagtgagctgagatcacaccactgtactccaccctgggtgacagagcaacactctggagggacgcgtgtgaaccaccagctatgactcaccagccccacctgcacttggaaggttgcctccccctttccccatgggtgcagaccagttctggccctgcaagcccgccaactttcttgccatccaacagtctggaccccattgtccccaaccaggtctgaaccctggccccagagagggtccccttccaagtacgtcctttcttaggtctactccctcagtcctagactgccatagagttttcttctatcctacactcactctttttttttttttttttttgagatggagtcttgctctgtcgcccaggctggagtgcaggtgacacaatctcggctcactgcaagctctgcctcccaggttcacgccattctcctccctcagcctcccgagtagctgggactacaggcacccgccaccatgcccggctaattttttgtgttttttttagcagagacagggtttcaccttgttagccaggatggtctcgatctcctgacctcacctacactcactctttaatcatggttgtaaaagtcaatttcctccatcttctttcccaggggtttagctgagcccaatcccatctctgaatttcaggcatgatgtgcgcaggctccaggcttagccagggagagccctggatgttctggacatggtgacaggcttgagaagggacagtgagacccctggctgggattttgctagaaatacttggaaagatgtgttcttctccctggggttgctaaggtagcagaaaacatgcctgggcaggggacagacatcctgttcccattgagggactagtcggcctgaaaatgaagcccccaaggaggacagcagagacaagaagttcccgatagccttgagagactgcaaagattcacccacccctggactttcagtctcagagtcaataaaatagcttttgttgtactttactttgctcaagccagtttactttgtttcactgttatttatttatttagagacagggtctcactctgttacccaggctgcagtgcagtggcgagatcatagctctctggagcctcaacctcctggactcaagcaatcctcccacctcagcctcccgagtagctgggactacaggcatgcaccaccacacctggcatattttataattttttgtagagtcaggggtctccctacatagcccaggttggtctcaaactcctgggctcaagcgatctgcccacctcagcctcccaaagtgctggggttacaggtatgagccaccacgccccagccaacacaaaccaattttagttgggagtctgtcagccactatctaaaatcttttaagattcctgtctggcaggccaggcgcggtggctcacacctgtattcccagcactttgggaggtcaaggcgggtggattacctgaggtcaggagttcaagaccagcctgaccaacatagtgaaaccccgtctctacaaaaaatacaaaaattttgtgttgttgtttttgttttttgagacaaggtctcattctgtcacccaggcaggactgtggtggcaccatcatggctcagcgcagcctccttttccccaggctcaagtgatcctcttgcctcagcctcccacgtggctgggactacaggtgtgtaccaccactcccggataattttttttattttttatttttagtaaagacagtctcactatgttgcccaggctggtctccaactcctggtctcaagcaatcctcccagttcagcctctcaaagtgctgggattacagatgtgagccacaatacccggccccaattctaatgtttaaagagtacagtctacaccttaaagcctgcattttatcatcctgtcctcactgctctgacttctttacagttgtgctgtccaccttggcggcttctaccacatgtggctattttaagtttcaattaattaaaattaaattttaatttaattaattaaaaataaattttaattaattaattaaaaattaaaaattccttttccctggccacactgagtgctccatagctacatgtgaccactaactacggactagactgtgcagacacagaacattccatcatggctgagagttctactgggcaacactgctggagagcatccctttcaagacacctccttccaccttactcttgaactgatgtcaatggcaaaggaagcacacacgaacattagtaagtggagctcacaggccaggcgcggtggctcacgcctgtaatcccagtactttgggaggccgaggcaggcggatcacgaggtcaggggatcgagaccatctgaccaacatggagaaaccccatctctactaaaaatacaaaattagccaggcgtggtggcgcatgcctgtaatctcagctactcagggggctgacacaggacaatcgcttgaacctgggaggctgaggttgcagtgagccgagatcacaccattgcactctagcctggacaataagagcaaaactccgtctcaaaaaataaaaataaaaataaaaaaggaagtggacctcacaatggagggaaactcgcctgaacagagtttcccaaacttcagccattttcatacacacatgggatttctatgatctccaaatacctctagcttctacctacacaattttgtctaaatttgatcaccttacatcagtggttctcaactacaggcaattttgcacccccagggtgggtatctggcaatatctggaaacactgttgtctgtcacaactccaagatgctactctcatctagtggatggaggcagccaaggatgctgcgagacaccttacaatgcacagacaacctccacaacagagaagtatccagcccaaaacgccacttgtgcccagttgagaactcctgctctaggttttatatataaactatttgtttaaaatggattcactccatttacataaatgtattttaaatgatagcctctggccaggcatggctcacacctgtcatcccaacactttgagaggccgaggcaggaaaacagcttgagttcaggagttggagaccagcccgagcaacacggtgagacctcatctctactaaaattcaaaaataattagccaggcatggtggacatgcctatagtctcagctacttggggggctaaggacgaaggattgcttgagcccgggaagtcgaggctgcagtgagccctgatcatgccactgtactgcagtctaggggacagagcaaaacactgtctcaaaaaaaaaaaaaaaagataacttcatgccattaccataactagaaaccagtatcacttgccataaacagaagataaataacaaaaccagcacaatgaaaagcaaagtgtgttactccactccagctggctgctgcagctggcagtgcctctgagccagaagcctaccctgctgttgctcctcctcctttacttttttttttctttttttgagacgcagtcttgctgtcgcccaggctggagtgcagtggcgcgatctcagctcactgcaacctccgcctcctgggttcaagcaattcttgtgcctcagccacccaagcagctgggattacaggtgtgcaccaccacgcccagctaacttttgtatttttagtagagacggcgtttcaccatgttggccaggctggtctcaaacacctgacctaaagtgatccagccgcctcggcctcccaaagtgctgggattagaggcatgagccgccgcacctggcccctcctttctttattgctgagaagttagcaagtgtttggtgttaaaaagtaggccctgacagggctgtaaatactgaagggaaactgaaaaataaataagcgtcttgctaaatgtctcaatgtgagtcagttcctgcccatgaattccttaaatttatcactgcagcacccagaaccattgcctgcccagcattttggaactgttgtcccacggtagaaaccttgagcttggtggcaaacttactacaagtgaccaaattcccccacatctgtccaaacaagagaagtgacagccagcctccctactgaggagtggatttatacatgcagttctcttcctggggaagctgcagccacaccctgcgtgttgcatgcatggacttcagctccctggtgccccagggttccagaggagcagtggcccaaagctgtgttgtggcagctgtcacgttggtgttgtgggtgctgctgttgttccttaacaccaaactgaaactggaccgtctgacactgccatgacaaataaacttccatcccacattccagacaggctggggagatgggctgcaagaccgaaactgatttttttttttttttttttttgagacggagtctcactctgtcacccaggctggagtgcagtggcgggatctcggctcactgcaacctctgcctcccggattcaagcgattctactccctcgacctcccgagtagctgggattacaggcgtgcaccaccacgccaggctaatttttgtatttttagtagagacggggtttcaccatattggtcaggctggtctggtcttgaactactgacctcgtgattcgcccgcctcagcctcccaaagtgctgggattataggcatgagccaccgtgcccagcccaaatcctttaagagtaagaaattaggccgggcacggtcgtcacgcctataatcccagcactttgggaggctgaggcgggcggatcacgaggtcaagagatcgagaccatcctggccaacatggtgaaaccctgtctctactaaaaatacaaaaattagctggatgcagtggcaaacacctgtagtcccagctactcaggaagctgaaacaggagaatcgcttgaaccctggaggtggaggttgcagtaagccgagattctggcactgcactccagccttggtgacagagtaagactccatctcaaaaaaaaaaaagttatttttccagatgaaaaaggaaaatatgaaataactttctcacccattgataacagccattcaactaggttaaagtgtaagtttataaataacttcgtttacactgcttcctgcttagaccatttatttattattttatttattttttgtttgtttgtttttgagacagggtctcactctgtcacccaggctggaatgcagtggcccaatctcggttcactgtaacctccgcctcccaggctcaagtgatcctcccatgtcagcctcctgagtagctgggactacaggcctgcaccaccacagccggctaatttttgtatttttagtagagatggggtttcaccatgttggccaggctagtttcaaacgcctgacctcaggtgatacacctgcctcagtcttccaaagtggattacaagcatgagccaccgcgcccagcctagaccatttatataaaggaaaaccaaaattgattttcttaggatttgactttaagacaaataaaggttttaacagcagatagtctgctaaccagatgtgcaatggtttcatacaatctggctgaaatgcaaaagcaaatattagaggagcagagccaagggaacaatgtttctgaaaaaggtaactaatgtaacaaggagttggcctccacagaaaccatcatctctgctgggagttcccctataatcagttagcactgcgcaaatatttgctgaattgtctgcatgacacaccaaccttccaggaagttacagggtccaggaaagaacagtctcagcattgacgctgggcagatccaagaagaacatgaagaaaaattaaaagtagccagatatggtggctcatgcctgtaatcccagtactttgggaggccgaggcgggagaatcacttgaggtcaggagttcgagaccagcctggccaacatgacgaaaccttgtctctactaaaaatataaaaattagctgggcatgggccgggtgcagtggctgactcctgtaatcccagcactttgggaggccaaggcgggtggatcaagaggtcaggagatcaagaccattctggccaacatggtgaaaccctgccgtctctactaaaaatacaaaatttagccaggtgtggctgtagtcccagctactggggaggctgaggcaggagaattgcttgaacccgagaggcagaggctgcactgagccaagatcatgccactgcactccagcctgggtgacagagcgagactccgtctaaaaaaaaaaaaaaaaaaaattagctgggcatggtggcgggtgcctgtagtcccagctattggggagactgaggcaggagaatcgcttgaacccaggaggaagaagttatagtgagccaatattctgccactgcactccagccagagtgagattctgtctcaaaaaaaaaaaaggaaaaaaattaaaagccgttatgaattagtcaacagcagtggttctcaatagcagggcggggggattttgccccctgcagacatttggcaatgtctagggatgtgtttgattgtcactactacagggaagtagggcactactggcacgtagtgggtagaagccagggatactgctaaacatcctacaatgcccaggagaccccccaccagagagtgtaatctggccccaaatgtcaatagtcctgcggtggagagccctgctctggagcagctctgcccactaggcttctgtgatgatggaatcattctatactgcaccatcatccagcacagtagccagcagccacatgtggctgctgagtacccaaaatgtgacatttaaagtttatttcaatacccaaaggaatatacatcattctaccataaagacacacgcacacaaatgttcactacagcactattcacaaagcaaagacatggaatcaacctaaatgcccatcaaagacagactggataaagaaaatgtagtacatatgcacatggaatactacgcagccataaaaaagaacaagattgtgtcttttgcaggacatggattgagctggaggctattatcctcagcacattaacacaggaaaagaaagccaaataccacgtgttctcacttataagtaggagctaagtgataagaacttacaggcacaaagaagggaagaagagacactgggggtctatctgcaggtagagggtgggaggagggagaagagcagaaaagataactgttgggcactgggcttaatacctgggtacagcaaaccccggtgacatgagtttactgatgtaacctcaggtacgtagccctgaacctaaaataaaagtttttaaaattttttatttcattcacttaactgattgaaatagccacgtggtaccattatggacagcagttgttaagagggcagttaggagtggaaggaggctgggcacggtggctcacgcctgtaatcccagaactttgggaagccgaggcaggcggatcacctgaggtcaggagttcaggaccagcctggccaacatagctaaacgctgtctctactacaaacacaaaaatcagtcagggctgggcacggtggctcacgcctgtaatcccaacattttgggaggccaagacaggcagatcacgaggtcaggagattgaaaccatcctagctaacacagtgaaacctcgtctctactaaaaatacaaaaaatgggccggacatggtgggggacacctgtagtcccagctactcaggaggctgaggaaggagaattgcttgaacccagaaggtggaggttgcagcgagccaacatcacgccactgcactccagcctgggcaacagagcgagactccatctcaaaaaacaaaaacaaaaatcaatcaggtgtggtggcgcacgcccgtaatcccagctactccagaggctgaggcaggagaatggcttgaacccaggaggcggaggttgcagtgagccgaggtagtgccattgcactccagcctgggcaacagagcgagactccgtctcaaaaaaaagagaaaagaaaaaggagtggaaggaaaggtatgaagggaaacttttgctcttccttctaaatacatctaaggtctgggtttttcgtttttttttttttttttcctgtttaactaggagaatacaaaacctaagtcaggaaggatgcaaagaaagaagcgaagtctgaagtctgaacacatccctgccacagaaatgctactgtctggaggagaaatgggaatatatcaatcacctcatgagaaaagccaagtcaatgtggcagcttctctttaaatgtaaagctcaggtcctctgacccagcaagtcctgccagagggaggtagggagcgatctctggtcctatgggagatgcacgaggatgttcacagcggcaatagacagggcaacaccccggaaatgacaaaggcaccccctgtgcaatggatttgtaccaattgcaagaaggaagtagagacatatacactccagggaaagatccaggtggttaaatgggaagaaaaaaagaaggcaagaaacatgtaatttattattttgtattttaataccaaaatatgtgttaatataagcctaggaaaaagcactgaggaacaaacacctcctctgccccatgactgttaccacaggtgcttccagcagatgggcagtcagggatgctgggactgtcgcctttccctgtttctccatctctgagtcttccctgtgggtattctgctgctcagcagacctgactcctcttatagaagtatgactcgtgtgttgacccactcccacaaagatcctacagctatcagactcaagtccaaggctctcaccttctcaccttttcatctctgctgtccctttaccaagccaccctcctgcagccaaggcaggcatgccccggaaccctatgctctcatctttccccaccattccatttctatcaaactacccaacatgtctgtaagacccactcacaccagacatcctcctgcaagcctgtccctttgtcttctatctatccttccaaacccaactctgtgctcttcacaaggagaggaggaagcagttctgggctctcttagactctactggtctgtttctctctagaccaggactggcaaactcaaacctacaggggcccagcaagccacataaaaaaatacataggccaggtgcagtggctcacgcctgtaatcccaacactttgaaaggctgaggcaggaagatcacttacagccaaaagtgtgagaccggcttgggttacatagtgagatcccatctctatttattttttaaaaatggaagaagaagaaaagaagaaagaaggaggtggagaaggaaagaaagaagagaggagggaggaggagaaaaaacaatgaatgaaaataaacacagggtccagtgggatggggcacaccgccagtccagttcctacacaagcctagaccatctgattctgcaagacaaagacattctgtaagcaaatattcagttataaaatgttggcaactgattcaatttttaaatattatacaaaactaaaaccacaccaagatatcttttttttacgaccaaagtcaaaaatcttaataatggcaaggatggacaaataggcgctgtcactgccagcaaggatccaagatggcatcacctcagggaggacattttgacgatgctatcaaaattacaaatgtaccttcacttcagccattccccttccagatattccgtgcagtctaacatgggcacaaagacttgtgtgacatttctagtaatagtaaaccattagaaaaaataaatataactgaccaagctcagtggctcacgcctataatcccagcactttggaggcccaggttcacttgaggccaagagatcaagaccagcctgggtgacagcgcctctaaagattagatagatagatagatagatagatagatagatagatagatagacagacagacagacagacagacaaataaaatggaaaaataatctaaatgaccatcagtggtagactggctaaacaaactacagtactattcaatttaatactacaaaggcattaaaataatgatcaaaggccaggtgcaatggtgtgtgcctgtagtcccagctatttgggacgctgaggcaggagaatcacttgaacccaggagtttgagacagcctaggcaacacagcccccacatctcaaataagtaaataaataaataatttcaaaaagggaatgaagaaggttgttatatactgacacggaacgagctcagaattttttttttttgagacggagtctcactccgtcacccaggctggagtgcagtggtgcgatctcggctcactgcaacctccgcctcccggattcaagcaattcttctgcctcctcagccttccgagtagctgggattacaggtgcccaccaccatgcccagctaagtttgctatttgtagtagagacagtttcaccatgttgaccaggctggtctcaaactcctgaccccaggtgatccacccaccttggtctcccaaagtgctgggattataggcgtgagccactgccggccagaatgtactgttaagtgaacaatacatgtactgtgtagggtatattaataatagaataaaaacaaaaaatctatgtctatttatctatataaagatgcatggtttttttgataaatgcttaaaaatttctagaacaatacagaagaacatggtaagactggctgcctggggaagggtacagggtagctgactagagagagtgggagggaaactgactttgcaatggctacacctctgtagcttttaagtattaaaccatgtgactctgactcagtacacttttttctaatctaaaaataaaataggccgggtgcagtggctcatcctgtaatcccagcactttgggagataggcagatggcctgagctcaggagtttgagaccagcctgggcaacatggtgaaaccctgtctctacttaaaaaaagaaaaaaagtccaataaaattagctgggtatagtggtgggcacctgtaatcccagctacttgggaggctgaggcgggagaattgcttcaacccgggaggcggaggttgcggtgagccgagatcgcaccacttgcactccagcctgggtgacaaagcaagactccgtctccaaaataaataaaaataataataaaataataaagctcaccccgctgcccaaacagcacacagctctgtctgcagcctctgatcttgccatgagcttgtaggtcagagagcagacaccattcacctcccccaggcctggcacacaaacgtgctccgtcactaagcgtgggctgatgactcattctcctgggccctttcacatgccccagtgcccagcactcctccctcacctcatgcatttgtgtttacccaagacactcggtcataggttctaacacagacctaggccacagagcctggctggcaaccccacacagcacgagcccaaaaaattccagaaaacaggacagaatccagtggaaggcaatttcctagacaccaaaacaataagcaaaaacatgagtaagtgctgagtgtgtgccaagcgctgtggcaaagccctcaacgcgaatgacttgccttgctcctcccgactgtcctacatcaagggcttctatcctcgccctcttgtagatgaggacactgcacctcagagggtcttgcagcccataagggacagagccaggatgtgagtccagcaggctgaccccggagccagccctcttagctggagtctggcaatctcatctcgttgtagaatctgagagccacctctcaattgtctagatggcaacctagggaggaatccaaatggcaggaacccagcagagacacaccaagggtccccactggcactgccaagcccacctgcctcctccctccaagcctgctatggcagctggcactgctatgggagcgtccatgagcaacacacattggggtctaagagctctacgtccaacaagaggcaggaggctggacgtggctccttccttgcagccatgggtcacgcggataaagaagggaaggaagaagggaggggcatcaggaaggaagaattccctttttctctgcagatgaggattccattgtttatcctccttctggctccagtgctcaacatgtaccctcactgaagcccattgtgggccctgccaccacttatacccccaatgaattaggaatgcaaaactcttgagattttttaacgtttctgggttttttttgttttttttttttttttttgagacagcgtcacactccatcccatgctggagtgcagtgacgcgatcatggctcactgcagcctcaaacccctggactcaagggatcctcccacttcagcctcccaagtaactgagaccacaaacatgcaataccatgcccagctaattttttatttttcttggtagagatggagtctccctatgttgcccaggctggtctcgaactcctgggcttaagaaatcctcccacctccgcctctcaaaatgctgggatacaggcatgagccaccatgccctgttgctcctattcctttttgtttgttttttgtttttgttttgttttgttttgagacagagtctcgctctccccaggctggagtgcaatggcgcaatctcggctcactgcaagctccgcctcccgggttcacgccattctcctgcctcagcctcctgagtagctgggactgcaggcgcccaccaccacgcccggctaatttttttgtatttttagtagagacggggtttcaccgtgttagccaggatggtctcgatctcctgacctcgtgatccgcccgcctcggcctcccaaagtgctgggattataggcgtgagccaccgcgcccggccgctcctcttctttattcactcgctcatttaatcaagcagccagtatttactgagcacctactaggtgccagcctttgtgctaagcactgggattctcacaagacaaacgagggcactgctctcacagagcctacattttgtaggtgggcaaggtaggaacaacaacaaaaaaaaaaaaacaagaaaaaaaaaatatatgctactcagcggtaggtggctcctacagagtgaatggtctggaaagatgtcccaaagacacagctgagctgagacctgggagacaagagacagcagcttacgagctgtgggaccctggactagttaattaaccctgctaagcctccgtttcctggaaaataaaacaatgacagtacctagtattggacgatgccattaagacaatccacttaaaatacctaagacagtgatgctggcacccaagacaccaacggagtttaacaaaattcttacaagaaaaactactgtgtgtcactagaacggaagccccacactgtcagggatttctctcgcacgtgttgaccactatatccctaatattaaaactgccagagacagagtaagtgctcaggaaatatttatggagtgaataaacggatgaatcaacagtagctatttttagtcttcatgctataaacctctgttaacttttctgtgagtgtgtagagatctggatgccctttcaaacagccggcaattctctgaaatatccaaaaacaaggccaagattcttaagcactggttttctgtggtatcacacacaaaactgcatttttgagtgcttctttgttggtcaggcttatccgatcccagttaggtgacttctcaggccccgggcaggagtcagtgcctctctctactttctctttgtttgctttaggaagggccaggattcagaatgaaaacattacctgtggccgggtacagtgtctcatgcctataatcccagcagtttgggaggccaaggtgggtggatcacctgaggctgggagttcgaggccagcctggccaacatggtcaaaccctgtctctactaaaaatacaaaaatagctgggggtggttatgcacgcctgtaatcccagctacttgggaggctgaggcaggacaatcacttgaacctgggaggcagaagttgcagtgagccaggatggcgccattgcactccagcgtgggcaacaagagccagactctgtctcaaaaaaaaaaagaaagaaagaaagaaaagaaaaagaaaacattacttgtaaagtgaaaataaaatacaaatcaacttgtgagactataaggcactggttaagtaaattagagatgtctattcaaagaaatatgctgtcattcaaaatgtcatttgcatatggcaaaaccctgtctctattaaaaacacaaaaattagctgggcgtggtggtgtgcacctgtagtcctagctacttgggaggcagaggcggaggcaggagaatcacttgaactcggaaggcggaggttgcagtgagccgaaatcatgccattgcaatccagcctgggcaacagagtgagactccgtctcaaaaaacaacaacaacaacaacaacaacaacaacaacaaacccacgttctacatggttcctagtcataaaacaatgtacacgcagaaacaaacaggaagaaaacatcatctgctaaaaggtttgtgttcattgtgattgtctttgaaggaaaaataacataataccagcatttcctttatcagttttctctgttctctcatttttctttttctttctttttttttttttttaatgagactgagcctcgctctgtcacccaggctagagagcagtggcacgatctcgactcactgcaacctccgcctcccaggttcaagcaattctcctgactcagcctcccaagtagctgggattacaggcatgtgccaccatgcccagctaattttggtttttttttttccagtagagacaggttttcaccatgttggacaggctggactcgaactcctgacctcaggtgatccacccacctcagcctcccaaagtgctgggttacaggcacgagccaccatgcccggcctgttctctcatttttttttacatagatatgtactcatttttcaattagaggaaaacaaagattagactttttcactgctccccttataacataaactattcaagaagagagtgcctggccaggccctggagcctggagccccacaggaggacagaccaccctgacttgacaatttaagctcagtgttcctgtgacttggctaacctatatgtctaaaactcaatctcagatacagaaaaggaagccaacgctgggcgcggtggctcatgcttgtaatcccagcactttgggaggccaaggcaggtggatcacctgaggtcgggagttcaagaccagcctgaccaacatggagaaaccccgtctctactaaaaatacaaaaaagtagccaggcctggtggtgcatgcctgtaatcccagctacgcaggaggctgaggcaggagaattgcttgaacccaggaggcggaggttatggtgagctgagattgcgccattgcactctggcatgggcaacaagaacaaaactccatctcgggaaaaaaagaagaataaatttcttaggtcaggcatggtggcacaggcctgtattcccagcactttgagaggccaaaagtggacaaatcacctgaggtcaggggtttgagaccagcctggccaacatggctaaaccctgtgtctactaaaaatacaaaaaaaatcactgggcatggtggtgcatgcctgtaatactagctagtaggaaggctgaggcatgagaattgcttgaacccagaaggcagaggttgcagtgagccaagaccacaccactgcattccatcctgggcaacagagtgagacactgtctcaataaatacataaataagccgggcatggtggcccatgcctgtaatcccagcactttgggaggccgaggtggatcacttgagatcaggagtttgagaccagcctgtccaacatggtgaaaccccatccctactaaaaaaaaaaaaatacaaaaattagccaggtatggtggcatacacctgtaaccccaactactcaggaggctgaggcagaagaattgcttgaacccaggagccggaggctgcagtgagccgagactgcaccactgcactccagcctgggcaaaagagtgagactctgtctcaaaaaataaaaaataagtaataaataaataaatttattggctgggcgtgatggctcacgcctgtaatcccagcactttgggagaccaaggcaggcggatcacaaggtcaggagttcgagaccagcctgaccaacatggtaaaaccccgtctccactaaaaatacaaaaattagctggcgtggtgccacgggcctgtaatcccagctacccaggaggctgaggcaggagaatcgcttgaacccaggaggcggaggttgcagggagccaagaacgcgcctctgcactccagcctgggtgaaagaacaagactccatctcaattaaaaaaaaaaaaatttcttataataccattatactcctatcagaatggctgaaacaaaaggtgacggacaataccaagtgttgatgaggacatggaacaactgaccagcttggtggaagtataaattagtacaattgctttggaaaattatcattttcttctaaagctaaacacaaatataccctagggcccagcaaagccacataatacatactgaatgatgtgttcaagaatgttcatagcagccgggcgcggtggctcacgcctgtaatcccagcactttgggaggccgaggcgggcaggtcacaagatcaagaccatcctggctaacaaggtgaaacctcgtctctatgaaaaatacaaaaaattagccaggcgtggtggtgggcgcctgtagtcccagctactctggaggctgaggcaggagaatggcgtgaacctgggaggcggagcttgcagtgagccgagatcgtgccactgaactccagcctgggcgacagagcgagactccatctcaaagaaaaaaaaaaaagttcatagctgcactattcatgacattaatttcaaataaaagcttaataacactaagagatactgcacatgccaagatggcaataaatgagacgctttctacgttagtttccttgggctgccataataaaatatcatagactggatggcttaaacaacagaaacttattttctcacagtcctggaggccagaaatccaagaacaaggtgtcagcagggttggtttctcctgaggcctctctccttggcttgcagacagccaccttccccctgtgtcctcacacggtcttttctctggtgtctctgtctttttttttttttctttctttctttctttttgagatggagtctcgctctgtcgcccaggctggagtgcaggggcatgatcttggctcactgcaacctccgcttcctgggttaaagcaattctcctgcctcggccttcctagtagctgagattacaggtgcacgccaccacacctggctaatttttgtaattttagtagagatgggatatcaccatgttggccaggctggttttgaactcctgacctcaggtgatccacctgcctcagcctcctaaagttctgggattacaggtgtgagccaccatgcccagcctctctttctgtcttaatctcctcctataaggtcaccgggctggatggaaaagggcccatcctaacagcttcattttaaattgatcacctctttaaaggccccctgtctccaaatgcagtcacattctgaggtgctggggattccagcttcaaacgtgaatttggggaggtgtgggggatccacgtctgcaacatttcccaaatgttctaacagcacaaggcttccttaattactaaatcagaaagctgacctcatagcaagaacaatagtccagactatatgaatttctcatccaacaggtgtcttgagttttgttttcggttttgttttttttttaaaaagacaggatgagacaccttaaaaggactatggccactcagtgagtatcagcttccttagtccagtggctctgagggccattcaccccccagaggacacttggcaatgtctggagacattcttgattgtcacaaggtggggaggggatggcactggcatctagtgggcagaggccagggatgttgctaaacatcctacaatgcccaggacagcctccataacagggaatcatcaaacccaaaatatcggccaggcgcagcatatttttagtagagacagggtttcaccatgttggccaggttggtcttgaactcctgaccttaagtgagccacccacctcggcctcccaaagtgctgggattacaagtgtgagccaccaagcccggccccaagcctgactttatctcatcactgcaaactgcccgtggcacgtgggagatcctgccaggcccacggtaggagcagggcactgttgacactacaaactgattcttccttggggaccgccgccaacaggcttttccttggcatttgctaaatgccacagagatttaattggggcgaaggaagagcatccggcccagtccacctttccaattctcaccagaagcctttccctgctcgcacagggcctcttccaactgtcttcccccagagtttctgcaaattctgtttagacaaaaataaaagcagggccaggcacagtggctgctgcctgtagtcccagcactttgacaggcagaggttggcggactgctttagctcaagagtttgaaaccagcctgagcaacatggagaaaccccatctctataaaaaaatacaaaaattagccaggtatggtggtgcatgtttgtaatcccagctactggggaggctgcagcggtaggattgtttgaacccaggaggctgaggttgcagtgagatcgcacccactgtactccagcctgagcaatagaatgagagtacgtctcaaaaaaaaaaaaaggttttaaatgtataagcacaaccaactatcctatttctttccccttgtagcagtaacattatgtgtttagactgcgccatttcagcatgggccactaattcctaaatgtcaggcatgacttggggtatttacaaatctcaggaacttttatagacttcatggttttctttaaattgactgccttttatttaaattctaaaaggaaacttcctgccatgacacaagaaagcaagtatcatttggtacaaacagaagggctcataaaaataattgctaacctttcatacatatattaatctttcaaactcacaaattagagaaaacagatactagttgttaaaatcagaatcattctaaatgtcatcaataaaaatgttataattagtctttttctttccaaattaaaccaaaatcaccaccttcatgagtgaccctgaagacacgtcccaacccctccaccccttcaaaggcagtcataaaatacagccagcccttatcactgactttcaacatttccatctgggtaaagacactaaaagaacattctgttctgagaagtaagggacaaaagtccaaagatggccggttccatgccttgcctcctttttccaacttattgcatgcaagacagaggtcaaggtcaaagggtgcccccatctccttgcggactggactacagggacctcctctcgccagccagctgtacagtaggtagaaagagcccttttgggctgggcgcagtggcttatgcttgtaatcccagcactttggaaggccaaggcgggcggatcatgaggtcaagagttcgagaccagcctgcagaacatggtgaaaccccgtctctactaaaaatacaaaaattagccagccatggtggcctgcacctgtaatcccagctactcaggaggctgaggaaggagaatcgcttgaactcgggaggcggaggttccagtgagccgagatcataccactgcactccagcctgggcaacagaaggagactctgtctcaaaaaagaaaagaaagagcccgtctgcaaggaagcccggcaggcacggcacccatgtccacactccatccttcagagtccctctgtgggtttgcaacaacacatcttctggtctccacgtgggcagagagcagctagtctggttttggtcagcacaaggcagagcaagggaggacctctgtaactgaaggggatggcgcaagtgcagctgggcgctggcagaggacagagagcacagccccatgggccgctgccaagctccactgttctcatcccaggggggcaaagagctgttggtgcaactctctcctccagcccagagaggggaaggtcggtggctgaggaggggggtgtctctgggtttcacccaccagcacaatcccctccctcaaaacatacccctatatgcttggtatctaatactccctccaccacatcaaagaaaggatgttaaaatgtacacacacggccgggtgcggtggctcatgcctgtgatcccagcactttgggaggccgaggtgggtggatcacctgaggtcaggagttcgaaaccagcatggccaacagggcaaaactctgtctctactaaaaccacaaaaattagctaggcgtggtggcgggtgcctgtaatcccatgtactcaggaggctgaggcaagagaatcgcttgaacctcagaggcagaggttgcagtgagccgagatcgcaccactacactccatcctgggcgacaagagcaagattctgtcacaaaaataataataataataaataaaattaaaaaataaaataagatgtacacacacccctacatgccacatatctaatactatctccactttgtcaaaggaaggacattgaaacacacacccaccccactatatacaattgatcctcataatttataatttctgtatttgcaaattcaccaaatccctcaaacttgtaatcccaaatcaacagctgcagccccttcacagtcactaatggatgcgtgcagtgtagccaaaatggtgagttgctcctccctgccccgcccccagacacacacattcccagctgaggtgacacaaggcttctcattgcagctctcacactacaaataggagtcatttttgtggtctcttactgccacgatttgtgcatttttgtgcttttccctgatggttttgcagtttaaaatggcccctcagcacagtgcagaagaactagtatctctaagcacaggaaggctgggatgtgccacgtggaaaaaatacacgtgtcagataagctgcctccaggcgtgagttacagagttgttgcctgtgagttcgatgttaatgaatccataacgtacattaaatatgcggtttttaaaaaacagaaacacacctaaaacgaggttcttcattgatcagtcaacaaaaataatgtgaccagagcctctcaggaacctaaccccatatttcccctaagagcaatggttccatattcgaaaattcagtgctcacaacgactgaaataaagaatgtaagtactgggcagggcacggtggctcacatctgtaatcccagcactttgggaggccaaggcaggcggatcacctgaggtcaggagttcgagactagcctggccaacatggcgaaaccccgtctctactaaaactacaaaaattagccgggcatactggtaggcatgtgtaatcccagctacttgggaggctgaggcaggagaatcacttgaactgggaggtggaggttgcagtgagccaagatcacgccactgcactccagcctgggcgacagagcaagactccgtctcaaaaaaaaaaaaaaaaatgccaggtgcagtggctcacgcctgtaatcgcaacactttgggaggccgaggcaggcggatcacaaagtcaagagatcaagaccatcctggtcaacatggtgaaaccctgtctctactaaaaatacaaaaattagctgggcgtggtggtggcgcaggcctgtagtagtcccagctacttgggaggctgaagcagagaattgcttaaacccaggaggcagaggttgcagtgagccgagactgcgccactgcactccagcctgagtgagagtgagactccgtctcaaaataaaaaacaagaatgtaagtcctgagagtaatgagagtcctacctaacaccacctccatcacatcaaagagaaagggcatttttgtttccttatcagtaaagcaagaataaaaaaaattaccaacatcaaagggccattgtgcagcatgaaagaggaaacatgagttcagagccaaaacactgcaggtcctaaataaatattcatctttttcctccaccgtcagataatgagtcacataaacatgctgacataagctctatgctctcaggcaaaatgtaggacctctgaaatgcctctgatgcctccacccaggtggcgggcttcctgtctagattccagtcccctttgtgggatggaaagaggagcacgacaatccgttcccagggtctgcagcacacatcggtgtgtgacagcttctcctcattgttgtaacaaattagcacaactttggccgggcgccgtggctcacggctgtaatcccagcactttgggaggccaaggcgggcagatcacgaggtcaggagatccagaccatcctggctaacacggtgaaaccccgtctctaataaaatacaaaaaattagccgagcgtggtgacaggcgcctgtagtcccagctactcgggaggctgagacaggagaatggcgcgaacccggaaggcggagcttgcagtgagccaaggttgcgccactgcactccagcctgggcgacagagcgagactccgcctcaaaaaaaaaaaaaaattagcacaacttgagtggcttaaaacaatgcaagtttattaccctacagttaggtccgaagtccaaaatgggcctcatgggactaaaatcaaggaaggtgtcagcagagccgtgttccttctggaggctccaaccgagtccgtttccttaactcttccaacttctagagtcccccgcattccttggctcatggccccttcttccctcttcaagccagcagtgcagcctctcccaatctttctcttatgctgacactcactctcctgcctgtctttcgcttttaaggaccctgtgataacactgggccgggccagggtcagtggctcacacctgtaatctcagcattttgggaggccaaggtgggcagataacttgaggtcaggagttcaaggccagcttggccaatacggtgaagccccgtctctaccaaaaatacaaaaattaggccaggcatggtggctcacgcctgtaatcccagcacttagggaggccaaggtgagcggatcatgaggtcaagagatcgagaccatctcggtcaacacggtgaaaccccatctctactaaaaatacaattagctgggcgtggtggcatgcgcctgtagtcccagctactccggaggctggggcaggagaactgcttgaaccgggaggcagaggttgcagtgagccaagatcacaccactgcactccagcctagtgacagagcaagactctgtctcaaaaaaaaaaaaaaaattagctgggcgtggcggcgggagcctgtaatcccagctacgcaggaggccgatgcatgagaatcgcttgaacccgggaggtggaggttgcagtgagtagagatcatgccactgcactccagcctgggtgacaagagcgagaccctgtctaaaaacaaacaaacaaaaagatttaaggtgatatatccacaaatggcttttttttttttttttttttttgagacagggtctcactctgttgccgaggctggagtgcagcggtatgatcagggtttaccgccacctacgcttcctgggctcaagcactcctcctacctcagcctcccaagtagcaaggaccacaggctcaagccaccatgcctggctttttttattattattatttattttttgtagagacagggtttcactatgttgcccaggctgctcttgaactccagggctcaagcaatcctcctgcctgggcctcccaaagtgctgggattacaggtgtgagccaccaagcccaactgaaattctattacacaataaaaagaaacttcaaaaacttcatgctaaattaaagcagccagacacaaaaggcaacacgtggtgtgattccattgatagacaatttccagaaagggcaaacctatggaatcagaaagcggatcactggttgcctgggactggggcaagggcagggatgaattgcagatgggctggaggagactttcggaggtgatggaaacattcaaaacccatgccggagtgatggttgcataactccatacacctggtttttttttaatcaatggtttacatacttttttttttttttttgagatggagtctcgctgtgtcgcccaggctacagtgcagtggcgcgatctcggctcactgccagctctgcctcctgggttcacgccattctcctgcctcagcctcctgagtagctgggactacaagtgcccgccaccacacccagctaattttttgtatttttagtagagatggggtttcacttgtgttagccaggatggtctggatctcctgacctcctgatccgcccaccttggcctcccaaagtgctgggattacaggaatgagccaccgcacctggccagtttacatactttcaatagatgtatgctatataaattatacttcaataaagctgtttaaaacattgtggtagacaacatatctattcagttcttctttctcaatctgattcatattcaaaacttcctagtcccccaaatccaaatatatcaagcatcaaagcatcctcatccagtgtggccacccacaaaacgtagattgttacaatgaggcaaagtcttgggccacctggtacctaagctcccatccttgccacaacatcacaccagggcctcgacatacctggacagaatgctctacatagttattcattttcctaaatttgatcaggaaaaagcagtgaaattcatatttctaaatttctcataaaaggcccctcctctcaaagaagcacactgtagaccccaacggtaaacctcatgcaaacacctaaggattaccattagccctagtaaacacctaaggcatactgagcacttattctcctaaactttacatggactaaaaaactatgagatacataattattgatattcccattttacagatgaaacaactgagactcagagaggtaaagttattttcccaagatcacacagctagtaagcagcagagcctgggtgtgaacccagctcctcaatggactcctgcgtcctggctcctaacaaataatccctgccatttcaccacaagaggagctccattcagccataagcaaagggcatgatgtcataaaatggtttccagcaatggaggtgaaatgccttgtttcctaactacaccatttcaaaagttttctcaacatcaggatgtggtaactttctcaagagagaaaagaactttgaagccaggagattcctccaaaaataagctgcacgtcttcgcaacattcgctgagtgaccccagaaataactgcattctgtcccctatgacatgtggcatcgtttttggtttttttaaccacaaatcttccaaccattccacagctttattgcctagaaccattaggtgaaatgggtggatccggttcaaaactgcctcctctcacaacctccaagaccacgaacacattaatatcagtgaatctttgtttccctgtcaataaaatgggagaatttttttttttgagatggagtcttgcttcttcacccaggctggagtgcagtggtacaatcctgactcaccgcaacctccacatcctgggttcaagcaattctcctgcctcagcctccccagtagctggaattacaggcaccaccaccacacccggctaatttttgtatttttagtagagacagggtttcaccatgttggccaggctggtctcgaactcctgacctcgagtgatccgcccaccttggcctcccaaagtgctgggattacaggcttgaaccaccacatctggcccctaaaatgggagaattaactccaaaaactcacatggttgttgtaaggattaaaacagccctatttatctcaagtgtccagcagacagcctgacccattacatattacttttttcttcctttaaccacccacccactttagccctcacgctgccatcccccagcccctagttctatttcaggaagctcctccatctctctgtgcttctcaagagtttctaaacttcaggattccaccttgatgttgctactcctgaaaatgcagattatatacaagagcatttacgcaaatgcacagcaaccctgatacacaatttgaatccaaatccatgtcactgtttaagaaatagattggccagacacagtggctcacatctgtaatcacagcactttgggaggccaaggtgggtggatcacctgaggtaaggagttcgagaccagcctgaccaacatggagaaaccccatctgtactaaaaatacaaaatttgccgggcatggtgcatgcctgtaatcccagctactcaggaggctgattcaaggagaatcgcttgaacctggaatgcggacgttgcagtgagccgagatcgtgccagccttggcaacaagagtgaagctacatctcaaaaaaaaaaaacagaattagattagttccaggccaagcacggtggctcacgtctgtaatcccagcactttcggaggccaaggcaggtggatcacctgaggtcaggagttcaagaccagcctggccaacatggtgaaacaactctctctactaaaaatacaaagattagccgggagtggtagtgggcacctgtaatcccagctacttgggaagctgaggcagaagaatcgcttgaacccaggaggcagaggttgcagtgggccaagaccaaggcattgcactccaggcaacaagagtgaaactacatcgtctcaaaaaaaaagaaagattagttccaaagctggtaaattctaaaggggctgtgatgctccattccaacgcaacctagaaaacttacttttaaataaaattatctgcaccactccctctggctctccatatgaacggctcatgtttctatcacgctaatgatcacttttgaacaatatttgcatttttctttcatgtactgactcaaaagttctcaactctgactgcatgttaaaatcatcaggggagcttattaaaatatatagatagaaacccaggtcccaccctaaattcttatttcaaaggtctagaatgaatcagaaaaggctagttaagtttccctggtgattgcaatgaacagccagggtcaggacacccacacctgttgggcaggtcttctttaattcatccttgcatccccatcagctggagtggctcctgcacatagtaggcgtctcataattgctcatggcacaaattaataaccactggattttagactccactgatcatattaattcatcacagtatttacggaggatgtacgatgtaccaggcactgttccaggcatagtgttcaagtcaattgtcatcattaaaacgaaggaggccgggcgcggtgactcacgcctgtaatcccagcactttggaaggccgaggtgggtggatcacgaggtcaggagttcaagacaagcctggccaagatggtgaaacccccgtctctactaaaaatacaaaaactagtcaggcgtggtgtcgggcgcctgtaatcccagctactcgggaggttgaggcagagaattgcttgaacccgggaggcggaggttgcagtgagccgagatctcgccacagcactccagcgtgggcaacagagggagactccgtctcaataataataataatactaataataataaacgcaaaacagagaagggaggagtgagggaactatctttgggtcagacaatccggagttcaatctccattttgcagtcttccctatagcccttaacctccgtaacctccagtttcctcctctgggtaatatcagtgaggcctcttcttcggaggattcaggaagccagggacaaagaccccacaaaatggccgccagcaccattctttttttttttttttttaattccactgacacctggtgaagccacccttatggttcactccacccgccgcgtctcctgttccgagcaactgacgctgcaataagcggccgccaccgggaaatgcccagagaggaccagacgcccgaggaagggcggagcagagcggccgcaggccccgcccaacaccgcgctcagcctcccgcgggctccagcctcacctgcgcggcctgtggagctgcacatctccaggccccgccccccagaactctgattggcgggtctaggcgggggccgggaaatctgcatttgcaccagcgcccacccccgtccttcccacccccgcccctcacgcccaggtaagtctatggcaggcgatacgagagccccgcaaacctcaacgcgtcacgctgccatcctccgaacaggaagacggcgaggcgcaaaataccaacccgtcccctcttcccaaatgcagaaaaacccttgcctgttccgcgcctaagctgccctcggggtctcctactgcgggaagggcacagcaggtggcagcccctgtcccagccgtgggattccttccccgaaattgtggggggagaacacaaggggtagtgtcaccaagcggccagtaggagaccctcccaccctcctgcgactgctggttcgggtccaccccgggcggagggggaaggggccaccggagcgcaggtggtctcggcgcagcctcctggggctgggacccaggggcgctgatggggtaccccgaggcgtaggccgcgcccccctaaaagctgagcatatctgggctcccgagtaatgctccaagcgcagagctcggtgtgacactgaccaaattgttacctcagatattaattacggacagatattaattacggaacaataaaacggtgagaaagcacggctgatccgaattccgcgagtgtgtaaacagcactggggcgggcccggcttctcggggtttctaaaggaaggtgggcaaggaggcccaggcaaccgggcgctcgaaccccaaagggccggcatcaggctaggtgccgcccggggctgaagcgcagggaccccctccccacctccccgcctccccagccctgccccaggctcatggcgccgggcgcggcgcgcggccaacctgtcaggcccggccaggctggcccgagcgccgggctccgggaggcgcggacaaaggaaaacacgggcccaggcccactcacccggcgcggggcctgctgtccatccgcttcttctggcgcaccggctgcagcgggatgttgtccgtcatgtcggcggcgccgcccgccttggccgccgcgccccccgcgccgcctgggccgccgcccggtccggcctccgcgccgccgcccgccggcgccgcgccgccccgggggaggaggcggcggcagcgggcgggccgggcccgcagcgagggggcgagctcgcgagcgccgggccacgcgcggagcgcccgcgcggcccgaccgacggacacgggcgcaccatgggcccgagctccgcgctgcgcccgctcgctccgcgccgcgccgcgcctgccacggggggcggccgggccgtgtccgcgccgccgcgaccgctgcagtgtccccgcccccggcccgcgcccgcgccccccacgcgcgcccacccggccacgcgccccccgcccacgcccgccgtgcgcgcaccctgccaccgcaccccccgcaaaatcccacattcacaatcacatcccagccctatacacgcgcgctgtgacactcatccccaccaatatctgacatgcacaatcacacgggcacccggccacgctcaccccatcagtcagtcattctcactcactcttgcaccaacgtgcatattcacgcccaggccctacacacacacctgccactgctcactgcctgcaacatctaacattcacaatcacatgtgagtcctgcacacacacataacactctcaccctcctgttggtcaccatcatccatgcacccagtttctcaagcctcacacccatgtgcctgcagaaatcacagtcacacagggaccctcagcttatcagactccttcaccctctgaccttcaccatcctcaccctcattctctatctggattctgggaactcaccatgacacacacgcacctgcctctttcatccaaacacccttcaatagtctgaacaccctcattctcacaccagccactttcttgggcttgcacatgggccccactctcaggcctcagacagtcaccctgcattacctgtcactgtgattcacggtctcacacacacacctatctccaccgcagcccacatccacactcacttccacaccctcccacacagtgtctgggacccatgaacttttcaaaggcctgataaagttatgagagcaggaaaaaaaaaacagagggaaggaacaaagtgagggagtttaaaaatcaatatgtaactaaagagcctgaaattgtaataataccatataaactaatctaaagctgacttttacatagttacatctaatgactgatcatgttggacgccgtttcttttttttctttttgaaacagaatctccctctgtcgcccaggctggagtgcagtggcaaaatctcagctcactgcaatctctgcctcccaggttgaagcaattctcctgcctcagctacccgggtagctggggttatacatgtgcctggctaatttttgtagttttagtagagatggggtttcaccatgttggccagactggtcttgaactcctggcctcatgtgatctgtccacctcggcctcccaaagtgctgggctcttccttggcatttgctaaatgccatagagatttaattgggatgaaggaagagcatccggcccagtccacctttccaactctcaccagaagcctttccctgctcccacgggccactgcgcttggcccttttattttgttttatttgtttgtttttttaagttagtgctaactgccagcaagtggatgccttttgtgtttgctgtcacacaggatggagccaccaaatatcccagtgtctgaggtggatctcaaaccaagaagtgtgacttatctcatgcaccagagaagttcctcaagaaaagaagcatgtcattagtaattgctgcattgcacatttggagaggaaatagcattctccagccaacaggcctggtgtgctttgcttcctgctgtctcttctacatctaaaatgatgcttcgtacatagcatggcacaagttggcactcaataaaggcttcttgcatggaagaaggataaacaccctgacacaccaattatggcatcagtgtgggtcccaccatctcccatctgctttgctagacatccccctttcaaactccacaccctcttctcaaccccactactacacagggtacaagagaagaccaaggaggccgggcgcggtggctcacacctctaatcctgacactttgggaggccgaggtgggcggatcacttgaggtcaggcattcgagatcagcctggccaacatggtgaaaccccatctctactaaaaaacaaaaatacaaaaatatattaaaatcacccgggcacggccgggcgcagtggctcacgcctgtaatcccagcactttgggaggccaatgcgggcagatcacgggtcaggagttcgagaccagcctggccaacatagtgaaatcctgtctctactaaaaatacaaaaacttagccacgcatggtggcaggcactggtaatctcagctactcaggaggttaaggcaggagaattgcttgaacccgggaggcggaggttgcagtgagccgagatcatgccattgcactctagcccaggcaacagtgcgagactctgtttcaaaaaaaaaaaaaaaagaaagaaaaggttagctattaaaagtcctacttctatgatatgaatattcatagttttccctaattcaagaatgaacacaacagcattatcaatgctcatccctgaaagattccaggtgggtttttaaaatacaatttaattagcaggattttttgttttagtagttttccatttatagaaaacataagcaattagcacagagagtttcatatgtccccatcctatatccatgtccccagtcatggggacagtttcccttattaacattttgcggtacatccaggtggatcttaaatatttcattgcttttgttttgtcaatactctctactttttctctagcaaaacgtgttgcttttgcaataattttttctttaaataagtttttaaaagatgaaagagcccactattaaccctcaaaggtactaacactctcatatggaaagagagggggaaattgtaggtggttttttgttttgttttgttttgtttttgcctttttactttccaaattttctttctttatttatttatttttatttttgagatggagtctcactctgtcgcccaggctggagtgcagtggcacaatctcagctcactgcaggctccgcctcccgggttcacgccattttcctgcctcagcctccccagtagctgggactacaggcgcccatcaccatgcccagctaatttttgtatttttagcaaagacagggtttcaccatgttagccaggatggtctcgatctcctgacctcctgatccacctgcctcggcctcccaaagtgctgggattacaggcgtgagccactgcaaccggcctttactttccaaattttctttagtacgctttcataatcagaggagaaaatacatttaaaaaaactcctttttgtttttattcttattattttttgagacagagtctcactctgctgcccaggctggattgcagtggcatgatctcagctcactgcaacctccgcctcccaggttcaagcgattctcccgcctcagcctcctgagtagctggggctacaggcacacaccaacatgaccggctaatttttatatttttagtagagaagaggtttcaccatgttagccaggctggtctcaaactcctgacctcaggtgatccacctgcctcgcctccctaagtactgggattacaggcatgagccactgcgcatggccgtttttattttaagagacagagtcttgctctattgtagctgggactacaggtgtgcactgcatgccaggctaatttattttattttttatagagacaaggtctcactatgttgcccaggctggccttgacctcctgggctcaagccatcctcctgccttgacctcctagtgtcctgggattacaggtgtgagccactgcaccaggccgaaactccttttcagcaaggtaatccctcaggaagggacgcacctgcaggcttaaatctcatcttgagagagaatcagatgcctgcttgggacaagcgagacacccaagggatcaccagagcggtgccagggtctaggagaggggcaaggctgggggaagtgatgagatgtgagaggttaatctgaggcccccttctgggtatacagcaacccctcttcctgacacagcactaccttctgcccaggaatagtcacctcatggttctgcttcctcaggaaaagccccttgacaatcctctccatccaataggtcctgggtacagtgcacccctgactcctaggtatgtggagtggaaaggtcctggagggataagccaatctagtccaacttctactttccagaaatcagagagactgtggcccaaagaggtcatgtcacatgcctctatgtcacatgccatccatgcccgatggatgacaggctggagccggaatataccttgaaactctcatcttggcccaccatgaagccttatgttcatagacctccaagcccactcctgctttattatttatttgtttgtttgtttgtttgtttggagatggagtctcactctgttgcccaggctgaagtgcagtggcatgatctcagctcactacaacctccaactcccaggttcaagcaattctcccacctcagcctcccaagtagctgggattacaggcgcgcgccactatacccggctaatttttgtatttttagttgagacgggttttcgccatgttggccaggctgatctcgagctcctggcttcaggtaatccacccgcctcagcctcccagagtgctgggattatgggtgtgagccactgcgccctgccccactgctactttggacctgctgtaaagaaggagtgtttggtggtaagtgggcaagaagtcaagggtacgggcagtgatgagagatggaggaggcagggaaaatgggaataaataataaatatgctttgggtaaactcaggctgggagtgagaaaataaaatccttttagtgcctacaattctctctccatgaattctctctgaataaacattctaggtatcccccaaagcagtttccctaccttggcactattgacatttgggctgaatatttatcatggggggctgtgctatgcattacaggaaatttagcagcattcttggtctctacccactaaatgccagtagctgcctcacaccagctgtgacaaccacaaatgttttcacacatcatgaaatgtctcctggggagacaaaattgtccctagttaagagccactgggctagaatgtgatgttaaatcattttaaaatctctaataagactgtgtgtgtcatttttttttttttttttttttgagacagagtctccttctgtcacctgggctggagtgcagtggcaccatctcccgggttcaagcgattctcctgtctcagccccccgagtagctgggataacaggtgtgtgcctccaagcccggcaaatttttgtatttttagtagagagggggtttcaccatgttggccaggctgctcttgaacttctggcctcaagtgatcctcccgccttggcctcccaaagtgctgagattacaagcctggcgtgagccactgtgcccaaccaactgtgtctctctctaacacttaccaatccagtcctttcccaaccctttgttttttgttttttttggaaagaaaaagaacgtcttaggttgagaactttccatgaacaacaatatctagctaaaatttaataatattctgggctgtgtgtgtattttttagatagagttggccaggcacagtggctcacgcctataatcccagcactttgggaggccgaggcaggtggatcacgaggtcaggagatcgagaccatcctggctaacacagtgaaaccccgtctctactaaaaatacaaaaaatcagctgggcgtggtggtgggtgcctgtagtcccagctactcgggaggctgcgacgggagaatggcatgaacctgggaggcggagcttgcagtgagccgagatcacgccactgcactacagcctgggcaacagagcgagactccatctgagatagtcttgctctgtcccgcccaggctagagtgcagtagcgcgatcatggctcactgcaaccttggccgcccatgctcaaactatcctcccacctcagtcccccaagaagctggaactacaggcattcatcaccatgcccagctaatttctgaaatttttttgtagagacggttttgccatgttgcccaggctggtctcaaactcctgagctctaatgagcctcctgtgttagcctcccaaagtgctaggattagaggcgtgagcaattacatccaaaaatattctgttttcacctccaaaaagggcactaagaaggttgggggaaaaaaatcaacagatgtccaatcattccgtcaagcagtcttcactaaacacctacaatggtctatgcatagagggtacagtcagacacagcccctgtttcaaggagatgacatcctagtaaaggttgttaaaaacttagaaagcatcggccaggcgcagtggctcacacctgtaatcctggcactttgggaggccaaggcgggggggggtggggcagatcacctgaggtcgggagttcaagaccagcctgaccaacatgaagaaaccccatctctactaaaaatacaaaattagccgagtgtggaggcgcatgcctataatcccagctactggggaggctgaggcaggagaactgcttgaacccaggaggcggaggttgcggtgagccaagattgcaccactgcactccagcctgggcaacaagagcaaaactctgtctcaaaaaaaaaaaaaaaaaattgaaagcatcaaaaagatgacttgatagcttgccttagcatacccttccaggttccctgtgtctttcatcgtccttgagctattttacaactctataaattgtagaaaactgataattatgcaaatgattcttgtccatagaaatgcaaattattttgtccagtggaatgcagttattgcctgtggatattgatcatgttttgcatctgtttgtaagttcttttcaacattcctaattgccagcaatttaggagctcattttaaattctcctctgaatcaactgtaaatttattaataattctttgacatgtgttcattttatacaggcatacctgagagatattgtgggtttggctccagatgaaaaaagaaaacaacttttatctcaggaatgtgagtgtttttaaattatcaggcccagagagacattaaaatgaagcagcaatcacgttctactccctcctttgagctatgtattcatctcctgaaactgcccgttattgccacaagtagctagaaattaacctaataatgctgcaccagacactataacccacaccccataggttagcaatgtatagtcaattactaatcaatgttatttctgtaaaccaatgagaatttctgatgaacaagtttgtatcagcccactccctgtccgcttttttaccctttaaatacctgcttatggcctggtccagtggcttgcgcatgtaatcccagcactttaggaggccgaggaagtaggactccttcacccgtctgtacaaaaaaataaaagaattagctgggtcacggtggcacacgcctgtaatgccagctacttaggaagctgaggtgggaggattgcttgagccaaggaggctgaggctgtagtgagccatgattgtgccactgcactccaggctgggtgacagagcgaaaccttgtcaaataaatacataaatgggccagactcagtggctcatgcctgtaatcccagcgctttgggaggccaagatgacaggatcacttgagcctgggagttcaagacctgcttgggcaatatagtgagaccttgtctctacaaaaaatacaaaaattagctgggcatggtggtacacgcctgtagtctcagctactcaggaggctgagttgggcagattgcatgagcctaggaggttgaggttgcagcgagccatgttcacatcactgcacgccagcctgggtgacagggtcttgctctgtcacccagtctagagggcagtgattaatcaatcaaccaacctacctgttggtaacaaaagccatacagaggtcatatccaaggttacttggggctgagtcttccaagcagctgtcctcactttggctcaagtaaactctaaattgtattttgtgcctcagcctcttccttttagatcaacacagaccacaacaataaagcaaatattgcaataaagcaagtcatatgactttggtttcccagtgtatataaaagctacgtttacactatatcctgttaagtgtgtaatagcattacatctaaaaaacaatgtacaggccggccacggtggctcacgcctataatcccagcactttgggaggctgaggcaggcgaatcatgaggtcaggacttcgagaccagcctggccatcatggtgaaaccccatctctactaaaaatacaaaaaattagctgggcatagtggcaggcacctgtaatcccagctattcgggaggctgaggcaggagaattgcttgaacctgggaggcagaggttgcagtgagccaagatcgcaccagtgtactccagcctgggagacagagtgagactccatctcgggaaaaacaaaaaacaaaccaaaaaaaaaaacaacgtacataccttaattataaattcctttattgttaaagatgttaatgatcctctgagccttctggagtcgtaatttttttgccggtgaaggatcttaccttgatgttgatggctgttcactgatcagggtggtggttgctgaaggttgggatggctatgccaatttctttaaaataagacaacaatgatgttggctatattgattctttatctgagatttctttgtaacttgtgatactgtctgaaaatattttacccacaacaggccgggcgcggtggctcatgcctgtaatcccagcactttgggaggccgaggcgggtggatcacaaggtcaggagatcgagaccatcctggctaacacggtgaaatcccatctctactaaaaatacaaaaaaaattacttgggcgtggtggcagacgcctgtagtcccagctacttgggaagctgaggcagaagaaccacttgaacatgggaggcagaggttgcagtgagctgagattgcgccactgcactccagcctgggtgacagagcgagactctgtctcaatctcaaaaaatactttctttgctcatctgtaagaagcagttctttattcattcaagttttctcctaagattgccaccattcagtcacatcttcaagcttcactgctatttccagctctcttgctatctccatcatatctgcagttacttcctccactgaattttgttgtttgtaaagacaggatttcactgtgttgactgggttggtcttgaactcctggctctcaagccatcctcctcggcctcccaaagtgctgggattacaggcataagccacggtgcctggctctttcactgaagtcttgaacccatcaaagtcatccatgagggttggaagccacttcttccaaactcctgtttatgttgatattttgaccttctcccatgaattacgaatgtttttaacaacatctagaatggtgaatcctttccaggttttcactttactttgcccagacccatcagagaaataacaaactatggcagcttacaaaatgtagtatttctgaaataataagacctggaagttgaaactcttagaggcatttgaaccagagccactccatctcgaacaggagctggggaaaataaagctgagacctactgggctgcattcccaggaggttaaggcattcttagtcacaggatgagataggaggtcagcacaagatacaggtcataaagaccttgctga

SEQ ID NO: 1221 - DNA, 26939 bp, Homo sapiens
gtgagctcctggctgacatccttgaagaggtgaggaaggccattggagtcaccttcccccaagacaaacgctgatgtatccccgaataaataaagacatcttacatcttcgtggtagtggtttggcagaagctggagaacccagtatcaaagggtcactagaaaagaatttgggcagggctgggcatggcagctcatgcctgtaatcccagcactttgggaggccgaggagggtggatcacctgaggtcaggagtttgagaccagcctgaccaacatggtgaaaccccatctctactaaaaatacaaaattagccgggcataatgacgcatgcctgtaatcccagctacttgggaggctgaggcgggagaatcacttgaacctgggaggcggaggttgcggtgagccgagatcgtgccattgcactccagcctgggcaacaagagcgaaactctatctcaaagaaaaaaaaaagaaagaaaaaaaaaataattcgggcagaatgatgagggaaggccgggcatggtggctcacacctgtaatctcagcacttcgagaggccaaggtgggagacttgcttgaggccaggatttcgagaccagcctgggtaacatgacaggaccttgtctctacaaaaaataaaaatattatccaggcatggtggcccgcacctgtagtcccacctacttgggaggctgaagtgggaggactgcttgagtccaggaggttgaaactgccgtgagtcatgattgcaccactgcacttcagcctgggtgacagagacagacccagtctcaaaaaaaaaagaatgattttggagagggaggaatgtgcagggtcaggaccacattcccagaagctcctggcacagacacctgtgggaagatccaccgtttgcctgtcacggcctctctggggtttgaccctcattgccttggagtgacttttgcaaaacaacttgatttctcacctcaaaaatcagtctttttctggactcctgaaagccacccagcttttgttcttgttgctcttcctgcctgtaattgtctctccttgaattcaatatagtagtcaggctgttcctttggacagtgtcagaaacacaactcagaatgtctccacaaggccaggcatgggggtcacagcactttgggaggctgagacaggaggaccacgtgaggccaggagtttgagaccaggctgggcaacatagtgagaccccgtctcttaaaaaaaaaaaaaaaaaaaagcctgcacaggaatggaatgcttggtaattaaagccttcagggcagggcaggcatcagcccaggactctgtttttctctatctctttgactttccttggcatgggttttaatggcagcagtgggccatctggtacagccggggccatcatgctggctgctgccgggagggcacagaaaagagatggacagaccctcacccctgcagtccgctgcccggggggctgcccccacagagctgggccgggttttgtgccaggtgagggggagctccaggccgtctctgagtgccagggtcacaggaggagctcacagccatgttgcttcggcccccgatgccagcccagtcctagtaaggacccagagctcccacccctggctgcacatgggtacagtcaggtgccatgcttcatggagctggcaggagctggggacacacgggagccctgccccttccaagatcaggagggtgagagctccgcaggagcaactgcagctgcccaggccgtggctgcaatccagacacccccgtgctattgggagctgggagtagacaggagccacacccagttgtgtctatggatgtggatgtgggcctcctgctctacagagcaggcaggagccccgccccccaaggcacagctgcagcccccaaaccggggctgtagacccaggcatccctgcactcctgagaggcctggaaaggcctcccttgtccttgtaggctcagaggtgcctgctaccactgcctggcctctccccactccctctcttgctctgatctcagagtggggttggggctgagcccaggtgctgacattgtccaccaggtgtgcacatgctcagggtagtgctaacatgtgcgagcactctgccaccttggcctcctccagacattgggtgccgaggagcacaagaggggaacctgagggggtgctaagggtggctgggtgctggcgtgaaggtgccccttggtgccagcagcctgggcaccatggatggccatgggaggcagacaggctcctgggcagaagggggcaggtccccagtgaagccccaccttcaggccaggcaggtttgaagcctgggggccagggtgccagtcctgtggactgaagggggaactcatggtgctttttcctgggcccacccatcctgccatggaccaataagcatgcacttcccctctgtgaggcccataaaagccccaggctcagccagagccagcagaggacagagagacaacaggatgaccagctacagagcggagctaccctctccagggctcctctctactgagagctgagcacttggtgggacaacctgcctacagagaagaactacccactgcgggtctcccctgagctgttgtaatactcaataaagctcctgtttgtctttttcacccttccgttgtctgcatacctcattcttcctggacacaggacaagaactagggcaaaggcaccaccagccacagaggtttctggccagaaaagcaacaccccaaagatcctgtaacagtttcaccagttaagtgtaggcctgggcactggagccagatggtgcctgtgacctcaggaaactaatagcgtgtgggtaggaagtgtccctaaatacactctcccccagcctctgtttgtctcttcatcagtaaaggggtactactaactttcctctgctgaggaataaatgagatggtgactgatggggccgggtgcggtggctcacgcctgtaatcccagcactttgggaggccgaggcaggcagatcatgaggtcaggagatcgagaccatcctggctaacacggtgaaaccccgtctctactaaaaatacaaaaatattagctgggtatagtggcgggcgcctatagtctcagctactcggaaggctgaggcaggagaatggcatgaacctgggagtcggagtttgctgtgagccaagatcacgccactgcactccagcctgggtgacacagtgagactccatctcaaaaaaaaaaaaaaaatgagaaggtgactgatatgtagtttggatctgagtccctgcccaaatcccatcttgaaatttaatttccagttttggaggcagggcctggtacaaggtgattggctcatgggggtggctttctcgtgaatggtttagcaccatcaccttggtatcaccctcacgacagtgagttctctcgagatctggtcatttgaaaatgtgtagtgttgggaatagacccccaaaatctggccataaactggccccaaaactggccataaacaaaatctctgcagcactgtgacatgtttgtgatggccatgacgcccatgccggaaggctgtgggtttactggaatgagggcaaggaatccctggccgacccagggtggaaaactgcttcaaggcgttcttaaaccacaaaaaatagcatgactgatctgtgccttcaggacatgttcctgctgcagataactagccagagcccatccctttatttcggcccatccctttgtttcccataaggaatactttcagttaatctataatctgtagaaacaatgcttatcactggcttactgtcaaaaaatctctgttcgaggctctcagctctgaaggctgtgagacccctgatttcccactccacacctctatatttctgtgtgtgtgtctttaattcctctagcgccactgggttagggtctccccaaccgagctggtcttggcagtgtagcaccttccccactctctcctgctccttctcccgccttgtgagatgcttgttcccccttcaccttctgccatgactggaagcttcctgaggcctccccagaagcagaagcctgtgttacacttgctgtacacagtctgcagaaccatgagccaattaaacctcatttttttttttttttttgagatgaagtctcactctgtggcccagggtggagtgcagtggcacgatctcacctcaccgcaacctctgcttcccaggttcaagtgattcttttgcttagcctcccaagtagctaggattacaggtgtgcaccactgcacacggctaatttttttttgtcttgaactcctgacgttaggtaacctgcctgccttggcaaatccaaagtactaggattacaggtgtgagccactgtgcccagcaaacctcttttgtttataaattacccagcctctgtcaggtgcagtggctcatgcctgtaatttgagcattttgggaagctgaggtgggcagatcacttgaggtcaagagttcaagaccaacctggccaacatggtgaaatcccgtctctactaaaaatacaaaaattaggccgggcacagtggctcacacctgtaatcccagcacttcgggaggccaaggcgggcagaccacctgagatcaggagttctagccagcttggccaacatggtgaaaccccatctctactaaaaatacaaaaatcacctgggcatggtggtgcatgcctgtaatcccagctactcgggaggctgagacagcagagatctcttgaacctgggaggcggaggttgcagtgagccaagattgcaccactccactccagcctgggtgaaagaaaaaagaaattaatgggtggcttagctgggtggttccagctcagggtctccctgaaaattgcagtcatgacatcagtcaggactatcttcacctgaaagcttgactggggctgaagaatccctttccaaaatgattaactcacctggccagaggacttggtttcctgccacccgtgtttcgccagagtatgactgcttgagtgtcctcactgtcacacgtgtccgtgcaaagagaccacctaacagactttgtgtgagcaacaaggctgtttatttcacctgggtgcaggtgggctgagtctgaaaagggagtcagcaaagggtggtgggattatcattagttcttataggtttgggataggtgtacaaattacattctcaagagtggggagaatattgcaaagtaccttcttaagtggggtggaggggagaatatatcatatcagttagagtggggcaggaacaaatcaccatggtggaatgtcatcagttaaggctattttcacttcttttgtggatcttcagttgcttccggccatctggatgtgtacgtgcaggtcacaggggatatgacggcttagcttgggctcagaggcctgacactcaccacatggcagctggctttccttaaaggaagtgatctgaaagggaacaaggtggaagctgtagtggcttttctgacctgtcctgtgaaatcacactctgtcatttccacaatatcctcttggtcacactgtttagccctattgagtgtgggcagagaccacacagcagcatgaatacctggaggtgtgactcctcaggtgccatcttggatgtgggcttaatagttttgattcagcatctttattattataaagagtttggctgggtgcggtggctcacgcctgtaatcccagcactttgggaggccaaggcgggcggatcatgagggcaagagatcgagaccatcctggccaacatggcaaaagcctatctctaataaaaatatcaaaattagcagggcgttgtcacacgcctatagtcccagctactcaggaggctgaggcaggagaatcacttgaacccggaggcggaggttgcagtgaactgagatcacaccactgcactccagcctggcgacagagcaagactccgtctcaaaaaacaaaacaaagcaaaacaaaacaaaacacacaaaaaagagttttagtcaggcacagtgacgcatgcctgtagtcccagcactgtgggaaactgaggcaggtggctcacttgagcccaggggtttgagaccagcctgggcaacatggcaaaaccctctccctacaaaacatacaaaattagcagtgcatagtggcacacacgtgtagtcccagctactccagaagctgaggtgggaggatcccttgagcccaggaggtcgaggtggcagtgagccacagttgtgtcattgcactccagcctggacgacagagggagatcctgtctcaaaataaataaataaaaataaaaataaacagttttgacttcacaactagctaaaaagtgtattccctcactcagtgactgtactgttcagaggtgtatacctgcattaaaagccctttccttccttctctgtaactggagtagggaagggctatctcattggactggagtaacacacacagataaagccggatgcaaagttaacaggaaacactatttctctcaaggatacgctttgtttgttttttttttgagatgaagtctcgctctgtcacccgaggtggagtgcaatggcacgatctctgctcactgcagcctctgcctcctgggttcaagtgattctctggcctcagcctcccaagtagctgggattacaggagcacaccagtacgcccagctaatttttgtatttttagtagagacagggtttcaccatgttggccaggctggtctcaaactcctgacctcaggtgatctgcctgtcttggcctcccaaagtggtgggatttcaggtgtgagccaccacgctggccaaggacatggtttcttacagagactttgttctctaaattcataaattgttggaaattctatcagtaaaaatgaaacatccgagtcttgctgacaggatctaatccacttgatacagagtagcagccttgatttccaaagcaggtgcacagcttcagataaagggtttctggatgcaacatttcacatgtaccttcttgtttccagcgattcaggacactggtttcacttcacagtcctgatccaatgttgaccttgctttgctctaagctatcatttggttgtcacctaagctctaccctccccctttatcttggctttttcttttcttttttctttttgagacaggctcttcctctgtcacccagtctgattgcagtgatgcaattgatcacagctcacggcagccgggacctcccaagctcaaacaatcttcccacctcagcctcccaagtagctgggactacaggcacgcaccaccacatccagctaattttcttttttttctgcttccttttctttttgtttttttttagatagaggcttgctctgttgcccaggctggggtgcagtggcacgatcttggctcactgcaacctctgcctcttgggttcaagcgattctcctgcctcagcctcccaagcagctgggactgcaggcacgcgccaccactcccagctaatttttttgtatttttagtggagacggggtttcgccatgttggctaggctggtcacaaactcctgacctcagatgatacacccacttcggcctcccacacagctggtattacaggtgtgagctaccacgcccggccccccctcctttcttttgttttttagttgacacagggtctcaccatggtacagcccaggctggtcctgaactcctggcttcaggtgatcctcctgccttggcctcccaaagtgctgggactataggaatgagccatcacacctggcccctttcttcaattttcaaaacaaactgatccttcaaggtcaagaggaaatacctcctctgagaagtcttctctgaatgtcagaggcagacaatgtctgatttctgcatgctccccaacattcaatcatacagttattgaataacacattttgagagataactatgaatcaagtaacatgctggtttctgggagaattgaggacaaattaaccttgtggaaattttgggtggatgaaaaaaaccaacatgaaattaaaacactgcacacatttacagctgtgagaagcattacacatcctgggtgctatgcgagctttttttttttttttttttttttttgagttggagtttccctcttgttactgaggctggagtgcaaggtcacgatctcagctcactgcaacctctgcctccagattcaaacgattcccctgcctcagctcccgagtagctgggactacaggtgcctgccaccacacctggctaatttagaatttttagtagggatagggtttcaccgtgttggccaggctggtctcaaactcctgacctcaggtgatctacccatctcggcctcccaaagtgctgggattacagaagtgagccactgagcccaaccaggagctttttcgagaaagaaggaagtccaagagatcttcctgacaccctagtctgactctgccctttgcctgctcaaaatttccccatgcttcccagcggccttctggacatagatcaagtcccttctctgacaggcccaaaccctttatcatctgatcctagctcatttttctgagttttccttagttgctattattttctgtctaaagtgacatgtcataatattcataaagcacacaagtcttatgtgtacagctcaatgaattgtaaatatgtgtatacccggccgggcacagtggctcacgcctgtaatcccagcactttgggaggccgaggcaggtggatcacttgaggtcaggagcttgagaccagcctgaccaacatagtgaaaccccatctttactaaaaatacaaaattagctgggcgtggtgtcgcatgcctgcaattccagctacttgggaggctgaggcaggagaattgcttgaacccggaggcagaggttgcagtaagccgagatcgtgccattgcactccatcctgggcaacaagagcaaaactccgtctcaaaataataataataataataataataataataataataatgtgtatacccatgtaaacaccattcagataaaaatatggcatatttggggcacccggggagtgtctcttgtggcccctcccctccataccctgctgatctatcagcacagattagtttctgccactttttaaacttcatattccttttctttttacacaaacacaaacattcgagtcatgactgggtggggtggctcaagcctgtaatctcagcactttgggaggccaaggtgcgaggatcgcttgagtctgggagttcagagaccagcctgggcaacatagagagacctcatctccacataaaaagttttaaaaattaaccaggggcggtgtagtcccagctactcaggaggctgaggtgggaggcttcagcccgggaattccagactgcagtgagccatgattgggccactgcactccagcctgggcaacacagtgagaccctgtctcaaaaaaaaaaaaaaaaaaaacaggaaaaaacaaacaaacagaaaagcaggcctggcgcggtagctcatgcctgtaatcccagcgctttggaaggctgagacggggttatctcttgggctcacaagttagagacaagcctgggcgtgggctatattgctagatccaggtctctgcaaaaaacaaaaccactcagtttttagtcatctataacgtcctgcctggaagcatgctattttgggcctctgagcttttgcacttgctaattccttctgcgctggggagagctcaaaccctgcccgaaacttctaaaaatggtgcctggataaatgaaggcattagagctgcgattggacggacggctgttggacggcgccactgctggcacttatcgggagatgctcattggacagtcacgtgacgggaccaaacctcccgagggagcgaggcaggtgcggtcacgtgacccggcggcgctgcggggcagcggccattttgcggggcggccacgtgaaggacgcacgttcagcggggctctcacgtgacccgggcgcgctgcggccgcccgcgcggacccggcgagaggcggcggcgggagcggcggtgatggacgggtccggggagcagcccagaggcgggggtgaggcgggaggcagacgggcgggaggagggcgagccccctcgccggcccgtccgggatccttcctaccggcctggggctgtgcgatctccaagcactgaggggcagaaactcccggatcgggcgctgccagcctccagtcccctccgtcctcggaggttcctggctctctgatccccgtgtcccgatccctgcctctctggcgctctcggaccctcgagaaccaggggatctcggaagccaagcccccgggcaggcccgggcttgtcgcccgcaccacttcctgcctctggcactggtgggaggggcgggtctcgcctctgccccctcaggccaggggtctggatgcatatagcgttcccctagcctctttccccggggagaatgtaggatacaggcccagcctcctggcctttctccatcagggactcagttgtctgggcccccccgtcactttatctgctagggtcccagaagtccagggtccccagctctgtcctccctcaggggccgtgagtctccacagtctcctgatcccctagaacccaagagtccaggtacctcttcccttcctttctcctctagggcccaccagctctgagcagatcatgaagacaggggcccttttgcttcaggggtgagtttgaggtctgattattgtggcacagatttgaggagtgacaccccgttctgattctgcaccctcactccatccccactctagtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggtgtgggcccctgaggacccagaagtccagccactgggctccttcaggacacaggactctcagccccgcattctcctcctcccctaagaactaggagtctgggccccacaactcagcgcaaacattccggactcccagccctcctctctgccaggatcttaaaaccctccttcagggagtcatttttcccaccttcctaaatgtctgtcttgtccccttcccttgtcccccgttggcctgttgcttttcatttcagcctggcttggggctcagtctccttatctttagtgtgcggtggatgcgggaattttccaccatcagcctgatgcctgctccccggcactggttctcctctctcctgcaggatgattgccgccgtggacacagactccccccgagaggtctttttccgagtggcagctgacatgttttctgacggcaacttcaactggggccgggttgtcgcccttttctactttgccagcaaactggtgctcaaggtgggcagctgcagggcagtgagcccagggatgctccccctcagatctgtgaggacctggggatcgtggtatcaaccccctgcagtggcccagtgaccacagagggcatggagagagatggctgtgcactgggtgtctgctccttcttttattcattcaacaagcatttactggacctgctatgtgccaggcctatacctggcacctgggacacagcactgtacaaagcaggctacatccctgctctcagggagttcacgtgcaggggtgaagtaaagtgggcagtgtgatttagcagagtggtcaggaaagatttctattttttttttttttttttttgagatggagttttgctcttgttgcccaggcttgagtgcaatggcatgatcttggttcactgcaacctctgcctcccaggttcaagcgattctcctgcctcagcttcctgagtagctgggattatgggtgtgcaccattatccctggctttttttttttttttttttttttttgtatttttagtagagacgggtttcaccatgttggtcaggctggtcttgaactcctgacctcaagtgatccacctgccttggcctcccaaagtgctgggattacaggcatgagccaccgcaacaagccaggaaagacttctaagggcaggtgacatcaaagagcaggtgacattaaagccaaagctagaatgataagaagcatgcagtgatctatagtgatcggggggaagaggcatctggtagagggaacagcaagtgcaaaggccctgaggtaggaccaagcctcatcttttgacagtagggaggaggccagtgctgttggaacagagtgaactggggagagggtgggaaaggaaggcacagttgggcaggggcagattgtgtggagtttttcgggctgctggaaagactttttcttttctttttttttttttttttttttttttttgagacagagtctcactttgttgcccaggctggagtgcaatggcgccatctcggctcactgcaacctctgcctcccgggttcaagtgactctcatgctttagcctcccaagtagctagaattacaggcacacaccaccatgcctggctagtttttgtatttttagtagagacggagtttcgccatgttggccaggctggtctcaaactcctggcctcaagtgatccgcccaccttggcctcccaaagtgctgggattacaggcgtgaaccactgcacccagcctggaaagactttaactttactctgagtgtgatgggagtgattggctggttttaaatacggaagcgacaagacctgatttataactttaagagattattctagcaagtatagatgccccttgacttgcaatggtgttacatcctagtaatcccatcataaattgaaaataacataagttgaaaatgcattcaatgccccgataaacccatagtaaggtcaaaattgtaagtcaaaccgtcataagttggggactgtctgtatagcaaaatgttaattgtagaatctaattataggtggcggctatatggcttttaactgtgaaattcttttaacttttcattatgaagattctcataagaaaatgtggtgggggtggtggtgaaatgctcctggctgttgttggccaaaagagatcatgaggcacaagggcagaagcgaggatcctggagaggtggcacctgtcatagtcttgctgaaagatgacaagccctggtggtagcagcagaggtgcggggggggcatttttttttttaagaggtagggtcttgctctgttggccaggctggagtgcagtagtgatcatagctcactgcagcctcaaaccgctggggtcaagcagttctctcgcctcagtctccagagtagctgagactacaggagcatgccaccacgccccactaactgttgcattagtctttttctatagagacggggtctcgctatgttgtccaggctggtctccaacagggagggatatttctttttggaagatttttttttttttttttttttttttttgatacagggtctcgctctgttaccaaggctggaatgcagtggcatgaccttggctcactgcagtctccacctcctgggttcaagcaattctacctcagcctcctgagaagctgggattacaggctctccccaccacaccagcaaatgggagggatatttctttctttctttcttttttttttttcctgagacggagtctctctcggttgcacccaggctggagtgcagtggcgcgatctcagctcactgcaacctccacctcctgggtttaagcgattctcttgcctcagtctcccgagtagcttgggattacaggcgtccgccaccacacccagctaatttttgcatttttagtagagatggggtttcaccatgttggccaggctggtctcgaactccttacctcaggtgatccgcctgcctcggtctcccaaagtgctgggattacaggcgtgagccaccgtgctcagctgagagggatatttcttgatgtgttttcaagattgagctgatggggcctgaacgtccgagatgaggggaatagcagtgcaggtgatggtggcaccacctacagagcggggatgatagaatagaagtggccagataaaggctgcaggagaagtcttgggagttgggagagcaggtcggggtccatggtcaggggttgatcttctctggtccagaaaagtcctctctggctgggcgtggtggctcacgcctgtaatcccagcactttgggaggccgaggcagggggatcatgaggtcaggagatcgagaccatcctggctaacatggtgaaaccccgtctctactaaaaatacaaaaaattagccgggcatggtggtgggcacttgtagtcccagctactcgggaggctgaggcagaagaatggcgtgaactgggaggcggagtttgcagtgagctgagattgcaccactgcactccagcctggagcgacagagtgagactccgtctcaaaaaaaaaaaaaaaaaaaaaagaaaagtcctctctggggaagtgacatttgccctgagagctgaagggtaagaatttgcttcgtcgaggcctgtttaggcggaaacaggagtacatgaagaagtcccgaggcaggaagaatttgatgggaatttaaaaaattaaaaaaaaaaaaaaaaatggggctgggcatggtggctcacacctgtaatcccggcactttgggaggctgaggcatgcggatcacctaaggccaggagtttgagaccagcctgaccaacatggtgaaaccttgtctgcactaaaaattcaaaaaaaaaaaaaaaaatagcccggtgtggtggcggatgcctgtaataccagctgcttaggaggctcaggcaggaggatcacttaaatctgggaggcggaggttgcaatgagccgagactgcactattgtactccagcctgggcaacaagatcaaaactctatctcaaaaaaaaaaaaaaaaattagccaggcatgttggcaggcacctgtaatcccaaccctttgggaggctggggcaggagaattgcttgaacccagaaggcaaagctttcagtgagccgagattgcgccactgcactccatcctgggtgtcagagcaagactccatcttaaaaaaaaaaaatggaagcagctcagcgaggcacaaaacaggaagtggaaaggtggagtgaggtcaggccaaagcctgcacacagggcttgtgggctgcactgtgccttcgggtcttcatcctgagggtactggggagccacagaaggctcaggggtggggcagttgagagtaacattatcttgtttacaattttattttttttatttatttattttttgagacggattcttgctctattgtccaggctggcgtgaaatggcgtgatctgggctcactgcaacctctgcctcctgggttcaagcgattcacctgcctcagcatcccaaggagctgggattacaggtgcctgccaccacacccagctaatttttgtatttatttattttgagatggagttttgctcttgttgcccaggctggagtgcaatggcgcaacctcggctcactgcaacctccgcctcccgggttcaagcaattctcctgcctcagactcccaagtagctgggattacaggcatgtgccaccacgcccggctaattttgtatttttagtagagatggcattactccgtattggtcaggctggtcttgaactcccgacctcaagtgatccgcctgccttggcctcccaaagtgctgggattacaggcatgagccgccgcacctggccatgtttacaatttttgaagccgacttcaattgtgggtggcagaaatctttgaggggaggcaaagaattgacaaaggaggtttggggccactatctccaggcagtggggacaaggttcagtccctaacgcccactccactccccacaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttttccccactgagaaggggtctcgctatgttgcccaggttggtctcgaactcctggcctcaagcgatcctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacacacttcggcatctgagtcactgggcctctgccccgctccccggcacgtcaggagagcaggccctgtccgctgccccacgccgggcccgccgtctgctggcctagagatacctgcttgggccactcagggacgtggggctctctgcactcacttgacatctttttctggggtgccctgtggggtctgtgggttagggatgagttggtcctgggcctgacctgcaggagctcacgggaaaggaaaagaagggagctcacgggaaaggaaaagggagctcacgggaaacgagggtgataggtggtacatctgtcgcagcccaggatgatctgtgcgggacagaggcagcggcctgtgaggcccaagcaggcgtgtgggtaagggaagaacagcacggccggctgcagagcaagcctcctcggcccggggaccacagcctggcgtgtcacacgtgggacctcaggaggccatacctttaccgagctggagaatgggagtggggggaggagggatgggaggaccagaggagcaggaagggctctggagcctggtggtgaggtcgctggagggtggcaggctgaggacaccagggcgagggcccacgggagaggcctcctgagctgggctgaggacagagaggaagggacctggctggcgactgagaggctggagggcagggcagaggaggaggaacctggtctggccccacagctgggtggggcccccctggagaggaactgccggaagaaggtgctgagctcagaggcccagtgaccttagacacaggcggagcgaagacaagggggctagaggatgtgggttctcagtcacagggtctctggcacccccctctgggtctttaccccctcccatctctgggtctctgtccccatgctctgggtctttgctttccgagcctctgttcccaccccacctttggccctctttctctgggcctctttccacccctggcacccagacctctggccccctctctctgggtctctgtccccccctctggatctctggccccccatctctctctgggtctgtcccccgaccctgagtttctgtctccctctctctgggtctctgtcctctctctggctgtcactctctcttgggtctctgtacctcccctctctctgggtctctttccctctccccggtctctgtcccccgcccccgggtccctgtccccgcccccccaggtctcagtcctccctagtctctgtccccttctctctgagtccctgtcccccctctctctgggtctctgtacccccttctctggatctctgtccccacctctctctggatctctgtcccccactctggatttctgtcccctcccgccgggtccctctgggtctctatcccccccacccctgggtctctgtacctccctgcctctgtccccccccacctctgtccccccctctctctgggtctcttttcccctccctctgggtctctgccctcctctctctaggtctgtccccctcccctctctctcagggtctctgtacccctctgtctccgggtctgttttcccctctctctgggtctctgtccccctctctctcagggtctctgtctgagtctctttttctctgggcctctgtctccccaccccacgttctctatggtcttcagatcctgtctctctcagcccctcctctccctccacctatgggccccaaggcccctctcggccgactaaaggtctctgggctgaggtatgacatttggtaaatgagtaactcgggccccacagtcaacggggtgctttggacggctgcccctcctccatggactcttcccagagaccccaagtcaggggagagagaggggcagaggatcaatgagtgtacactgagccaccacccagagtgaggggacaatatggccacaggcaggatcccagaaaaaaaaaaattatgggaaccaaaaagacacggagacaaagcacacagccggcttccaacaaggggggaccttggggtagggggcccgatttgggtctgagccaggtctagttctgagggtcccaccaaaaaagtcggggagtgccaaggggatgaggtcagcgagtggccccacccccatccgtccccgcgggggccccttcccgcgctgagctcagcatgactcagcagtcgctgcctgcaacaaggaccccagataccggcctggcggggcatctgcagatcccctcggtcaggggctgccccgcctgggctgttcggagcagctcctctgtagggcagggcctgacctcaccccacaccccagtggcttcagctccctgcccagcgcacgggctgcctccatcagggcacttaagtagagtcaaggtttgcgccgactccgtctcccagaaatcaacgtggaccaggcccacttaaaaaatatgcattagtcgaagacagacgtctcgtccataggtccccagactgtttgtccacaacgcagggcttctctttgtgggcctgaaggagcacacgtcaggcaagacacgagggcaacttcagagacactgttcagggccacggagaattctcgaagtctgtgagttgtctccaaaacagcctccaggaaatgcaatcccagagacaccgcaaagctcaaaacagacttttcattcctccccatttccactcccagaaaaagcctgggcccctgaaagagctccaaggtatccccaaagtcccagcccatctttggagggttccagagggctgtccagggttccagaagtcaccctacctcatacaatgctcctcctgggcttcccgcactgggtgaaacccacggctccagaataactgccctttccaacttgcagagcacctcaagaacctaaagatttccccggggagggctccaaaatatagagagtttgcatcgtgaacccccacccctgtaaatcccaggactccagtccccgcaacactccatcttccagagatctccaggggtccagaaataacacctcacagccttccaagcttcccaaggatccggagactccttatctcgcagcgcaaacctcaggcaactacaggtcctccctgcacctttgaggtgcccctccccccactcaaggttccagaaaaatccatgccctcggaaaccccagaatcttactttcccgaggcaccccaggaccccagggtcatcagttcacagggctgttagtgctcccataaaactctagcctcccagagggaccccagcccccaccctcccgcccacgaacccctgcatttccagaatcagccccagggccccaacccccccaagcccccatttcacaacacgctggcgctacaggcgcgtgacttccccttgctttggggcggggggctgagactcctatgtgctccggattggtcaggcacggccttcggccccgcctcctgccaccgcagattggccgctagccctccccgagcgccctgcctccgagggccggcgcaccataaaagaagccgccctagccacgtcccctcgcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctggaaatagaggcgcacctcgtgcagtgcccacaacacgcggcagtccacaccgctgcgtggtcttagggacgtatagctgtaagagctaggacagggtgcggagagtgataaatacaagctgtcacatgtctttgtggcctgggcctctgacccccaacgactcttgggaaatgtaggtttagttctatgtgccgagtgtgtgtattctgagccatttctcccttctatatagaagccagctgaagatgagtggggtaaaaccccagacgccatgaaagctgccatggccctggagaaaaagctgaaccaggcccttttggatcttcatgccctgggttctgcccgcacggacccccatgtacgtacccgctgcatccatggctacccaaccatacccctcaagcctctgctccctttgggcaaatttccttcagagcctcatttcacacctgtcacattttaatctgcaactggctgctctctccccctcttttccagggattgggtttctaatttctccctcttctctctcagctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcagctggtggttttgtgtgtggtgtggaagatgaggtgggatctgttctcataaagcttctggctgggttgggatgccagtgaaagaggagttggccccatctcccattttcttaactgtcctaagacaagaggctatctgggtagtgttgaacctgagggttctctgcttgcctggctgttaactgtccctcccagatggtagagatagactccagggagttgaattaagacctaggttggtatctagaaacagatgttaggtctcagccagaaacagccctatttaacgagtgattatggggccaggtgggtcgctcacctgatgtcaggagttcgagaccagcctgaccaacatgaagaaaccccgtctctactaaaatacaaaattagctgggtgtggtggctcatacctgtaatcccagctagtcaggaggttgaggtaggagaatcgcttgaatctgggaggcggaggttgcagtgagctgagatggcgtcattgcactccagcctgggcaaaaagagtggaactcccatctcaaacaaaaaacatgtctgcctcacggaagttgcggtgagctgagatggcgccactgtgctccagcttgggcaacagagtaagactctgtctcaaaaaagaaaaaagcctcaattctgggaggcagttggaattattaggccctttatatgggcacattgacgctattgctatgcaacttgcatggcaaccggggggctcactgaggtctttgctccagagtttaagagattatggcccgagcttgagtgatcccaatgtgaggcgcacactgagaggaactggccagtggagctgagcagccaggaacacgtgatgcccaagcaatgctggacaaggggtttagggttcatcacagaaatgggatgtgaaaccttgggccggattctccaaatgggaactgaagaagcttaaaacaggccttaaaaagcacttgctgtgtccaagctgcaaaactgctgtgtcagctctgactcttccccttctccttcccctgggtctggggcagggtggttcaagcctgtaatcccagcactttgggaggccaaggcaggacgatcacttgagcccaggaggttgagaccagcctaagcaacatagggagaccccccaagtctctctagaataagaggatgagctcagaccagggaaggggtggtactggggggacgtcacagccaggcccaccaagtgtcatgtctgaccacacctgggattcttaaatatagatgtatttttttcatctcatctccggacacactccaatcacacccctcctgccctcccctctcaactgcaaaccaagcggtgcagacacagcacagcacacatgaggggccctccctttcaccaaagctgaaggcagggcacagtttggggatggaagagcctcgaggtaaatgtgggggttctagaacccagtgacctcagttctggatcatgggaaagggatcagtatgcagtaacgtggtaaggttccagatctagaagccaggacctagaacctagtggtttcacagtgggcagagcagttgggaataagccaggttaggggtgggggaagacagccagctctgtcctctgcaggcggattccctggagggagatctcagatttagaaaggaagagtaggatctggtccagaaagggccagaaagacaggaaggcatctggactgagactgtgtgtcctccagaaggaatgagcagccaagtggttctaccacctcttgcttggccaaagtgtaggggatgacaggagccggatggagggatcctccaggcagagcctggctctgacatgccagggagggctagaacatccctcccagagccccacttctggagttgaaatggaggaccatctgctctcagttaccttcaaactctgaaagtgccccggctctggacttgatcgccccattcgcagggacaccacgtggtttccagaacttggtggcccgcatgccgggcctgagcgtggcctgctctgtatgctgtagaatttgtaagccacacggggggctctaaaagccccagacctgaaagcaccatgccaggtttcctaaaacctctggcaccaccgcagagtaatggcagattcctggcctctgggaagcggtccaggcccaggggactccagggcgctgattatgcatattctggagccagagaaaggcacggctttgtggattctggagtgcaggaacttggaaactggagctggagggggtggagtgtttggcggactgggtgggggcactgcggggccacacccagtgcagatctggagcgggggtttaggagcagcacccctctgcatcctctctctggagcagagaggcaggacaggcggggagtgtggtggggcggacttagttacgctcctcgcccagggagctggtggggctgaggggctcgctcggggtgctgagtgagctggaggtggccgtgtccacagagttgcgcttgctgccgctggtggaggaggtgcaggacgctcggcgcggccactctggtgcacggatgttgcgccggtccttggcggcctcctcgtcctcatcgtagcgctcgccgtcttcctccagcggcccgttccggggatcctcctcgtcctcactctggtgcgggctggagtgtcgtgacagcgagggcgacggtggcaccgaggctggccgtgggtagcggtacccctgggcctgcatacggcgatgtgggtgcaaaccagggtgagctgaggacctcacagtcccacccaggcatccagccacctctaggccttcccactccaggagggacccccaccccaccgaagcccagccctttagctcctggctaagcagaaatccagggtccactcaccgcatccgcctcgttgggctcgtaggtgaagtgctctggaaaggccttggacagcgccatgtggcgcgcagacatatagtactaggggaaaggaggagagggggcagaggatgtgagagccaggccccacccccaggcagatgatgggggtcttggccacaccctttatgcagatgagcacactgctgcaccccatacaaataatccatctatctgactccaccccttatgtagataagcagacctgtgaatggacagtttctgagccatacccctcaaacaggggccgaattctcaagtgagtctcctctttggccacacccttatgcaaatgagaacgcctgaccaatgttctttttttctttttaaacacggtcttgttctgttactctaggatggagtgcagtgggtttgaacaaggctcactgcagcctcaacctccggggctcaagcgaccctaccacctcagcctccccagtagctgggactacaggcacgcaccatcacgctcggctgatttttttttatttttagtaaaaataaaatgttgcccaggctggtctcttaactcctgagctcatgcgatccttcctgttaggcctcccaaagtgctgggattacaaccatgagccaccatcgcgatcggcctggttcattgcttaaagggacagcaactgttacaagtaggatgagaccctgcaccctgcaccaaagacccctagccaggagctgctgatttgccaggagaggataggaaagtgggggtcctacccggcctaggtatttccagtccagaaggtcggagaggcgctccgtgcggttccgctggatgatacgctgccgccggctctgctgacagaaactgtagaggaaggaggtgagctgcgagcaggaatcatccaggctgcggaaccgccggtcaagaatgtagatacctgtggaggccaggacccaggttcagaaaacatcctggggagatcttcatggtctccaggactctgtggcaccaggacccctcctctcccagcggcccgagagcccccccatttcctggtgcccctggtctccaagggtgcaagctcctccttcccaggatccaggagtcactgttctcaagcccccttccagaatcctcaggggcctgggcgctgaccgtaagctgaggggtctgcgatgtgttcctccatgaagcagccgaagccggagagattggtggagatactggggattcccataaccgtgcactcagctgcgggaaggcaggagagagacccacttagcttccctcatcgcctaccgtcttaatcgcaatagacgcctcaacaccgccctctactggcgcctgtaccaagtgccaggcgctgtgcggagcgtcgctgagcccccacaaccaggctgtgcatttccctatttctcagaggggacgctaagaggctcagaaaagagaattacttgctcttgctccaagatgcgggaaagtccatagttgggagataaggatgctaatttattgagcatcccaatatccatttgacttaactctcacaacctgtaggatcgggccaaggtccatcattctacttaattgtcacaacctgtaagatcctttcttgtgccagtatcttgtacggacttagtctattttgatggggggtaagataaggtctctcattattagtatccctgtgtacagagcatctagtacgtcttgtttaatacctttaacaaccttgagaaatagttcaaggaatgtattataattttttgatggatttttatgcttttttttttttctttcgagacagggtctcactctgtcacccaagctgtagtgcagtggcacaatctcggctcactgcaaccttcacctcccgggttcaagcgattttcgtgccttagccacccgagtagctgggactacaggcacacaccaccatgcccagttaattattgtattttttagtatagacagggtttcaccatgttggccaggcaggtcttgaactcctgacctcaggtgatcc

SEQ ID NO: 1222 - DNA, 101883 bp, Homo sapiens
tccccctccccctccctccctctaacccctccccctccctccccttcccctcctccccctccatccccttcccctcctccccctccctccccttcccctcctcccccctccccctccccctgcctcccctccccctctccctgtctttctttttattttttttctagagatagggtctcactctgttgcccaggctggagtgcagtggtgtgatcatggctcactgcagcctcccaggctcaagggattctccagcctcagcctcttgagtagctgagactacaggcgcataccaccatccctgacttttttgtttatttttgttttagagatggtggggtcttgctattttgcccaggctggtctcgaactcctgggctcaagtgattctcccaccttggcctcccaaagtgctaggattacaggcttgagccacggtgcctcacctgggtcccccagggtcacaggtaccatactcctgccttacctctttgggaacttcaggacgtctcatggcccacatgtggctgagtactatcctgtgctggacacagggctggctgcgtctccttggtgccccatctcccgatcctcttgaggagcgaggggctgagtgtatgcacgagatggcatgtcccctgcctggtcccctccctgctccagcacagctctaagggtagcagagtactaattacagggatgtgtgggaaatgatggccccattttctcaccattgccaccaccactgctgactccttcccaagtccctaccacaggccaggctctagtgcaggcaggtgtggctgagctgggccggctgggctggtgtcctgcctctggtggtgttaacaggcagcctcttgcaatggaggagcctggatgccaatcttgacccttacgagctgcgtaatcctgggcaaatatttgagtttgctaagcctcaatttctcatctgtatatgggtacgggattccttgtagcactgtgatgagggtgaacaaatgatcactgtaaaatccctggcccagagcccaggaggctcacaacaggtcctcggtcagtttctgtgcctccctgaagttctaggttactcactcattcattcactcaccatccctgggctcagccagggtgcctagccctgtactaagtgctcgtatgaaacagtgctaaatgctcacgtgcaacagtactaagtgctcacgtcaaacagtactaagtgctcatgtgaaacagtgctaagtgctcacgtgaaacagtactaagtgctcacatgaaacgatgctaagtgctcacgtgaaatgatgctaagtgctcacgtgaaacagtactaagtgctcacatgaaacgatgctaagtgctcacatgaaacagtactaagtgctcatgtgaaacattctgagtcctccaggtgtttccaggccaagagaataggaacagttgggtgaaagggggatggccttctctaaagagtcccagatcagggccccttgccccttgtgtggcctgccggtggcacttggatttcacccacagagctacccaggaaccatggcagtttctaagcgggtcccaggagtctcaagggggcagcctagagagaggtgagagggtgatggcgacactccccagaggagcacggtggccttgtgaaatgggtatgggttccggaacagacaatcacaaatggaacacttagtagctctatgcccttgggtatgtcattcctctctgagactcagtttccccacctgggaaataaggataacgtagcattcttggattgctgagaagatacaataagggcaagtatgaagtgtgatcgatcagattcaggtgcccaacacgtgttgttgattttctttttttttttttcttttttttttttttcaggccaggcaccgtggctcatgcctgtaatcccaacactttgggaggccgaggtggatggatcacctgaggtcaggagttcgagaccagcctggccaacatggtgaaacccctgtctctactaaaagtacaaaaattacccgggagtgatggtgggcgcctgtaatcccagctacttggaaggttgaggcaggagaattgcttgaacccgggaggcggaggttgcagtgagccaagatcgcaccattgcactcctgggcgatgagatgagcctgggcgacaagagcgaaactccatctcaaaaaaaaaaaagctatttttttttctttattagagacgaggtctcactatgttgcccaggctgatggggcaagatgggggtgggggtgagccactgcgcctggcagaactgttgattttaacagtaggattatctgcctgcattacagaaaagcaagctgaggctcagagaggagccccaagtcacatacactgaggggagaggcagacgctgtatttgagctgccactgggtacaaggcagacttccacacgtgggaagccttagaaatggtctcccctggccgggcacggtggagcacgcctgtaatcccggcactttgggaggcagaagcgggagcatcccttgagcccaggagttcaagaccagcctgggtaacatagtgagaccctgtctctacaaaaacattttaaaattagccgggagtggtggtgcccacctgtaatcccagctactctggtggctgaggcgggaaggtcgcttgagcccgggagatggaggctgcagtgaactatggtcgttccactggactccagcctgggcgacacagagagaccctgtctctaaaaagaaataacaattaaaaataaaaataaaaagtcttccagctgggcgcggtggctcaagcctctaatcccagcactttgggaggccgaggcaggtgaatcacctgaggtcaggagttcgagaccagcctggccaaaatggtgaaaccccgtctttactaaaaatacaaaaaattagaggggcgtggtggcaggagcctgtaatcccagctactcgggaggctgaggcaggataatcgctggaacccgggaggcggaggttgcagtgagccgatatcgcgccactgcactccagcctgggcgacaagagcaaaactccgtctcaaaaaaaaaaaaaaaaaaaaaaaagtctccctcctagagtaaaatgaggcgacccagtctgagagtgtgggtacggggacttcccgcagcctctcccaggcagcaagggaagggaagaaaccgagtgtaagcggagggcaagcgggcggacacccaccaggcccggccccaccccgtgctccgcgtggccgggagacgcggcgcctttaaagcccagtgggaggcgtgtccctgggcgtgtcctcccggagccccgccccgggggctggtagcctcggccccgggaggttgcgccggctctggctcagcggcggctccggtggcagcggcggtggcggctaggcgggctcggcggctcctgtccctcgggcggctgcccgctcgctgcccagggcgcccggacacacgtgggcggctcagcgatggcccgcgccccgcgacgtggcgggcaggcaccggggcgcgggaccgctgagcccgagtgagccggggccgcgctcccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggcactgctgagtcctctctggctgggaaggggggaaggtaggagggtgagggccctgcaggagtctttcttgtaagcagagctggcagtgggtgctggcaccccccaatcaggaggaagtccccccggaacagctgtgcattgcaggagtcccagacaccatgtgtgcgtgttttcccctcccgcccgtctctgtgcttccaaatggagacagggacgcctgcggatgttcagggaattccccagggtgacactgccacctctggccccagggagtccagtttgaggctatggatgagttttccttctctgggaacttgctctccttattggcgtggaaagtaaaggtgtcagcctgtgtcaatgttgtcacgaggaccgcctccctggggccttggaaaattgctggtgcgtctgcctggctcctcggggcccccaccagggcagcccccaccagggcagccccagcctgctccctggcgtctccaggtggggtgaagaggttgttctggtctgtgggcctctgggtagcacagacatgcacgtggagctgggaagcccttgagtagagtgggaattgggcccctagctcctaagcttgtcagatttgagttgctaatggcagcggtgggaatgaggcagctcaggtggctgtgcagagctccacactggggcaggtatggggaaaggtcccatgtccatctgtgtgctggggtagcttagggctgctagggcctgtcctgtttctgcggactgggtagctgggcacgtgtggccatctggagacccctattggcttggggtcagaccccagggccccatcttggctgctgtgactccagccaggtgagagtattagttactagtgtccctgggtgcctactatacacggccggcatttggtgtcagtgccaggagatcccagcggtccagccctgctgccagcctcactttagagccacggggaggctccaggaggggagacgctcaggtgctgaggatgaatggtgaggcggagccccaaacctagggcctctcgggctggagccctgtgccctaccccaaccaccaatcctacagggacaagaaaagtccagtgagaatcaaacaggttgggtcacgctcccaggagacaagaccatggcaggctgagggggttaaggggtattcctcaccacaaggcgcagtggtgccccagggaagcttacagcccttgcacctgttcttaggccgtttattgcacggggaacgccctctccatctaaatccttccctttgcgcagagcacacattaagtaagtccccatgtgcctctgaccaacaaagccaagtgaccctacctccttgtaatgctgcacgagggttttttgtttgttttttgtttgtttttgtttttaatttaaggcagagtctcactctgttgcccagactggagtgcagtggcacgatctcagctcactgcaatctctgcctcccaggttcaagcaattctcctgcctcagccgcctgggtggcatccgccaccatgcctggctcatttttgtatttttttgtagagacggggtttcaccatgttacccaggctggtcttgaactcctggcctcaagtgatccacccaccttggcttcccaaagtgctgggattataggcttgagccactgcacctggccatgcgagggtctttgagtgggaaacagaatgagctcgttagaggcagtaaagtgcccacactgggcgtgggaggggcagaggcttcagggagctgggctcacaggcagtggaagggaagatgggaagggcctataccagggcgggggcagctggagcgaatggagaggattccacagacttgggaagagcaaggcaggcggggtgtgggaaaggcagggggaggatgagcatccaagggcacccacctgccccttctttcttccttgctgtcagtgaccatgtcctgctcagcagacaccagcctgctgctggttttcagggcagcccagatgggagcgcagagaggggcagtgcagggtcaggacaggccccgggggctgtgctttgaggccaggacctgggagggagggcagggccctgccagctttctcagacctggaagatgctatggaaataagtcctaggccctggaggaaagggaaaaaggaaacacagccctctcatgtgatctgctcgcctcacgtttcggacgggaagtgtttagattggttggccgctacagcacatagccacgcagtttgaggccaagctgggagttgaacccaagtctgcctccagaacttttgtgcgttccacaccagggatccgattaggtcctggtggggaaaggcagggtgtatgccttggcaagtttatgtccccagaagctgggcaaagcgggtggggaggagacaaacacccctaccactgccagacctctccccacgcccattaaagaaccctccagggccaaacaaaaatacctcggaaacccacacgtgctggcatgtgcatcgcgtgcccaggcccgggccttccccttagtggtcctggtgcccagcatttgggtcttcagagtgcggcaccacacgcccgcaagcctcttgggaggctgagcctgtccctgtgggtttgcgcttgtgtgtggtgagcccaagatcctcctgctcccaggaagttgcccgctcaaggaagcagctcctgaacacagcagtcccaggtgttgaaaagccaggaggcccagggctggggttaggagagcgcagttaatgggaggtgagttcctcagtgtcctccagagacaccctagcccctggccagcaggaagagatgccccctctgagtggctctgttggaatccagatgccacctgttaaccaagtctactgaccatgtcacctccccagagacaaaacttgagaagagtgtgcaggacaaggacaggcctcagctgactcccaggtcatgactcaggcccctgtcctcagagatggagttcccatgcccccatttgcagtcatcaaagtggctgccccacaaggtcacagcctggtaaggcagtggctaagagtgtgctgagaccaggacacgaccagaagtgaccaccccaaggcagtatcctagtgtgtgcctggggaaattactggaggagcaggacttcatagaggaaggctgggagccccaagtgtcactgtcgccatgcagaaaatgtccagaaggagcatggttctcttctccagagctggaggctggagcggatgagcaggaaaattcaatctgctgttggggcaagcccgcttcctccaggcaggacaaaaattccccaagtgttctgtgtaggacctggctcgcccgtgcttaccaaggccgcaaagctgctcagcagcagaacctgcgcccaaggctcaggcctcaaaggctcttcccattacaccagcttcacctcgttcagctggtcaggaattggcagtttaatttctcagtaattgggcccacagcagtggctcagcaaaatctctgtattccattggcgggtggctgcctagcagcaccctacgcatatcagccagtcagactttaaaagataaatgaaggcataaataaaacaagattagacatgtggtagaaccgtcaaagccgagtgcatgggaattcattatacttttccactgtttgtgtgtttgaaattttccttgaggctgggcgcggtggctcacacctgtaatcccagcactttgggaggccaaggcgggtggatcatctgaggtcaggagttcgagaccagcccggacaacatggtgaaaacctggctctactacaaatacaaaaacttagccaggcgtggtggcatgtccctgtaaccccaattactcgggaggctgaggcaggagaattgcttgaacccaggagatggaggttgcagcgagctgagaccacgccactgcattccagcctgggtgatggagtgagactgtccccaccgcccccctccccaaaattttttttccctgagaaaggttttaaaatggcagaatttccccatagtgaaggcttaaaaacctattttcaccgtaattcctagtttcaaatgaagtttttcagggttttagacggagacagggccaggagaggcttggagggagtacttctttctgtggttaagaacactgagaggccctgactctggaggccaagccttcagaggacccggctccaagggtcagtgggaaagcagcactcgggacagcactacccacccccacccaccaagaaagagcacaaacagccaccagagtggtttcttctttataaacacaagtacatgaggtttatttgaaattccaatttattacaagttcaccctttaatggggcccttcctctttgaagacaataaaaaaaaaaaacaacaacaaacaattcaggtgtcactgaagtgggaacacaggattctcactatgaacaagaacagactggatgtaggaggcaggggaagctggcggtggtggggttatgaagctgtgatgtcagtgccaactccatgcctatagaagggacggtaaactacccagcagccctggagcaatcctcgtcgtccttgggcaggaggacggaggaagcagaggccacattccgcagtttaaaattaagaggcttgattctcatgttctaggagctgcagtccccttggtggactttaaataggtacagaagagcttgggtgctcaaaatttccaaattcaaaggtgataaaaaagaaaaaccctgttttgtacttttatcaaaatccatcataaaagggaaagaagactacaaagttttgcctaaatataacaactagagctagatttgttgtgggggaaggggctctcagagcttctctgccgctctctcctcccaccccccaccgacactgaccactggaatcttcaggttcttgaggagttccaaggctgaggtcagaacgggcatgggaggcagcagacacagcactgccctgctccccctccaatgttgctgcttgcctcaatgagcctccaacccaactgctctagaggagagtggatgggctgaaggagaagccagggaagttagagcaaacacattatcatagaaactgtactgtacatgtgctaaagcaagatgtcaggagtatcttacaagatgttctttatacaatatcactgctgaaacaagcaacttttaataactagaaaagtcaatttaaaaaaaaaattaaacatttaaattcttcctgcttttcttctgctcccctaagagcttgactggtatgtgggtgggctgggctccaacacccctctggccagatccatcaaagtaaaggttatatgcatgattataagcaggactccagtctctaagtgaagtgccttagttttgtttttttgttttttgtggtttttttattttttgggggggtgggaggagctgtcacaaagaaggggagattcaggaatggctccaggacacgtccctttactctgccaagatcaactcaaaagaccacaactgtttcatgatgctggtgaatacacaattctgtatggcactcactgatactgtcacctgagaggaagacgggggaagagacagagtatgggcttaaagaaacaagactgtataataaatacagattaaaaaagaaaaatcgccaccatctcccctgttggcctgattaccccgatcctgctatgtaacacagcaatccctcccctggagaccagaggggcttggcactgtggtggaagccagagcgagcaggcccttaggaaagaaggcaggaacaggaactggcttcaccagaaaagctagaccctcggactcctcctggaaactctcagaagggagggttatggccctctttgtcccttcatatttctggacaaagaccaccaacccaatatcaagccccataaagagcttttagaaaaacagcataagcttgggatgacaggcgtttctggactccctgtgatctcttccaggttcttggtcttcctcgctcgcctccctcccaccctccctagctgtccccccacctcagctcccttaccacggccctgcctctctacttcttctgtcttcgtcccctggactgtccaacggcctctggctcactgtccccttcatcttcagcaagcctatcaggaaacttcttgcgcttcctgcggacatatgggtggccaggaaggtgtttatgcaacagagccactagacactgttctgtcttcaccatgcagcttagcacatggctgccacggcagttgtaaacctcagcattggtaaacacttgcttcatgtcagtaagaaactcctgcacagagcggtagctcccacaggaacatttgttctgcactgtctgaaagtccatggggtgcgtgatcacatcatagtagtcctcggcctcatctctggtcacaggctccctgtggagaagaaccaaatggagaatctgcacagccttgacggcagtgcccctgccactgagacacgtcctgaaaagcaagggcttggctgagagcccctcaggggctctggaagcttttagaaccagccaggccactcctctcccctgcacctgagaacacagcactcacctgaagggccagctgaagcggtacttcacgatcttgtggaggatctcttcacacttctgcagctccaggctttgcctccgggagctccgcttggtctgaagcacctggcaggaaagaaagaacaatgttattacagattcaagacaggaggaagaatggacagggcagaaaataagtgtatctgctcaaaaaaggaagagagttcaactatttccttggcgcagaggtgctgaaaccttctgatattcaagtcagggagcaccctcggcccaggtggcaggcatcttcccagtagtccactcactcgcctcccccggggccacggcaatcaaagcagcaaagagcaggcagcgggggccgcctttaccagcagtcctgctggaggtcggctgaagggggctactgtcaacaggacactagctctcagagaacaggtggacctggggttacagtgacaccatggaagggcatcaacaagccactgcagaaagcaaaacatgctatctgggccaacagcagccaattctgtgggggtggggtgcctctggtaagaaaagcaagaggtccaattcccttcctgggctcttccaccgtagacatgtgagggttaagtggctaaagagaaaaggggcggggcctccattccaggtagccataacaaaagctgtgattcacagcagaggccacagagcccaaggctgtggcaaaccgagcatcttctaatgccttatgatctcccaaatggcctgccttaagcccctaactccaatttgatctgtcaaaacaagcaccttttcaagagtttcttttttgttctttaaagctcaagtgagatctaaaaactactaaaattacattggttaaggagcagaggggagggtaatgtccctcccataacaactgtcgactcaacagtaagtgaggctccagcattgctgacattcccacaatgaagacccagcccctctgagcccactggagacacatggatactatttttaaatccttaataagttgcaggctgcccgctaactagtttgcaggctacagcaggggaatgccggacatagctgttcctggaggccttgctgcttctgtctgcgtacaggctcacccatctgcctccccagcctcccaagtttggtaagaaggaggaggggggaggctcccctcccacctgttgcctgatgaattcctaattgctggggtagggaataagaaacagaaaggttagagaagggatgataaataattctcaccagctcatccacctcagcatcatccacaggtggtgccttgggctgagacctcctggtagagtgtggcttcttacccgggcgccggcctgaccttgctgcaggggggatgacgctgtgcttgccccggatggtctttcgaggtctcactgaaagaaaaactatggattcagcagagaacaacggaaggtgaagggaggagcatcttcgaaatgggggaaagggatgcagggagaatccttttcctggacaaggaaagcagtggcctcctttggttttaaggtgctcttgctattttatcttgccttacctaacaggacactaaaaggcagtggcagccgatgaagaatgggtgcctttcatccactgccaaagcccttcagagggctaggtccttcagtacttctgtcctgccccgtcctgcagttactcccagccataaggcccctgcaggaatcaactgtaaactctcactcatgagaagccatttgctaataggtcagcctggatttcccacagcccaagctcagcctgagcgagtggatgtatttacatgtaagatggaactggattgtaaaacaaaccctatgttgtaattcccagagttattctacacttaccatcagaatctttccagagaaaagctggtacttccatgaagggccacaaggctcctcattaaatacaatttagggctagtcccctccataagagccctgcccaggatccccaatgagagaataaagaatataggccgggcgttgtggctcacacatgtaatcccaccactttaggaggctgaggcaggtggatcacctgaggtcgggagttcaagaccagcctgaccaacatggtgaaaccccgtctctactaaaaatacaaaattagcagggcgtggtggcacatgctggtaatcccagctactcaggaggctgaggcaggaaaatcgcttgaacctgggaggcggaggttgcagtgagccgagatcacgccactgcactccagcctgggaaacaagggtgtaactccatctcacaaaagaaaaaaaacacacacacacacacacacaaaggcactgagactacttgtgtctcaggtttacaacaggtgctcaccatcaagccaactggcattcctcagtgagccctgggaaacaatgccatgaggatttagctccaggctctccaccaccttcccttggggagtggggagatgacactggacacagaggtctaggaaggcagtgacacgaataatccagaaacactactttccattctatttctggatcacgataaccctttcttggctactttagcgtctctagctcaagcccaggctagtaagaaagggtaagaatctgatgcttaggtgctagaaccttgagctgcactggggaaccacatctttggtggtctgaaagatagagttgacaaaaagctctgaagtaccaaatacttcccagatccttttggcaagtcgaggccgtaaaaacttagaaaagcaattccttggaaagagagctacaacgtagaagtggaaagcaatcactagcttacaaataaacagaatcagtatactaccatattcaggatctgccctcagagagatcaggcgcagtggctcacacttgtaatcccagcacttcgggaggccaaggcaggaggatcacttgaacccaagagttcaagaccagcctgggaaacatggcaagaccctatctctacaaaaaagccgggcatggtggcacgtgcctgtagtcccagctgctcaggaggctgaggtaaggaggattgcttaagcctgagagatcgaggatacagtgagcagtgatcataccagtgcactctagcctgggcaacagagaaagatacccatcccccgctccgccaaaaaaaatatgttcccaaacaaaggtgtgcccaagtcactgactctgaccaacagaagaggatattcctgaatgcaggactgatgggccatttgttcacttaccctaggatacctgaaaaatcaggcgtagtgaacaaacaaaaagagcccatacgtatgtgagagcttaaggtgtcccacatcacacctctgaagtatgggggggaaagtgggaggacaggagaagacgggcaagcccaaatcattaggttttggcagtctcactacagtaagagactagtcatgccaggcatcctctctctcactccttataccaagtatgaccattcagagctgctatgatcttgggaactgtaccactgcttcaaaagctcattagaattttgatctgtggtctgttttctacgaacctgtaaagaaaagtgtattggccgggcatagtggcttatgcctgtaatcccagcactttgggaggccaaggcaggcagatcacttgagctcaggagttcgagaccagcctggccaacatggtgaaactccatctctactaaaaatacaaaaatcagccaggtgtggtggtgggtgtctgtatactcgggaggctgaggcagagactgaggtaatctgaggtcataccactgcactccagcccaggcgacagtgagaccatctcaaaaaaaaaaaaaaaaaaaaaaaagtgtattttggaaagagggaggctgctaaaagaaaggctagactggaggacattagccacaaacaccagactctccaacactcatgagaaatgaacatgagagaatgagagtcaatgcggtgaacacaaaagatgatgccttttttcctactggcatctagtgagaacagatctgaatcttcctaacatccttccacctaagccttcaaataatcagtcgtctcttttcaaaccagcaaagctataaccctgcacactgcagggaggagaaaatcactgtaaccagacagaaaaagtcactctctgaaagcagcgataaaacaacagccaaaagaactgtcaggagatggcaatgggccaagatcttccttccccattgtccccatatgccgaggagctgagaatcagcagccttggcataaatatacttgggaccatgaattctactaaatcttagagcaagtgggttgatgttactgagatcaagccaccttctctcccaccaggcaggaagttaaacgccatcttggaaacccatttaaacccatggcagctaagttacgccacagtcacaacacaagagaaaaggaatagggcaagccggccacactacctactgccaagccagcctttccaagcgttccaagcttagaagactgtgaaatcaactacaaaggcagacaaaatacttacatcgcaaaccagccacctcataatcttcttcctcctcctcctcttcttcctcctcctcctcttcatcactctcatcatcttcactgtcctcagaagcagactcttcagtatagttcctgtgggtagaaaaaataatgtagggaacacagttttagcccaaagtggtcctaagaagggctcaaatcccacagggatcaggaaacttctcttcacagactacatatgtataacgtatgataattcagggagggaacctgaatgtaagccaggagagtttttcataaaaatgaaaaaccaagtttcaacagcatgcctcatgcctccttctgccaggccacagacagtttggacaagataccaaaggcaacagaaattaagaccaaaatgcaatcctacccttccccacacaaagcaatacaaaacactgtttcttttgtctcacaaaaagagccagataatgtaatacatcagttactaaaagctgtccccacctctgaggtagactgaaaagaataaacagagcccagacaggtgtgacttcaccttgatggcccccttccaggagctgaaacagcttgcagatgaccataatatcaaagcagtggtaatcccagctcggaacagctggtccaaagccccaccatttcagagcaacatgtctcatctctaagtgcagctgggatggagtgcaaaagaacctgctaatactgttaaggtggggtcaggatcaaacagctctgccccttagaaggaagcccaggccgggcaccgtggctcacgcctgtaatcccagcactttgggaggctgaggcaggcggatcacctaaggtcgggagttcgagactagcctgaccaacatggagaaaccccatctctactaaaaatacaaaatgagctgggtgtggtggcgcatgcttgtagtcctagctactcgggaggctgaggcagcagaatcgcttgaacctgggaggtggaagttacagtgagccgagatcgcgccatcgtactccagcctgggcaacaagagcgaaactccgtctcaaaaaagaagcccaagccagagtacctataagctgcacattttacaaccccaaatttcagtgtggaaaacaacagtattatcttggcaagtacaaggtgtctcctctttacaaggcccggtatttggccttattgagattcaagtaaaaaaacaaagcaccacctctactctcagggcattcataatctcatgggagacagacatgtataaaaccagagacaagatccatgcaccaaaatactacttcagagaatggaggttcagctgaacacagaggagaaaccatgaagcctaaggatgcaagcacttttcaaaagcgcagtgaaattttagcgaagccatgggcagtttacccactgggaattctgggcagagaatgttcccagctgggagaaaggcacaagaggcaaggatgaacaacaaacggtctgtaacaagtacacaaatatgggatctaaagctaataaaaacccaagctggtattgtgtaagagtctcagaagtgaggccaggaattgggatgttattctagaggcaatgggaagactagaagtttgtgatcaggaatgtgagcagatctttgctttgtgtacagcattctggtgttgcaatagttgggtggataagaggggagaagacgtgatataagaaagaggagttgagaagccaccaaaggagcccaggtgacagatgtagaagggacaaatgatagcggagaccacggagaatggagagcaagaaactggatcatcaaacatctgggcattggattgatatcatggcaaattaatgggtttgtaggatgagggagagatgttcatttccaagttgacacccaagttctactcatgatagggaagaaaacattatgtatcggtaaggaaggtaatgagtgtgagatttttagcagtgggtgatagcagaagtaatcatgaagacacaggaagtgggcaacaggaggctaaaggcagagagagagatttcattacttgagaagaaggtatgatcaagaagacagagaatgtggctggcagtgaaaactagaaatgtcaacattcagctaaaattagctcagagtcctttgagctcctattgaagtactgtaaatgatcaggctctgtacccaaaagatgaacttaaagctccttagattcattctgtttgaataactcaagcttaattataacagctattcatatttattcattcaattatttttaaaagaaaagattctcacctgccacgggagttgcgcctggcagtagcgggctggcaagctgggcactgccactcaccatctggtacttcatagagggccggcctcagacaaaacaggtggaaggctttattacactcatcacacaagatcaatttgtcatcctcacctgcagagagataaatgtgaatagcattgttgggagcacagcagcagtcaatgagctgtaaggaagaggcaatcaccctacaattcaaggcacacgaggagacatgttccatagaatgctacccagttgttgctttgtaaatgcaggcattttctaaaaagaaatgaagcataacttagattacagataatttgggaatcaggtctcctaatttatatcccaaaacttacccatggctatgacagaacagttaacaattactaagaggcacaaaaaacccaagtgagagtaggaaattttgctgctttttcgacctccccaaacgtttctcaacttatgcctgatgagtgttctctctctctcttttttttttttggagacagagtcttgctctgtcacccaggctggagtgcagtggcgcgatctcggctcactgcaacctccgcctcccgggttcaagtgattctcctgcttcagcctcccaaagtgctgggattacaggcgtgagccaccgcgcccggcccctgatgggttcccttaaaccatgtggtttcttacatttgaaaaagtgttgtgctgagtcaacttaatatggtaatctctccttccaaccttcattctagagcgattgaacgctttacagcaactgaatgattttacgtagatcttttcatctctaacctaactcagaaaataactctagccactgaaaagccaatcagcaaggggcttctaaccatgaagttccttttgcacatatgagactgcatgccaccctctgtacccggactgcctcctgctgaaagcacatatcttacttcacagatgactaaagttctgagccaatcaaaggatttaaaactaaactaactaaaatagttacaaggattaactaattttgttttctgtaaaaaatcagaagattgaagagatcaattgcttttatgttatgctctaaaccgaggaacaaagggcctgctctgattccctggcacgacatttcaaagactggcatgttacagacctgcaggagagtaaaatctataccacacttatattctgtgtacacaaaattcttttgggtagaaatgaagatcttgggaatagaaatcctactccctaatatacccacataagcaaatttgatttaaatatacctttctttcgacaaactttgcacctagcattttctgcggacatatcccacttgatacaggcatcaagcatcccaagcagcacgtgcatcctggagaaagtctgagcttcccggattgctgtcttccatttctccagtgcagatgcaacctaaacagagaccaaaccaggccagcattactacactgaccaaagacactgagagagaactaggaacaggggacagtatgagagaattctgaggacacttgcctcctagaacttcactaatctaaaccatttattcttataaaaggctccaaagggggaaaaaaacttgccaaaggtcacacagagatgcagtggagtgggtggatgactggggacaagcatcttctagggaaatccacctaacaactcagtataatttaaaaataggatcacctgtatgctgtaaatgctataatgcaacaattttagacagctaataaaactccgatttaaaagataatcaataacctaccacaacaccaccaatccaataccacagctggatttcaatgccctgcccgaagcaaagaagtccttgtgaagtaatgaatctcctaaaggaaaacagccagttatcctggaaggtcatgggctttaaaatacaggtgccaaggaacaaagatagttgattctgttccgaagtggggtactaaacagactggggagagggatgaggggaacagggctgctttttctctttcctatagaaacagagaatcacagggagccttgtgtgtataaatttatgaataacaaggataagtaatataaacacacatacaaaaatctacatttaagaagctgctaaagttcaactggaaactgactgactctgttgtagatatttcaacatctgctttgaaaaacagcaatctccttccttacttttgcagagctcctcagtaaactgaggtccacaatcacagctgccttgctgtcttctcccctgataaaaagagagctgacagacactactgcagattctcttcttgagaggataacccaaatcttttcaatggaatatcaatgtaagaatttcaggttcggttctttaaaagtgcttgagaactggcagggaatgactaccaatgggctttgctgtcctctagtggacattcacatgtagtgcacacagtatggaagaaaacagtcatgggcagtcctgctttttactatttcctatgaattataaaatctgagcatccaatagctcatctgacctcattaaaactttttttaaatttgaaggtgttttgggaataggcttatttaacctcgtttttttaaaaaacagattttaaatagtatcatacaataataggtagcccttgtaactggcttctttcactgagcatgtttctaggttcattcgcaaagcatgtaacagtactttcatcagttttactgctgaacaatatctcattgaatagacattgcacatgctgtttatccattcatcagctgacagttacctgggctgcttccgtattttggttattcagaatcaccccatcttacgatgggtcaaacctatgacttcacaatggtgcaaaagtgatacacgttcggccgggcgtggtggctcacacctataatcccagcactttgggaggccgaggcgggcggatcacaaagtcaggagttcgagaccagcctggccaatatggtgaaacctggtctctactaaaaatacaaaaattaggcgggtgtggtgatgtgtgcctgtagtcccagctactcgggagactgaggcaggagaattgcttgaacccgggaggcggaggctgcagtgagccgagattgcaccactgcactccagcctgggtgacagagcaagacttcatctcgagaaaaaaaaaaaaaaaaaagtgatacacattcagcaggctcctcgacttatgatagggttaaacccagataaaaccatcataaattataaatactgtaagtcaaacaatgggtttattgggacatagccccatcctaaattcaggagcatctgtaatcaggatgtccggacaaacgccaccaaagtaaacaatcaaacaaaacccaggattttgccaaacaatatatcagtcttttctatttaattcaataaaacaaaataagcattaaaaaccgaaatcaaccactattacaaaaagagatttgagagacaatccatttttataaataaggaagctgaatcctagattagagactgataaaagctcatgcaacagcctagtgccagttgaaaaaactttggcccttgctaagtggaaaccttcaaagcaaagagcagtggaaaatttcaaagctgtggctgagttgacctctggtggggaaccacgaggcataatgccattttaatgcagaacactgctgaactacttagtaggcaacctagttgattttccaagaaactcttccatgctttccatttatgtactgtgtctggacctgcaaacttctcacattttcctccccaactaagctaagaacaagtctcatctgacaaactaaaatgagtttacttcactgtggaacacagtacttcagaagttaatgagaaccctacagtgatgggtgagttctcaatgagaaggaagcactgttgcaggaaaagaaatggaaaggacagacgtgactcttggacagatcacatcaagaaagagactcttctgtattgaacttgagttaaaaacaaaacctatgtagtagtaagactaaaacttaagcctaatgagaagagatttagctaaggagactagttaactgtttaatatcttagacatctaaaaggttacctaggtgctatacacagtcatttaaaaggaacacagggccagatgcggtggctcctgcctgtaatcctagcactctgggaggccaaggcaggtggatcacttgagcccaggagttcaagaccagcaacatggtgaaaccttgcctctacagaaaaatacagaaaaagccgggtatggtggcacatgcctgtggtcccagttacttgggaggctgaagtagaaggacacctgagcccaagagtttgaggctgtagtgagccaagatcacaccactgcacccaccagcctgagtgacagagtgagaccctgttattcattcattcattcacaaataaaataaaataagcataggctgggcatggtggctcacgcctataatcccagcacttttggaggccaagatgggaggagcactggagcccaggagttcaagatcagcctgggcaatgtagggaaaccccttctctataaataaataaataaataaataaataaataaaaatttaaaaattagccaggaatggtagcaggcacctgtagttccagctactcgggaaagtgaggtgggagatcacaagcctggagtctgaggctgcagagagcctgggcaacacagtgagaccccatcccaaaaagtaaagacatttttaaaaataaaagaaacacaggaaggtgaaaactaaatcccagcaagataatgacacaccacatagtaagtgtctcagcttaagtcatgaattaaatctttatctaaactgaattttctttctccaccctgcttacctcttatccaaaattatctcccccatatcacatatcatcctcggcctcaggaagaaatgtagggggaacatgacaactatgtataaacatttgataagctttggaaaggacagcagactcactctatgtaaatggggaggacaaacaagaaccagctgtcagtgacaaagagcccaatttcagttcaatctgaacaggcctatgctgcccctcccatgacctgatccactcctacacattcttcaaaacccatcctctcttccctctggtaagttttctctagtgtgccctgggtatccctcacagtgagcctgagtactgctgtttctcatcattactggtcacaccacagtaagcgtcccctgccggtctctcacactcaaattgagttccccgaaggcaagaacttaaggctttttttttttgagacggagtctcgctctgttgccaggctggagtgcactggtgcgatctcggctcactgcaacctctacctcccgggctcaagtgattctcatgcctcagcctcctgagtagctgggactacaggctcgcgccaccacaccaccacactcggggtgtgtgtgtgtgtgtgtgcattttttctttttttttttagaagagaccggttttcaccatgttggccaggctggtctcgaactcctgacctcaagatccgctagcctcagcctcccaaagtgctgggattacaggcgtgagccaccgcacctggtcctgaacttaaggcttttttactcatctctataaaacctccaaacttactagcgactggcacaagcagggctttaccagatctttgtgaaaaaaaaggaaagaaggcagggagaggcaaatctaaaattagggacaatattctgcactaaataatggttaggacctctcccataatgtaatgttctcaaattcttttcttcacaagtaatcttaagcagaaatctaatacgcaaaacagacaaaaatggagctgctagttattctattaagtttcatatttattaataagtaatacaaaattaaaagaccaaatgtggctgggcgaggtggctcatgcctgtaatctcagcactttgggaggccagggtgggtggatcacttcagcccaggagttcaagaccagccggccaacacagcaaggccccgtctctataaaaaatttaaaaattagctgggcatggtgacactcgcctataatcccaggtactcagggcaggctaaggtgggaggattgcctgagcccaggagtttgaggctgcagcgagccatgactgcaccactgcactccagcatggacagtagagacccgtttctaaagaaacgcaataaaatcagaaaagagcaaatatgacatcaggtagatctgtgtggactaacgggacggaggggacagatgtttagaatatactggtaagtgagaaactgaagactgttgtgcacagtataagtttccacttttaataaatccaacaaatctttgtatatacataaaaaggacaccaaactattaaaaaagtgacatccttgggcagtgaaactagggtgggagttatatattttacttacctctcattttatttacttacaataataaagcatgctacatttaaaaataaaaagtgaggaaactgggtatctaatatgaaaaaaatgaagctgaagccttaccttctaccactgacaaaaattaactcaaatgatcaaagacctaaatgtaaaagttaaactataaaatatctagaaaaatacaagagaaagaaacgttcatgacactgaatctggcaatgatttcttggacatgacaccaaaagtggaggcaacaatggaaaaaaataggttaagttagactccatgcaaatgaaatgcttgtatgcaaaggacactatcaacagaatgaaaaggctacccatggaactggagaatatatttgcaaatcatgcatctgaaaaagggttattatcaaggacatataaagaactcctacaactcaacaacaaaaaatccaattgaaaaatgggcaaaggacttgaatatatatttctccaaataaggtagacaaatggacaataagcacatgaaaagatgctcaacatcataaatcattagagaaaaacaaatcaaaaccacaatgagatacaacttcatatccattaggatggatactattaaagaaacaggacattagtattggcaaaggctgggcgtggtggctgaggcctataatgccagcactctgggaggccatggccggcggaccacctgaggtcaggagtttgagaccagtctggccaacatggtgaaaccacgtctctactaaaactacaaaaaaaaattagccaggagtggtggtgcacgcctatagtctcagctacttgggaagctgaggcaggagaatcgcttgaacccaggggagtttgcagtgagccaagatcacaccactgtactccggcctcggcgacagagactctgtctcaaaaaaaaaaaaaaaaaaaaaaaaaaaaaaaaaaaaaaaagtattggcgagaatgtggaaaaaccagaaccctcatgagttgctggagagaatgtaaaattgtacagtcactataggaaaccatagagtggttcctcaaaaagttaaacactgaattaccatatgatgcagcaatcccactactgggtatacactgaaaaaaaattagaagcagggactcaaatatttggcttttttggttgtttttcttgtttttttgagatggagttttgctctgttgcccagggtagagtgcagtggctccatctctgctcactgtagcatcagcctcctgagttcaagcaattctcctgcctcagcctccctagtagctgagaatacaggtgtgcgccaccacgcctggctaatttttgtatttttagtagagatgaggtgtcaccatgttggccaggctggtctcaaactcctgacctcaggtgatctgcccacctcagcctcccaaagtgctgaaattacaggcgtgagccaccacgcccggccgggactcatttgtacattcatgttcacagcaacattattcccaatagccaaaagacggaagcaacccaagtgagtggatcaacaaaatgtggtacatagagacatgatataataaatatatttggtccttctccgcagactaaaaccttaataggagtgtcttttgttattcagaggagcccctttggatcacacctaaatttatgctaatgaggctttcggtgagacctctagttatggggctggccaccagaaagaccagatgattagaagactggaatgttcagccctacccacaagctcctgaaaggcaagaggaggggagacttcggagattaagctctacgaagatactggaacaagatctgatcagcttcaggtaacacactcagaagctggaaggaaggagtgttcagagaacacgtgaaagccccacgtacccctgctccgccaccttccttgttccacacgtctcatccatctggctgttcctgagtagtatccttcaaaatgacccggttaacctaagtaaaatgctttcccgggttctgtcaggcattctagcaaattatcatacttaaggagagggtcatgagaatcctcaatgtatagatggtacaggtggcaacgtggggcttgcgactggcatctgaagtgagaatagtctcgtgggacagagcactttaacttgcaggatctgacacaaactccaagtagaaagagtcagaattaaactgaattttaagagtagttggtatcagcagagaactagagagttgcttagtgtggtaaaaacccatgtatttggtgtcagaagtgtatgaaaaagttttgaaggctgatggtggtgatggttgcaaaacaacgtgaatatacttaatgccacagaatcgaacacataaaaatggtaaatttgggctggacgtggtggttcacacctgtaatcctagtactttgggaggctgaggtgggcagatgacctgaagtcaggagttcgagaccaacctagccaacatggtgaaaccccgtctctacaaaaaatacaaaaatcagccaggcatggtggcatgcacctgcaattccagctacttgggaggctgaggcaggggaattgcttgaacctgggaggtagaggttgcagtgagctgagattatgccactacactccagcctaggcaagagtgggactctttctccaaaaaaaaaaaaaaaagtaaatttgtatgttatgcatatttttaccaaaatttaaaaaatatctagagcaagcatggctgggcgcagtggctcacgcttacaatcaaactttgagaggccaaggtgggaggatagcttgaggccagaagttcaaggttacagtgagttataagcaaatcaccgcataccagcttacacaagagcaaaaccctgtatctaaaaattaaataaacaaattgttaatgtgtttaaaagtcaccaccacctttttaaaaaagaaagtaaactggtagaccaggagtggtggctcacgcctgtaatcccagcacattgggaggccgaagcgggtagatcacaaggtcaagagatcgagaccactctggccaacatggtgaaaccccgtctctactaaaaaatacaaaaattagctgggcgtggtggcacgcacctgtagtcccagctactcgggaggctgaggcaggagaatcgcttgaacctgggaggcggaggttgtagtgagctgagattgcaccactgcactccagcctggtgacagagcgagactccatctcaaaaaaaaaaaaacaaaaaaaagaaagtaaactctggtaaaggtgggaaggccacatccactgtgaccatcacccaatgaccaagaagcagggctgcactccacaggccagtgtgaaaaccacagaaggggtagaaagtgattaaaaaaaaaaaaaacacacacacacacaaaaacactcactcagggcacagtgcctatagcagctaaaatgcatagggttagattattttaaaaccaaatcaactcatctacggaatcataaactacaacttataacaacaaaatacctttgcttcctctaccattttcttctcttcatccacttcctcagtttttgctgaatcttcactttggagttttcttctcttttgcttgggagccatgaagccttggagaaatttctttatgacactggcctgaagggcaatcacacactcaccaaaatccttcaatttctctaatgaaatgacctataggaaaggattttaaaaccagactgagaaaaggcccagaggaagacgaaaggaatccaacctcaaattcaaataaatctagactcaaatgccacataacattcattaaacaaaatcgagagccacataccattaatttaactgtgctcctcagttcactgcatggctcatgcatttaaaagtacttgactggccgggtgcagtggctcacgcctgtaatcccagcattttggggggccaaggcgggcgaatcacctgaggtcaggagttcaagaccactttggccaacatggcaaaaccccatctctactaaaaatacaaaaattagccaggcgtggtggcacgtgcctgtaatcccagctactcgggaagcaggagaatcacttgaacccgggaggaggaggttgcagtgagccaagatcgtgctactgtactccagtctgggtgacacagcgagactccgtctcagggaaaaaaaaaaaaaaaaaaaaaaaaaagtacttgactacttcccttttcccagctaagggatccactaaatggcagaagcccccccacataaaggagttacatagttgattcattcaataatgactgagtgcctactatgtgtaaaatacaattttaacgcaaagacacactaagaaagtaaaataaaaattcactgactttccatcttaatgtttttttaatttttttcttatttctaacttgcttccagcatgtaactaactatatgtaaggtagtatgttttacaaacttgatctccttttttttatttttaaagagataggtctcactgggtcacccaggcagaagtgcagcaatcacaactcactgcagccttgaactcccagactcaagtgatcctcctgcctcagcctccccattagctgggaccacaggtacatggcatcacgcctggctaattttttaaattctttttagagacagggtctcactatgttgcgcaggctggtctcaaactcctggcctgaagcgatcctcctgcttcactgatctctttttaagcttcacatctacctgatagatgaggaaacagaagttaaatcacttcatcaaaatcatgcacccagccaggtgtggtggcacatgccagtagtcccagctacttgggagactgaggcagaaggagtttgaggctgctgtcagctatgatctgtgaatagccactgcacttcagactgggcaatataacaagacctatctctctctttttttttttggttttttgttgttgttgttttttgagacggagttttgctcttgtcgtccaggctggagtgcaatggcgcgatctcagctcactgcaacctccgcctcccgggtttaagcgattcttctgcctcagcctcccgagtagctgggattacaggcatgtgccaccatacccagctaatttttgtatttttagtagagacggggtttctctatgctggtcagactggtctcgaactcccaacctcaagtgatctgcccaccttggcctcctaaagtgctgggattacaggcgtaagccaccgcgcccgcatgaacaagacctatctcttaaaagatcaattaatttaaaaataaaaagaaaagaaataaaaaatgtccttaaatactatcttgtcaatcacacaagacatgccaattagaagataacgttttaatagtcacaaagaaaactaagaaaaatgacaacctaacgtcagcaagatataggcctgaatttggcacaaagtaggcaattaatgaacatttgctacacaaaaaagtaaacatgtaacatctgaaacctgcaagatcctttgggttcaataattctttttaaaaaaatcattaagaaccataaagatgtttaaatccttttccccaggaaatgtaccaagaattcatcacaagattaattaaaaagaaaaaatgtgcatatgtaagatacacatattatttgcttattccaatagcaaagaaaaacaagctaaaatagttgaaaagtacttataaattaggaaaaatggcatgggggaatgcaaatgaaactgttcataaaaatcacaaaactataagagcacatatgttggctgggtgaggtggctcatgcctataatcctagcattttgagaggctgaggtaggaggatctcatgaagcctggagtttgagatcagccagggcaacatagtgagattttgtctctacaaaattttccatgtgtttgtgtgtcaaacagggtcttgctatgttgcccaggctggtctcgacctgctgggctcaagcaatcctcctgccttagcctcccaaagtgctgggattataggcgtgagccaacatgccccgtctctacaaaaaaattctaaaaatcagccaggcatggttgcttgtacctgcagtcccagctacctggaaacctgagatgggagaatcacttaagcccaggaatttgaggctgcagtgagcaatgactgtgccactgtacttcagcctgggtaacagaggggacttcatttctttaaaaagaaaaaaaagacaaaacatcatagtgcatgaggaatttgaaaagacccacaaatattaatatgtctagaattatgtggacttattgatttaaaatcagtaaaaaacggtttataatagtaattgatggatactattcaccaatctttgatacctaaacctacctgttacggggtatgggatcttttgaaaagtttcacctataccacttaagggtccctctgagcaataaaggacaggactgtaatgacagcacactggacaacatgagtgatgcccaacataaatagaaatctgagctgactgagtgtgaagaatgggcaagtgcaggatatgcaagcatgtttcacacctgaaagcacaggcatcgcaaggtaaagatgttaaatgatgctatacgactggagcctctacaaccagttttcattcaccttagtagtgaagctcttttcataccaaggttgtaagccaattactaagtttttctggatagcagcaaaagataacaaggaaaaaatacatatacataaggtatttttggttccatacatgtcttccaagacaaatccaaacatctgatttccaggagggtcatgttgggaagtcaagaacagcaccagggaagaacttcagattgagttgccatgagtaatctaagggggattttcttatattcctacccgggcttcaaattctgatgtttcttccacatatccaagtcctcctttttgtaaccttgttgcaacttcaatgagatcactacgaaggaagtttaaaagctcctggttgccatcacaagattttagacccaaatttggcttccgtgctagatgaatagagtgaataatgtcctggtacctagaagatttgggacaagagaatggggaaagaaacaaacttttgaagatgttcttcaaatttcaattacttaacatgttttatttctagaaaacttacttagatctctttcacctctccctggtgttttttcttttttcttttttttttttttttttcccccgagacagggtcttgctctgtcacacaggctggagtgcaaaggtgccatcacagctcactgcaccttcaaacttctggactcatgcaatcctccaacctgagcctacagctgggactacaggaatacccctccacacctggctatatttttaattttttgtagggatggggtcttgctatgttgcccaggctggtctcaaactcctgatttcaattcaagcgatcctctcccctaggcctcccaaactgctaggattacaggtgtgcaccaccacacccagccacttctaagcttttaatggaaggattcgatcttcatatttagtgaacaaaacaggtcttttcaattcaacacacatagctatcaaatgctctgcccaaagagaaggaacatcatagaactatatttctttgtggctctgtataccgacattttcctttgtctttttttttttgttgtttttgagatggaatgtcgctctgttgcccagactggagtgcagtggtgcgatcttggctcactgcaacctccacctcccgggttcaagcaattctcctgcctcagcctacctagtagctgggactacaggcacccgccaccatgcctggctaatttttgtacttttagtagagacaggattttgccatgttggccaggctggtctcgaactcctgaccttgtgatccgcctgcctctgcctcccaaaatgctgggattacaggcgtgagccaccgcggccggccctcctctgtctttcttaatttgcctagacacatctgtattcagacaacacaattctgaatacagttttacttaatttacacattaagcagtgggctaacatcaatataatgtacctattgtccttcgcaaaagtctggcaatggtgtagagtatgtactgaatcatattttccttctctcttccatcaaacctaaattcaaccgtgaaattgagcacagagtcagcaatgagaggaggcattaagccaaaatcttgtcctggctttgatagaaataatgtctacaacaaatatggcagtcgcaaatttgatgctactttgtagacagaacagggttttttgattctttttaattcatatgacatgaaattcaccaacttgaagcatgtacttcagttttttgttgtagaaccacacatgtaattccaaaacattttcatcaccccaagcaggaatctcttacctgttagcaatcatcactcctattctccccttcccctatcctctggcaaccactaatccactttctgtttgaaatagatttgcctattctaagatgtttcatttgaatggaatcatacaccacatggcctttgatgtctgacttcttttgcttagcatgttttctaggttcattcatgttgtagcacagaacagtacttcatttctttttgtggctaaataatattccactatttgaatatactaaattttgggggttttttgtttcattttgtatgagacagcatctcgctctctcacccaggccagagtgcaggggcatgatcttggctcaatgcaacctccgcctcctgggctcaagtgatcaactcagctcagcctcccaagtagctaagactacatacacaaaccaccacacccaagataatttttgttttgtttttttttttcagaaacggagtttccctatgttgcccaggctggtctcaaaactcctggatgcaagacactggcctgcctttacctctcaaagtgccgggattacaggtgtgagccaccgcacaaggcctggatatatactaacttttatttatccgttccatcagttgatagtcattgccgttgtttccaccttttggctcttctgaatattgatagaatacttctggacacccacccatctgggcctccatctgcaaagctgtctgacaaccatgaggctcacagcttggtgctggcaactgttctttagtgcataataatcctgctactctatatatagatggccaaaggtatatttttccaataagcataatatgccaagaaaataccaggcaatatgaacacaaaacggttacacatttaaaatattttactttagtaacttaaatggataagaaaaaaaaccctcagatatttatatccaatgctaaagagaagtaagatgtgaggagtaagatgaaaacctcttacctcttctctagtctctctttaagttgactttctcttattccctgagggtgaagacagtttagcaactcatccagctccttttgactatcacataaaaacctgtaggggcaaaagagacctgataactctgaaaaaaaaaaaaaaattcaaaatcaaacactaagcaagggatctagagttggtggtgggacttgggagaacagaattccaaatgtgttcacaatctactatctagaagtagaataagtaatttactattttcatgatgcctaatgttaattctgtactaggacaccagagccaatatggttcctattaaaatattatatgaaattttataaagttaattggcatacttgtccctttccctccagagagtaaacctatacccaaaattcaaaaatgaaaggtcattaaatcacaggtgatcacagttaaagccgtagaatggatcctctaaaacctagctcgctgcctaaaagcagaaatgcgcataaaggaaacgaatagctatgcatacaatttgttaattaataaaatttaaggaaaatcttaaatacttctattcccaaccaaatttaagctacatttctactgctatataagatctatcacataatatacaaagttatattacaggggggaaaaaatcaaaattccaacccttaaaaaaacaagtatcttcttaacaaaaaatcaggtctgctaatgcaagaagttttgatatccaaaatatcagtcacacaaagtatcctgcgcaaataattattaactcactggcatcactatactaaatactttcttccttaacaattaaaaggaaaaagaaagagcaaccagatgaatgctcacattaccataggttctgtccttgtttgggtgtggttgtctctacagcaacttctgttgctgttccatgttgtgtgttcatgcttgcatttttacctaagtttgctttcttacctaagaaaaattgagacattaggttgactttagtaaatacccaattgctagtttcaaatctaagcagtacacagtgccaaactcaacaatttgtaacaacacagatacttcctgtgaaatatatcaaatatatcttcatgtataaaagatgctaatttctcttaaatatcttaaacacagcatgttatctcagatatttgctctctgaagtggaatcgttacacagttccaaagtttaggggtactgcaacttagaatgaagaatgactaaatatctttatatcaaagcaaaataaagaatttactccttttacatgatgttaagagcaaaggcatctgtagtgaagcagaggtaatgagaacatataaatactatagacttatccttggaggcttcaagtgtcaaataatacaactaacttttttgtaaatcagttcctatatactgatacgtgactttaacatagatatatcttgagccaatttatcaaagcctatcttagatcatcacaatatttggttttttgttttgtttcgttttgttttttgagatagagtctcgctctgtcgcccaggctggagtgcagtggtacaatctcagctcactgaaacctctgcctcccaggttcatgcaattctccctgcctcagactcccgagtggctgggattacaggcacacaccaacacacctggctaatttttctatttttagtagagatggggtttcaccatgttggccaggctggtctccaactcctgacctcaggtgatccgcccgccttggcctcccaagtgctgggattacaggtgtgagctaccacgcccggccagtcaccacaatatttgaagccttacctcatactatgattgtttatcttctctttcccattctccccactttaacctgaaacatctctgcaatactaacacataactttgtttagtcttttcaattgggtaatttatttattttttttaattttttgagacagaatgttgctctgtcacccaggctgcagtgcagtggcgcaatcttggctcactgcaacccctgcctcctgggcttaaacaattctcttgcctcagcctgccaagtagctgggattacaggtgcccgccaccacacccggctaatttttgtgttttttgtagagacggggtttcgccatgttggccaggctggtcttttaactcttgagctcaagtgatccgcctgcctcagcctcccaaagtgctgggattataggcatcagccactgcatccagcctcagttgggtaattttaaataaaaactgccattctagaactggaaaacacgaaacaacatccaccaggatgctctagaagtgaagggtctggctccccaatcttgtctcggggacacattataaagtaacactccttcatcccactggaatctcttccaaatctaaacatccaggctccacagttactgctctcaaacctaactgccctcacctgagtatttatgaagtctaacgaaaccagattcttctataaagtgacataatctatgctcgatataattcaacatgcaaacaccttaaatctgaagttttatttgaaggaatgtttatttttgtaaatcagtattattcttatttaacaattttgtgagtttcaagcttgagttaggaatttctctaaaatgaattactttttaaaaaataaagatttatcgaagaagcacaataacctagtactcaggaagcaacttcttttatttctttatctcccacatgacaccaacacataagcaattttcattaggttacagacagcagagctgaaagaagcttatggatcatttaacctagtggttctcgaaagggagcactgctgcctgccacatgtatctggcaggatttagagacatacttggttttcactgctaccacctagtgggtagaggggagctcccgaataacctataatgcacaggacagctcccagtacaaaaaactatcttcctcatcagtgtcatggtgggaggaaaaaaaaaaagattcatctagcccaaaatgtcagtaacactgaggttgagaaaacctgacctaacctaaccatcttatttttttaattaaaatttgttttatttctttcttgaaatatactcaatacatacactttaagaaagaatatggatatatattcagaaaactattcagtgtgtgtttcttttacaaactgaacacatatacccggcacccagatcaagagaaagaatattaccagtgtccctacatgatcccctctcagtcactcatttttcgttaggtatttgccatgtttctcctcacaagaattttaagaaccttatctgtcttgtttgctgctatacccctagcgtatgacaaactgcttcacaaatagagattcagcataaacactgaataaattaattttaaaagtagaagaagagggtcaggtgcagtggctcacacttgtaatccccagcactttgggaggccgaggtgggcagatcacctgaggtcaggagtttgagaccagcttggccaacatggcgaaaccccgtccctacaaaaaatacaaaaattagccagatgtggtggcacacacctgtagtcccagctactcgggagactgaagtaggagaagtgtttgaacccaggaggtggaggttgcagtgagccgagatcacgccattgctctccagcctgggcaacaagagtgaaattccgtctcaaaaaaaaaaaaaaaaagaagaagaagaagaggacatctaacactgcccttcttagaccccatacctcaatttcagcccttgaggcacctacaaaggcttccaagggacaaagtttgaaaactgctcctataaaagctaatacccaaatatcctcatattcaagctcttcatcttctcacactatgcttagaacaaaggtggtaatcaaacgtgggtttctctccttctttctacacatttcacatctacctacttcactcaaatagatctaagaccacaataaagaaattctgcaaatggaaaacgtgacagaggaaaagcagtccttaatgttgagcccacttgagcagggtgaaataactcttagatatacagatatactcactgcgaggacagtaatcctcatcaccagagactgtgtggtctttgcagtgatggttgaatcggtagtcaatgctgtcatgtacccagcctttttcaatgaataatcctggaacttcatctgagaagagccagtatctacaaatcacaaccagtattaataagacagtgaatagatcaggattgcaggatgattttactgctggagaagataatacagagtatcactgagcattcaaaaccacagtttacagaattcttcctcttcagaactctagacagataaaaattgcaaggtaaatcaaagtatacgagaaatgttgaaactggagactagcttaatgttcgtaatttgtataatttctttcttttttaaattgaaatggggtctcgctatgttggccgggctggtcttgaactcctggcctcaagcaatcctctcgactcagcctcccaaagtgtaggattacaggtgtgaaccaccacgcccagccctaatttgtgtaactactaatatttctcctttaggtttcacaaaatgtatgtatttaaaacctactgccatttttaaagacttggattacatttcacctatcaccatcatgtaagcttcctacttgtggtatatgcaagggcaggaatatgtcttacttaactttgcaactctagcatttggcagttaatattcaataatcatcaacaattctgtttccaaaaagaattggaaaactgaagagagaagcttgtctattcttgtactttagaaaattttcctaactaatagcaatgtaaatagtcctaaagaaaacaaaaatttggtttaggaactgacctattatggtttcgatctgtgccaataggagtcctgcgcatgactagtttggccttggcaatcccttcctggaaagctttctcagcagctgctttgtgcttccgtattcgttcttcttcagcttggcgttccagtttcactgttaaaaataaaaagactcaaatcagatattttcctagtaaatcccactcttacaaattaaataaaatatggagtaaaaagtgcctagtatacagtagttatcaaatcttagtttgctttctctaattctaatctgttacaagaaattacatgtaaggcagcaacatctagtcctcctacactccttgaatttgtggtgacatctcatccctcaactcaatgcaaaatcttttatctccaaaatatcacttctttttgtttttgttttgaggcagagtcttgctctgtcacccagggtggagtgcagtggtgcgatctcggctcactgcaacctctgcctcctgggttcaagcaattctcccgcctcagcctcctgtgtcgctggactacaggcacacaccaccgtgtccagctaatttttacatttttagtagagacggggtttccccatgttgtccaggctggtctcgaactcctgacctcaactgatccacccgtctcggcccctcaaagtgctgggattataggcgtgagccaccacacccagccaaaatatcacttcttaatatattttaaacaatcctgaagaaacagttaacagtccataaataggactaactgaaacatcttctgacaggtgcacctacaggatcctcaaaaagatcacgataaatcaaactagtaaaataactatttcaaaataaaacatatttcagtcctgaggaatctgacagtaatttggcttaatagccctgatgacaagaaaacaaacctgaaaagcaacagcagggacgcacttgtggataataattattttacattgaacacctatttttctaattattctgcaagttactgttaatgataaaaattttatttctgatcattcattaattaggtttattcagttagaaatttccctcaacaaaagcagcccgctaattttgttaagtttttccataattgtcacaaaccttgacaccatagggtacatggcaatgctatttacaatgtcacaatttttaagaagtgtttattatttttttagagatagggtcttactatgtttgcccaagctggtctcaaacttctgggctcaagcgatcctcctgcctcggcctctcaaaatgctgggattagagatgtgagccactgcactcagccccaataatttttaaccctgattgtctattgacaataacatctacaataagatgtaaatctggaaaatgcatctgtctaaagatgttactttaaaaacttaagataaattccatttatttaaaacatggaatttgttacctttgataaacagttttctagcccaagtgaaactgtgtatttgtaacaatggttatagtagaaaatagcacaaaggtaaatgattaaaaaaaaaaaaaagcgagagagtgagtgatggcccaattacaatcaaggaaaagttcagtctcccaagactacaaacaaacataaaccaacttaggacaagtcaccaaaggaagaccaaattctgtctcagaggttacagcactgaactagttatccaaagacctgaactctaatccaaatactgatcttggtaaaacactaatattctgtctcttgtttccatacaaataacagagtatcatcttcttttccttctcttaagataaatataaaacacagtggagcagtccaaaaatgcaagaagaaattattacgtttcagataaaatagagctgaaggttttaacctacattctgcttcatctggaacacagttatactttttttttttttcttttttttgagacagagtttctctcgtgttgtccaggctggagtgcaatggtatgatctcgcctcaccgcaacctccgcctgccgggttcaagtgattctcctgcctcagtctaccgagtagctgggattacaggcatgtgtcaccacgcccggctaattttgtatttttagtagagacaaggtttcttcatgttggtcaggctggtcttgaactcccaacctcaggtgatccgcccacctcagcctccccaagtgctgggattgtaggtgttgagccactgcgcccggccgcagttatactttcttgataggtattgttttgttttgagacggagtctcaccctgtcacccagtctggagtgcaacggcatgatctcggctcactgcaacctctgcctcccaggttcaagcgattctcctgccgcagcctcccaagtagctgggattacaggcgtgtgccaccacagccagctaatttatttatttatttatttatttatttattttgagatggagtctcgctctatcatcaggctggagtgcagtggtgtgatctcggctctctgcaacctccaactccctggttcaagcgattatcctgtctcagcttcccgagtagctggaattataggccgagtagctggaattacaggcaccaccacacccagctgatctttttttttttttaaaaaagacaagagtctcgctctgtcccccaggctggagtacggtggccgatcttggctcactgcaacctcagactccctggttcaagcaattctcctgcctcagcatcctgagtagctgggattacaggcatgcgccaccatgccaggctaatttttgtatttttagtagagacagggtttcaccgtgttggccagaatggtcttgatctcctgacctcgtgatctgcctgcctcagcctcccgaagtgtaggattacaggctgtgagccaccgagcctggcctgttcatatgtctttaaaatgttaatacaatggccaggggcggtggctcatgcctttaatcccagcaatttggcaagttgaggcaggcagttcatttgaggtcagagttttgggaccagcctaaccaacatggtgaatccccatctctactaaaaatacaaaaattagctgagtgtggtagcagatgccttgttatcccagctactcaggaggctgaggcacgagaatagcttgaacctgggaggtggaggttgcagtgagccagatcgcaccattgcactccagcctgagcgacagagcgacgctctgtatccaaaaaaataaataaaatggaaagtacacattacatatgtatactcaggcacagtatgcatacatatgcaaaaatatttcaatggccttaagtagtgtaaactaaaatttgttttaaaaggaatatacattttctaatgaaagaactattcaagccggggtttggtggctcaggcctgtaatcccagcactttaggaggctgaagcaggaagattgcttgagtttaggggttcaataccagcctccacaaataataaaaagattagccaggcgtgctgacacatgcctgtaagtcccagctgctcgggaggccgaagtgggaggaccacttgagcccaagaggtcaaggctgcagtgagctgagatcacactgctgcactccagcttgggtgacagaatgagaccttgtctcaaaataaaataaaaaagaaaatgttgaaaaagaacaagctggaagatcaacacttccctattccgaaacttactacaaagcaaagttatcaagacagtgtggcttttacataaagacagacatacagatcagtgaaatagaattcagagtccagaaataagccaacgtatcctacagtcatatgatttttgacaagcgtatcaaggccattcaatggggaaaggtttgtcatttcaaaaaacggcactaggacaactggagagccacatgcaaaaaaaaataaagctggacttttaccttacactataaaaattagctgaaaataaaagacctaaatttcagaggcaaaactattaagacatttggaagaaaacaggagtaaatcttcatgaccctggatttggcaaaagatccttaaatctaacaccaaatctataagtaacaaaagaataaatagataaaatgaacctcatcaaatttaaaaaacttttgtgcttcaaatgatactactaagaaagtgaaaggacaggccaggtgcagtggctcacagctgtaatcccagcactctgggaggccaaggcgtgcggatcacctgaggtcaggagttcgagaccttgcctggtcaacatggtgaaaacccacctctactaaaaatataaaattagccaggtgtggtggcacacgcctgtaatcccagctactcgggaggctgaggcaagagaatcacttgaacccaggaggcagaggtttcagggagctgagatcacgccactgcactagcctgggcacaaaaaagagcgcaactccgtctcccccaaaaaaagtaaaaggacaacacgcaaaatagatgaaaatatttgtagaccaggtatcagacagagaattgtatctagaatatatacagaactcttacaactcaataataatcagataactcaatttaataatgggcaaatgatctgaatacttcgccaaagatacacaggtggccaggagacacatgaaaagatggttcaacatcattagccatcaaagaaatgcaaatcaaaaccacaatgagataccatttcacacccactagtatgactatcatcaaaaagtcagaaaataacaagtattgatgaggaaggagaaaagtcagaacctttaattcactgctggtgggcatgtaaaattgtgcagccactttggaaaacagtctggcagtttctcagatggttaaacataatcatatgacccaacaatcttattccgaggtatttactctaaagaaatttaagtatatgactactcaaaaactcatacatgaatatttatggcagcattgttcataataggtaaaagatgaaaacaatctaaatgtttatcaagtgatgaatgagaaacaaaacgtggtatatccaaacaatggaatattatccagccataaaagggaatgaagtactaacacatgctacaacatggatgaacctggagaacatgctaagtgaaaaaagccagccataaaaaggctacatattatatgattgcatttacatgaaatatccagaataggtaaatccatagatgcagagaacagattggtggttgctgggggatgtggacaagggagaagagtgagtgacttttgggttttcttttaaaaatgttttggggccaggcatggtggctggcccggcatggtggctggccgggcacagtggctcacgcctgtaatcccagcactttgggagactgaggcgggtggatcaggagttcgaaaccagcctggccaacacggtgaaaccccatctctacaaaaacacaaaaattggccaggcatgatggcgcatgcctgtaatcccagctactcgggaggctgaggcaggagaatcgcttgaatccagaaggcggaggttgcagtgagccaagatcaaaccattgcactctagcctgggtgacagagcgagactccatctcaaaaaaaaaaaaaaaaaaatgttttagaactaaatagaggtggtctattttgtgactggcttctttcacttagcataatgttttcaagattcattcatgttgtagcatgtaaaacattatgctaagtgaaagtcacaacagactatttattatacaattccatttagagaaaatgcctagaatagcaaatctatagagacaaagtagactagtggttgctcagggctggggaggatgggcgaatggggtaatgacagttcatgggtagcaggtttctttgagatgataaaaatgttacaaaattggcaatggttgtacattatctgtgactctactgaaaacactaaattatacacaataagtgaactaattatactgtatgtcgattatttcttaataaagctgctttttaaaagttcagattcgatggagccatcaaagcccaaaatttttaagttcttaaatcttaaaggacagattactatctgagttggtgaccgtgctaggggcttcaaataccttgtcaatcaattttacaacaatcttatcaagcatatgaggaaagtgaggcacggataagtaatctgcccaaaggaacactgtacagctaagtcagagctagaacctgaacccaggtcagtcaactcccaagtcctatgttgtttccactatttctatttgtagatttggtcctttactgaacccagaaaagatgccaacatcacattaacttattaactaatcagaatgccaggctgaacactccagctgaaatatgaaattatcaacagaactaataaaaaataaaatacataccaataggtgctgggttattacatacagaaataagtaaacaaacagagaccctaccattacctcagtaatttcctttcttttactatcttctacagagcttccccttttctctcagcatgaaattttacctttcatttctctttcctggatttcccgttccttcttagcttgaatggcaagcaaccttctgctcttcacagcactaatcatgtcttcagcttctgtatctacttggggctcaaacttcacaatttcttttttcctatcagttttgcctaacccattctcaacttttccattttctttatttttggcttccatttctttccgtttctgtttctctgctctcttcttatcattttcttccttcaacacagcaagccgttccttccacaactctgcagacatctgctgtctggtctccatgtggtcttgcactgagtatgtcatgaggatccggtggcacagtgctgtcaagatctgtagcttctcctctgacgtcagctcaaaaaattcagaggtctccagcttttctaggaactcatcttgtacctcattatcctcaaatgcagctgaatctttattgtcatctgtgtctgagccctcgctttcctcctgaacatcagatctgcgcaagcagagccgcaccagctctgaaacagaatgcagagtcaaggggatttccgacagcttcattcccaattcaccatagtcttctgctatctcatcttgtaggagggtctgtaagaggatgaccaacaccctgttaaggtataaaaagccacccttatctgcactcaaggcttccataagggacacagcagtaataggatactgagcatctggtaaaagtagcccagaataacagctcaagaattccaccaccatggccacatccccaaacagcgtgttgggcagcccttcaggggtatccaccaatctgaatgctggaaggtttttgccagttaactcttggtcctcataccgcttctgtttttctaatctctcaagcatttctttctctcttcgttctttggctttttccttcaacttctttttcagctcctcccgtttctttttcaaatattctttccgttgttcttcagacatagaagcccacctctttttgtgctctagaagttcatagcgtttttgaacaagacttcgcaattcttctgggagacgagctctatcttcactagagagaagacgagctgttttggagataacacaggacagggcgctcctcttgtcctccctgtctttgttttctttgtagtatgcaatgaggtgtagggctgcaggaggcagatgtttatgaggtttactagaggtcctaggtgtacccccagaattccgtggggctcgtgtcatcttctgcgtgcctttggccatatccaacaaagtcatctgcttcattttggttttaggagtcttcagtccttttttgggagatttggaattccctgtggatttctgtccattcaggatgcctttgcttctgccctttgccttcaaaggcttgtcactgtgcttccctggtttcttggcaggtgggccttttttaggaatgtgaaagttagtgtgcagcttattgggcgacatcatcttcatcatttcttctagatgttcttcaggagatttggaattctttgagttcttcactttgagtggcgagccactcaatgacttcttcaagtgtacgtgacaccataacttaggatttagtggtgaactaagagaagagttgtctgtcttggatttctttgagggcttcctgtctggggatccagtattcttcctcttagtagaagggttgagagtcatatactagaatttaagaataggagcaaaattaattttaaaatctaaaactaacttaagcaacatttaagcatcttaaaggccctcttccccagctattcaggtaaagctacatattcatatctcttcatagatactttgtccctgaaaaaacaaagacatgaatgttagctaatgtttttgtcatgtcaacacaaaattcccttgacatccagacttaatactagacatttttgctatgtaactagttctgtttatgtatattaatgattcttaaatatttaaacaaaatctgtgaacccctccagcagaaatagtagacaaaaactatgcatacaatttcagagaatccatccatggaccccagattaaggatatctgatctacaaaatggcaatatctgaaaagtttaaaaagcactgttcttgaaacaagactgaattttcatcctttcactgttggttcctattcagggcattttatgcttttaagtagaaatgatactgtttaaagtacttttgtcttaactctgaggtacattttcttatagaagcatcagtgagtgtaagaacaacatgaacactgctcatagataaagacacctcctgacctgggcctcaaactcccctttgtcctcacccaacacttttaagaactcattctggccaggcgcagtggctcacccctgcaatcccagaactttgggaggccgaggcaggcagatcacttgaggtcaggagttggagaccagcctggccaacatggtgaaaccccgtctctactaaaaatgcaaaaattagccaggcatggtggcacatgcctgtcaccccagctactcgggaggctgaggctcgaaattgcttgaacccgggaggaggagggtgcagtgagccaggatcacaccactgcactccagcctggaggacagagcaagacccccgtctcaaaaaaaaaaaaaaaaaaagaactcattcccacaactaatttcacaccatcctctctttgaacataccctcttatgttccaaatccactccctccagtcccacaactctacaatccttcaatctcaccagaaccttaaatccattaattctattacattttcaccatcctaacccccatgtcttgctttacccagattaaattttagtcaatcatgataattaatctcacataaacctatagttcccttgtctctcttattctattgtatctacttggaaaaaccataaccctgattaactcactctatttactcctgccctgcatatgttcagctgaaacacggctaaaataaaagataaataaaagtgggtggtctcagctgggtgtggaggctcacacctgtaatcccagcactttcggaggccaaggcgggctgatcacaaggtcaggagatcgagaccatcctggctaacacggtgaaacccagtctctactaaaaatcaaaaaaattagccaggcatggtggcgggtgcctgtagtcccagctacttgggagactgaggcgtgaacccgcaaggtggagcttgcagtgagccgagatcacgccactgcactccagcttgggcgatggagcaagactctgcctcaaaaaaaaaaaaaaaaagtgagtggtctcactttaaattcattgccaggcacctcaaacgggtcctccatatcacctagcaaacacagtatgttcctttagtccactcatgttcccactctcctgatacacatctcatctcctcatacctcccatgcctcatctccatcatatacaatcagttaacaggttacagtccggtccatttgtcatgataccactgcttctctttttaaatgtgtattgaaaaaaagaaaaaccaaactctttgagtggaatgctttaaaaaagataattacaaagaaaaatgcctggtagctaaaatgcaaactaattgaaataaccaagtcaagtaatccaaaatacagcccatttcagaagaaaactgttgctttatgtgattagggaaaagactagatcaactctagaatacttgatttttattaccaaaatcagctaagtacatcaatggcactcacagatatgaacatccagtttttcaacagaagggactaaccagaaaagagcaacatgtaaagaagaagtctaaagacaagtaggttaggctagtttgagatgagactacaggcaagaaaacagctaaggattactgaataacgaaattatgagccccttaaaaaagggtacagggaaatggctaaggtgagataaatcccagggatcacacagtaaaacacctatgctcttgttaggagaaaagcaaataggtttagtaaaattaaataagctgtactataaagccatttaaatttttattttttatttttgagatggagtctcgctctgtctcccagtccggagtgcagtagcgcaatcctggctcactgcaacctccacctcccaggctcaagcgactctcctgcctcagcctcccaagtatctgtgattacaggtgtgcgccaccatacctggctaacttttgtatttttagtacagacagggtttcactatgttggccagcctggtctctaactcaaacaggtgatctgcccacctccgcctcccaaagtgctgggattacaggcatgagccacccagccagaccccaattaagatttaaacattaggggctgggcgtggtggttcacgcctgtaatcccagcactctgggaggccgaggcaggcggatcatgaggtcaggagattgagaccacagtgaaaccccatctctagtaaaaatacaaaaaattttagccaggtgcggtggcgggcgcctgtagtcccagctactcgggaggctgaggcaggagaatggcctgaacctgggaggtggagctagcagcgagccgagatggcgccactgcactccagcctggggaacagagcgagactccatctcaaaaaaaaaaaaaaaaagatttaaacattaaagatacaatgagagaaacgagcccacagaaccatggctacacgcagaggaaaaaaatatggcctacactgagtaggatatacttaacaaatccctcttttggctaagctatctaacttcaaaggccaactggcctttgaagagttccaggcaactgcaggttattgttcctctgccctttttgttgcctgattaaaactgtaatgtgttgccgggcggggtggctcacgcctgtaatcccagcactttggaaggctgaggcgggcagatcacgaggtcaagagatcgagaccatcctggctaacacagtgaaacaccatctctactaaaaatacaaaaaaaattagcctggcgcggtggcgggcgcctgtagtcccagttactcgggaagctgaggcaggagaatggcgtgaacccgggaggcggagctcgcagtgagccgagatcccgccactgcactctggcctgggagaaagagcgagactctgtctcaaaaaaacaaacaaacaaacaaaaagaaactggaatgtgttgttccccaatctccaataaccatccttagaatgggctgacaaagaggctttatagctttacaacatataaaccctatccatgactccgggattactttccctagatgcagaatttcctcattctagtttcccagaactgtatttcaaaatgctaggaagaataagccaagataacttatttaagactccaatctcttcatgcacagtaattactatcagtactccaaagagaatatggcagagaccatccaaattgcagagcaagacccattactaccctggcaggaaataagaacaaatgtgtgcccccaaaaagttaacaaccttcttcagtcagccttggaaaatcttcagagtacacacatacaggcggacattttttctaatgctcagaacaacagattatatatttaaagtcatcctaaaatgaaatttatcgctaaaaaggagactaagtttcatttttagcattttaaataggtatgttttaatagggtctgttacaataactgggacacttctttatttactgattatagttctattttaaaagaaaaatcactcacattttacatgaggttctttaaacttcttccacttagaagcatagtagtatgaagaaatgatacaagaaaatggtgggatggcttagccatgagggtctagcaacccatttttattcgtaaggtgtgtttttgtgccaagccacaccatgtttttgtttgtttttttcttaaaaatgaaagaaatgaactcacccaaccccctcccaataggccggctccccacgtgagcagtccttcagtaactggatcatctcagcatggggcatgctgggcagtcacagccaaatgggagccggcatggctggactcagggggatctgaaaaagtataaaaccacttatgtgctaacagtgctccctatcccccactcagcacagttaatctaccagactagcagatggggagggagaagaaaggacacctggattaccagcagtataatttttgccaaaggcccttcctaattgctaaacagaaaaaaatatttatgactgtctcggcaacatggaaggttgaaagaaaaagagagcgtccacaattttacatttgttcctgtcacttgaaactcaccacaaccacaaatatctgtctgcaactcctgtttcttgattaaaaaaaggataaaaattaaagaaattacttgtagcagctcattcagatgctgcacacaacttaataataagcaatataatctaggcagcaaaaccctgaattagcaaaccttggcaatccatattgattcttatctcactgttctcattcacccagggcaacatgttagaactctgaggacaacactcaaatagtgggcttttctcaatttccacatgcctttattagcaagtttgcaaaatttgttactataaaatatatttaaagtgttctcaaaataatataacttacttttcattttttttcttctagcaaccattccttcaacaatataatttaccttttaaagtacttctgttctaacccctaactcacaaacttttttttttcctccacccaaaacagggtctcactctgtctgtcacacaggctggagtgcagtggcatgatcacagctcactgcaaccttgacctcctgggctcaagggatcaccctgcctccatctccaaagtagcttggactagaggcacacgccaccacacccagttaattttttgtgtatgtagaaacagggtctcgccatgttacccaggctggtctcaaactcatgggctcaagcaatcctcccacctcagcccctcaaactgctgaaattacaagcaagagccactacgcccagccatacacaacaaacaaactttaagagcgagactttaaagaaaaatcaggccgggtgtggtggctcatgcctgtaatcccagcactttgggaggccgaggctggtggatcacaaggtccagggattgagaccatcctggccaacatggtgaaaccccatgtctaccaaaaatagaaaaattagccaggcatggtggtgggtgcctgtagtcccagctactcgggaggctgaggcaggagaatcgctggagcccaggaggcagaggttacagtgagcaaagactgcaccactgcactccagcctggcgacagagcgagactctgtcaaaggaaggaagggagggacggagggaggaagatagatagatagatagatagacagacagacagacagacagacagatatagatagatagatcagccaggcatgatagctcacacctgtaatcccaacacttcaggggtcgaggcggggaaggattgcttgagcccaggagtttgagaccagtctaggtaacatggcgagaccctgtctcttcaacaaattaaaaataaaaattagctgggcttcatggtgcacacctgtggtctcggctactcaggaggctaaggtaggcggattgcttaagcccagaggtcaagactgcagtgagctatgatcacaccgctgcacctccagcctgggcagagcaagagcctgtctcaaaaaataaaaaaataaataaaatatgtaatactatgagtaatggacaaaattatgtcactgccttcttaaatgatgcactaagaatacatcaattcttaatgtccaaatattcataacctgaatctaatcatgaagaaataaaccaaaatcaaagagcattctacaaaataaccgggttctattatttcaaaacgtcaaggttttgaaagacaaagaaaagctgagggactgtcccagattagaagagaccaaagagacaagtaaatgtgaacatgtgacacatggtagcacaatggatcctattaaagcaaaacaaaattgtttttttggttaaaagattactgaagaactgggaaaatgtgagtaaaaactatagattagataatagagttatttcaatgttaacttcctgattttgacaactgtactgtagttacgttggaaaatatccttgatttttttgttttgttttgtagagatggaatctctccatgttgcccaagaaggtcctgaactcctggactcaagtgatcctcccacctcagcctcccaaagtgtagaattacacaggtgtgagctagcaaatatcaatgtttttaagaaattcatattccagtattctgtaaaagggcatcctgtctggaaaattacttggctcaggaaaaaataattcgtgtgtatatagacagcagattaggccagatgcagtggctcacgcctgtaatcccaacactttgggaggctgaggcaggaggatcacttgagaccaggagctcaagaccagcatgggcaagagtgagactccatctttacaaaaaataaaaaacacaaaaatcagttgggcatggtggtgagcaccggtaatcctagctagtcagaagcatgaggtgggaggactgcttgagccagaagttccaggttacagtgagctatgatcattccactgctctctaacctgggagacagcataaggcctacctcagaaaaaaaaaaaaaaaaagagagagagaatgataaacaaatatgataaatgttaacatctgaggaaatctaattaaagagtacacagaaatttggtagtgttttgtcaattctcctgtataaaattatttaataaaatattaaaatgtgttaagaacaaggctaaattcatgcaggattccaaatgccttaaagtattattttcttcttacatctctaatccaaaggcttccctactaggatttatcagtctaaaataagagctcaaacatgatggagactaacaaaatagggctgcaatgtattacaagaggaaaatgagctagagatttcatcttagatgacagttatcacccaattgccttgtaaatcattcctccaagtcattgggcctacaaaaaattacgctgcccctaaagcccaaatgtcagtggcatttttctccaacaaatggaacttcaagaaatgaatagccagttacctattatatgcaacatactatgctaaacgttacaagatataaaataagcaaggtagttcttattctcaagtaatttatattctacaaagattttagaaaaccacaaacacaccctcatcatcatattaggtactcaggtaacaatccaaaattcctgtatctttacataattttcctctctcccacgtaagccctcactatgggtcctttggtaaaactattttatttatttatttatttgagacagagtctcactttgttgcccaggctggagtgcagtggcgtgatctcggctcactacaagctcagcctcccaggttcatgccattctcctgcctcagcctcccgagtagctgggactacaggtgcccgccaccacgcccggctaattttttgtatttttagtagagacggggtttcaccatgtcagccaggatggtctcgatctcctgacctcgtgatccgcccaactcggcctcccaaagtgctaggattacaggcgtgagccactgcgcctggcctgctaaaactattgctcagaactcactctctttacacctggtctcactctacagtaaatgtactcagagcctgacagaacattacattctacaaaaaccaaagagtatacagagagagaaaacatcccatgcctttggatggatgggtcctatgtgatcaactttaatcctcaacagattattttaaatttcttctagaaaaagaaagaaaacaaagcaatgttttaggttctacttatcatctgtgttactatgttttgccctggctgagaagccaaagtcctaattttataaataggaaaaacacagcttatatacagaaaacaatcagtgacatgtcagatagtattaggaaataagaaattattgtttaaggtagggaaaacaaataataaacctgagtatatgcctttaactttgtagaccagtattttacatgagtcttaagttttctgagtaaaatcactgccatcttccagcactttaagcaagcttccatttcctagtcttaacctaaattatagccaaatttcataacattagtaagttaagcccccactagaaattctgggagaagcttatttcttcagaaattgcctttcaggttttaagttcctggagttctagtctctctctcctacaaaaattgtggatcagctgggcgtggtggtacgtgcctgtagtccccagctactagtgagacacagggaggaggatcacttgagcccagaaatttcaggctgcagtgaactgtgattgtcccactgcactccagcctgggtaacagagcaagaccctgtctctaaagtaagaaataagtgtggatcagcttttatgtcttaggaaactcaaaaaatattttacccataaaaagagtctttcacattattcacatacttgaatcactaaactaaaatacataaaacagagctgtaagattagaaaagaggaaaatattaaggactcaagtaatccaagaattagtctaaaacccatttagagatggtttcatggagttctcatatagcgaagataggaatctcatgtgaagaccacagaaagctgaatcatggttccaaactctgtggcaacaaaatgacagtgaactcaaaatttctcctcaacaaacaaaaacaaacatctgagaaaaaaattatagttccatggaaaatttagtcctgatctagaaaaagccaattactttctaaatttttccttttaagcaaataataataatttaaagagcataacagaagacaccacttatcttgctggtctagaataagaaaatctgctaagtgctaaaaccatgactggaggtctttactaatgttttggagaaataaaattacttttcaatatgcttttgtcaccataatcaacttaagataattgaacaaatttagttgttatgacttcagatgtctttatattttcataattaaatgaaatgggaaaaaaagaaatcctggaaatgtgacctagttttaatggatcaagagcccttttctggttctacgctggcccagagaccaagatgaaaattatcagccagtatgctgcgttacatttaccaatgaaagaagcattaagtactttcaaaacctacattaaaaaaccactttaacaggtaaagcttgaaatggaaaagaaaatcagaaatcctaggccagtgtcttaagtcttgtcatcactttctgttggttctgattagactaggcctcagataccccatctgtaaaatgaaatatatatatgtaccatataacttcataaaaatatttggaaaatcaaaagtgaggattttaaaaattactccttctcggccaggcatggtggctcacatctgtaatcccagcactttgggaggccgaggcaggcggatcacttgaggtcaggagctcaagactagcctggccaacacggcaaaaccccatctctactaaaaatagaaaaattagccaggtgtggtggcacatgcctgtaatcccagctactcaggaggctgagaagaaggagaaggaggttgcagtgagccgagatcgcactactgcactccagcctgggtgacagagcgagactccaactcaaaaaaaaaaaaaaaacaaaaaaaacttactcttcaagaggaaaatactaggttttccactaatctatcacacacactgctcctcattccaggttcttttcaaggctgccactgtatgtgatcatcttgtccgacatgcaaaatcagttttcattcttggtaactggttaacaaaatactttttatatttataccatacctcattccaaaaagggtctgaggcacaaaagcacatgtatatagacttttaaaattatgctagcataataaaaaataaattgaactggggaagatattaaatgtggcctctcccctaccaacctcacataacaacctgtatgtaacagatatacctgaaaaatttttaattcattatctgatgttagagttcaaaacctgctataaatataaatatactggagccatcagagaaataatgatgctttatcctgctgtccaaaaattaacagtgaccttaccttgtatggatcaagtaaaaagtcactgaacttgctgggcagagagtatttcttcaccaattcatcttctacgacccaaggtgcattttcaccagtaccagctcgtaatgcattatgccgtataaagtatcgaactatctccttatttggtgggcgctctgtacgaatcaagctgtctgctggcacgttactgatgatctaggttaaaaagaaacaaataactcaccactggggtaaaaagtaattacccaaatgagaacaagcaatatacgttctctccagaaaaatcaaaattccatctatatcaacagggctacaaattagaaagaaaaatatataggccagggatggtttcttacacttgtaatctcatcaactcaggaggccaaggtataaagattgtttgaggccaggagttacagatcgacctgggcaatataacaagaccctctgtgtacaaaaatcaaaatacgccaatagtcctagctatttgggaggctgaagcaggggaattacttgaacccaggagttcgaagctatagtgagctatggtcacaccaatgcactctagcctgggcaacagagtgagaccctatctgagagacagaaaacggagaataattttcagagacagaatgtcaatttaaaaatatccttaggcaatatgtcaatatgtatcaaagttttctaaaaatatgtataccctttcagcaattcctctcgttaagaatttatcttaggaagtaaatggacaaagttgtcatcaaatgcttgtaatagcaaaaaagtgaggaatgggttgagagttattacctaaaggtacaccaataagggatttgttaaatgaaactatgtacatataatggacactgcagtcctatgaaaaaactttctcaatccagaaaaattcatcagaatcatctagggtactattaaaatgcagatgtttgggcctcaccacacacttaatgaatcttatgactctctggcagtagaggttaggaatcaacatatctaatcacctcccctggtgactatcacacacattaaaatctgagaacactgttttggaagaaaatttaatgacattacagatgtttagcacacaataaatgaaaaaattaagttataaaataatataaacagaatagttctacttttaaaagtcacttaatagcaggaaacagagaaggaaggaatacaaaaaaattttttttaaaaagtcacttaggagctacctaccattcactaaatctatattcaccaattatctctgagcatgacatcagatactatctctttcttatttgcattttctttcttcctgtaaccaatacttatatttgtgaacaaaatacttatactcatcaatatgaatacaagggatacttagggaagtggttaaaactaagcatttttttttttttttgagatggagtttcactcttgttgcccaggctggagagcaatggcgcaatctctgctcactgcaacctccgcctccctggttcaagctattctcctgcctcagcctccctagtagctgggattacaggcatgtgccaccacgcccggctaattttgtatttttagtagagatggggtttctccatgttggtcaggctggtctcgaactcccgagctcaggtgatccacctgcctcggcctcccaaagtgctgggattacaggcatgagccaccgtgcctggcctaaaactaggcatgtcttaatcagctaccttgctgaatgagaagaaactctgtgaaaaattgtatttaacaatatccaatattcaaatataaaaaaatcctggccaggtgcagtggctcatgcctgtaatcccagtactttgggaagccgaggcaggcggatcacaaggtcaggagttcaagaccagcctggccaacatagtgaaatcccgtatctactaaaaatacaaaacttagccgggcacggtggcgggcacctgtaatcccagctacttgtgaggctgaggcaggagaatcgcttgaatccgagaggcagaggctgtagtgagccaagaccgtgccattgtactcccgcctgagcgacagaacaagactccgtctcaaaaaagacaaaaaaacaaaacaacaacctaggccgggcgtggtggatcacgcttgtaatcccagcactttgggaggccaaggggtggtagaccacctgaggtcaggagttcgagatcagcctgaccaacgtggtgaaactctgtctctacaaaaaacacaaaattagtcaggcatggtgatgcatgcctgtaatcctagctacttgggaggctgaggctggagaatcacttgaacccaggaggcagaggatgcagtgagccgagattgcgccattgcactccagcctgggcaacaagagcaaaactccatctcaaaaaaagaaaagaaaagaaaaaaaaaatcctaacaacccagccaaggcttctgatcacgaaccataacaccaacagtcagaatggaatcggacttgtcagcattctgaggcaggaacaaaacaatgtaaataaagaagcaaaagatttgggttacaatccttcccattttcatttactgaatcaagaattttgacagttattaaacttctcaggtcttagctgtttcttctgtaaaatggttatacctgaagacaaatgtgcattgccttccacacccagtctcctaatccacctttctaagattctgcacatacaggtggtgtaggaatacctgaaaagtaacattccatatttcttagaatcttagttccaatcagcaaaacgcttttttttttttttttttttttgagacggagtctcgctctatgttgcccaggctggagtgcaggggcgcaatctcaactcactgcaacctccgcctcccaggttcaagcgagtctcctgcctcagcctcctgagtagctgggattataggcgtgcgccaccacacctggcaaatttttttttgttttgttttttgagaaggaatcttgctctatcgcccaggctggagtgcagtggcgtgatctccactcactgcaagctccgcctcccaggttcatgccattctcctgcctcagcctcctgagtagctgggactacatgcgcccgccaccacgcccggctaattttttgtatttttagtagagatgtggtttcaccatgttagccgggatggtctcgatctcctgacctcatgatccgcccacctcggcctcccaaagtactgggattacaggcgtgagccaccacgcccggcctgactgctctacttttaactgggaagagtgatttccttggaaagtccataactgctgggaacagattcttaattttcaaactgaatttcaagctcaaatgtaaattacttacactctactaattcctataagaaagaggaaaagcatggtatcttctaggaaagaaaatataatttacattaacttgaagtcattaattactgtaactacaaaaccactcagaatctgctgtacattcatttacatttttcttcagcacattttctccaacaaaagcaaccctatgatattttcttaaagaacatctatcacatgtaaaaagtaaagtgtcaactaaccttatcttcattttgtagtttcacatcatatttgtgaggcagaaattttggaggagcccatttcctttctcctttttttaatgaagtaggaagttttcgtggcgatctacgtgctctgtcatctagtcaaatcatagaaaattagtgaaaaacgtaattattttaatccttttcattcattcattaacaagtcttaactgaacgtctgctcttcactaggcactgggtgatgcagtacaaaaatgaatcataatgtccttaacttcaaggagctaaagtctatgaggagagtcagcaagtaaataactacaatgtactataaataactacaatgtagtaaacagtgtaatagaagttggtaaagaaaaacactatgagaggccgggcgtggtggctcacgcctgcaatcccagcactttgggaggctgagggaggcggatcacctgaggtcgggagttcgagaccagcctgaccaacatggagaaactccatctctactaaaaatacaaaattagccgggcttggtggtgcatccctataatcccagctactcgggaggctgaggtaggagaatcacttgaacccgggaggcagaggttgcagtgagccaagatcacgccattgcactccagcctgggcaacagagcaagactccgtctcaaaaaaagaaaagaaaagaaaaatactatgagaatacagagaaggaatacctaacttagtctggaaggtaggtagaaagatgagtaagaatatgacttgggccaggtgtggtagttcacgcctgtaatcccagcactttgggaggccaaggcaggcagatcccctgagtccaggagttcgagaccagcctgggcaacatggtgaaaccctgtctctataaaaaatacaaaaaattagccaggtgtggtggcacatgcctgtagtcacagcaacttgggcggctagggtaggatggcttgagcctgggaggtcagggctgcagtgagccctgatcttgcgactgcactccacactaagagacagagtgaaaccctgtctccaaaaaaaaaaaaaaaaagagagagagagagaatacgatatgacctgttcagagattgcagattgcaagcaataaggtgtggttaaatatgatgtatactacagtgaaaaaaattcaaaaaggtaagccagggccatattagaaagggccttgtataccatttaaagagattagaatttgtcttgctagcactagagaaccaatgacagactgtggctgtaactaactacggtgcattttggaaagatcaatataaaatggggcccatcacagtggctcgtgcctgtaatcccagcactttgaggagccaaggcagaaggatcacttgagctcaagaattcgagaccagcctggccagcatggtgaaaccctgtctctacaaaaaatagaaaaaattagctgggcatggtggcacgtgcctgtaatcccagctactcgggaggctgaggcagaagaattgcttgaacccgggaggtggaggttgcagtgagccgagatcatgccactgcactccagcctgggcaacagagcgagactctgtctcaaaaagaagacgaacataaaatggaaagttgatactgaagataaggaaattggaagatacaatgctaaacatctgaattaggctgggcacacaggctcacacaggtaatcccagaactctgggaggctgaggtggggagactgcttgagcccaggagtttaaatcaagccttagccacatggtgagaccctgtctctaaacaaacaaacaaaaaaaattagaaaggtgttgtgatgcacacgtgtggtcccagctactcaggaggctgaggcaggaggatcacttgagcctgggaggttgaggctgcaatgagctatgatcacaccactgcacaccagcctagacaacagagcaagaccctgtctcaaaaataaacaaacatctgaactaatgtaactgtaatacagaaggaaagagagtcaaaattcttccagttcgtgaccaactagacgtgagaatgttaaaggtattttaacttttctgccttagacactaggtggatggacggtgagccaagtaaaagaatgagagaacaattcttgtttacctgccttgggatacaagaagagtgaagtcaattcagctttacacatgttgaatctaaactgcataaaggaggggccaggcgtggtgactcacgcctgtaattccagcactttgggaggccaaggtgggcagatcacctgaggtccagagttcgagaccagcctggccagcatggtgaaaccccgtctctactaaaaatacaaaattagctggttgtggtagcgtgctcccatagtcccagttactggggaggctgaagcaggagaatcacttgaacccatgaggcgaaggttgcagtgagccaagatcgtgccactgcgctccagcctgggtgacagagcgagactccgtctcaaaaataaataaataaataaataaattgcatataggacaggcaagtaaagatcaagtctacagttaaaagtctgacccaggcttggaaatcaccaggctacaaacagttaagaattcaaactgtgccatgaatagcatataacattacactatgcaaactgaaaaacagaaggcaaagaatagaatcctatggaaaaagtcaaaggaatggcagggaaggaaggaagtaaagaaaccgaatagctggagcactaggagacagtggtatcaagctaagagatatgagtgaccaacagtattaaatgtaacagatacagcactattcacaatagcaaagacacagaatcaacttaaatgccaacaatggacacaagaaagaaaatgtggtacacatacaccatggaatactatgcagccataaaaaagaatgagatcatgtcctttgcagcgacatgaatgaagctggaggctattatccttgcaaactaacacaggaacagaaaaccaaatactgcatgttctcacttgtaagtgggagctaaatgatgagaacacatggacacatagaggggaacaacacacactcaggccttttaaagaaaaacaactaatgggtactaggcttaacacttgggtgatgaaataattaatctatgcaaccaagccctatgacacaagtttacctatgcaacaaccctgcacttctacccttgaacttaaacgttaaaaaataaataaatattaataaatataacagaaaagtccaacacaggccaagaagaaatctctgcttttgacaattaagaggacacttgtaaacttaataggaactatttcaggaatatagaggcagaagtaagaccacaataaaactgatgttcggaaagcagagagaatattcctaaccaaaacacttctcaacctcaaggaattgcaagtaatgcccttattacaaaacttcagtatcaaaaagaagagggaaactggaaaatacagacgttagcattcacaatacaggagaaaacaaactgaagtatcaacaacttgggatggaccaactacaatgacactctcagaagtttgcttcgaactacattaagaaagtacctcaaaaaccatctgcacagatccaaaacatctagacacacaaaatagaatgggagacagacaacatcacattctaatgcaaagtttgtaccagttaaatagtaagctaacatttgatcctctaatactcatgcggagggagaccaatacacaccaaacacttggtgcacctacatttttggagacaacaataatcaagtccagtcaaattctttattaatgaaggcctcagaggctgaacggtcttcccagtgagccaaatctcaattgttcaaatttaaaaacattattgttagagtctccaggtccctaggacatcatagtttcaggattttacctgctcccgtgtgagagggacttagattacagattatggagagaaaaaagtgcaactgacccttgaacagcatgggggttagggctctgacctctcctcctctcgcagtcaaaaacctgtgtatacagccaggcacagtgcgtcatacctgtaattcagcatgaggccgaggccacaaggaggtccaggctgcactaagctgtcatcacaacactccactccagcctgggggcaacagagtaagaccctgtttcaaaaaaaagaggtcaaggcaggaggatcgcttgaactcacgagtacaagaccagcctgaacaacatcgtgagaactgacctctacaaaaaaaaaaaaaaaaaacctacaaaaattagctgggtgtggtggtgcatgcctacggtcccagctacttgggaagctgaggtggcaggatcgcttcggccaggaatgtcgaggctgcagtgagccatgatcgtaccactgcactccagcctgggtgacagagcaagaccttatctatgaaaagccaaaaaaggacactaggacaattagcactttactagagagatgaactagcatcacataaaatgactgaggtcacttcaacagcaacaggaggtcattaggaaatgattacagtagtatagtacgtactacagttcattttattgttattatttaatactgaatcttcatatttttcttgactgagaatggtgccaggtatggtctgtgtaagttttgataaattttaactttttataatagatttctgtatatattttatggtagcaaatgatagactagtatctacatgtattttatgcatttatgacatacctaactctttgttctttttttacaatatttctaggttactcagttcgtctctgagtttcttcaaactgtcacaagcctccaaagaattttccaatacattcattgaaaaaatattgagagatgggttaagtgccataaaaaaaagaaaaagaaaaattccattcatatgtggacctgtacagttcaaacctatgttgttcaagggtgagctgtacctaaaaccatcacattggcttataatgtgaagatcagggttagaatttgctcttcctaccttgatcaccccccaatacataaatacatatttccacttcaagacgaaaggaaagcagactttccttgccatcttgagtagctagcaatgtgcacacagcttttgtgttttgtttttttttttttgagatggagttttgtttttgtggccctgctcttgtggcacagactagagtgcaatggtgcgatctcagttcactgcaaactccacctcctgggttcaagcgattctcctgcctcagcttcccgagtagctgggattataggcacccaccaccacaagccgctaatttttgtatttttagtagagacagggtttcaccatgttgaccaggctggtctcgaactcttgacctcagatgatccaccctcctcagcctcccaaagtgctgggattacaggcatgagccacggcacccagccctgcatagagctttctaagcaactagaggaaacgacttcccaatggtcttaattatttagggatattcaagtgtttcatgttgtggacattttagttgttctatgaatcataaatgaacaaaatcatgtctacataaaaaatcacacatttagttgctagagaaccctaaaagatgtgttcataataaaataaacaggatctcataaaacactaaggaaagctaatatcaaacatactaatactctctctccttccttcatcctctttcacaactgtctccttcttctgatggtcctgagcaatctgactggagttctctttgtcacttgatggagaatcacaggcaccatcagatttcttctcagtggcctcttcatccactttctccaaaggatgaatcttcacaatcttcaccttgagcattttctccttcccaacctataaaggaggtagtagagaaaatcagagataataaacacccagaaacctgaagatgtttagaacatatcatccaatatacatgcctcctcaactaacaaaaggtgattgaaacagtaaagtatccaagtacaatgaagtgttttcaactttttttctcagacttctaggttgaaatatgacagcctaaaaaaatgaaataaatgatcacaatctaggttcatgattcatgtaaaatgccaatatacaaggccaaagggcaatcactgtaccagcctaaaatatgtgaatacagttcaagaatttacatttttgtatgtatttacttattattattttttttttgagacacagtctctctctgtcacccaggctgaagtgcagtggtatgatctcggctcactgcaacctccgcttcctgggttcaagccattctaacctgcctcagcctccggagtagctgggactataggcacgcaccatcgtgccaggctaatttttgtatttttagtagagacgaggtttcaccatgtttgccaggctgatctcaaactcctgacctcaactgatctgcttgtctcagcctcccaaagggctgggattacaggcgtgagccacggtgcctggcctacattttaaaaaaaagaaatcaactgtatatggatatacaaatgttccagaaccatttgttgaaataacacctttctctacttaattacctttccacctctatcaaaaatcaactgtgtagggccaggattacaggcatgagccaccatgcccggccagacccaggaatttgaggctagcctgggcaatatagggagaccccatctttacaaaataaaataaaattagccaagcatgatggcgtgttcccatagtcttaactacggaggaggctgaggcaggaagatcgcttgagcccaggtttttgaggctgcagtaagctatgacagtgccaccacactccggcctaggtgacagggtgagaccctatcttggggcattagagggctgcgaaccactgctatgtcctcttgacaaactgactcatttttttcattataaaatgacttgctacttctttatccctggttatattctttaatctgaaatctatcctctgatacttacatagccccttcagatttcttttgacttatgttaacatggcatgtatttttccattctttcacttttattctatgtgtttctctcttatacacagcaataccatttggtcttgctttttctgcccaaaatgagtatttctactgttctgttattgttttaaagaaatgagatttttgttatgttgccgagtctggccttgaacttctgggctcaagcaattctctcgcctcagcctcctaagtagctgggactacaggcacacaccacacctggtcaatgtctaccctttaattgaaatgtttagattacttatgtttaatataattatagatatatttaaggtttatttgcttttctattcagcctcaacaaaactaaaaactgctcttcaaaaaatactgttaagaaaacaaaaacactggccaggcatggtggctcatggctgtagtcccagcactttgggaggccaaggtgggtggactgcttgagcccaggagttcaagaccagcctgggtaacatggtgaaacctcatctctacaaaaaacacaaaaaaatttgccaggcgaggatgtggtgcatgccagtgattccagctactagggaggctgaggtaaggggatcacttgagcctgggacgttgaagaagaagggagttatgattgtgcaccgcactcaagcttgggcaacacagcgagaccttatctcacaaaataaaaataaaaataaaaaaactctacaaagcttttccaatgctcattaagagttcaaaccaagccgggcacagtggctcatgcctgtaatcccagcactttgggaggctgaagtgggtgggtcacctgaagtcaggagtttgagaccagcctgtccaacatggtgaaacttcgtctctactaaaaatacaaaaagtagctgggcatggtggcgggcacctgtaatcccagctattcaggcagctgaggcaggagaatcagttgaacccgggaggtggaagttgcagtgagccgagatcgcgccattgcactccagcctgggcaacaagcaaaactctgtttataaaaaaaaaaaaaaaacagagttcaaaccatttttgcaaagcaacccttatgataaatccaaaaccaaaaacaacagagttcaaggccgggcgcagtggctcacacctgtaatcccagcgctttgggaggcccaggcaggcggatcacctgaggtcgggagttcgagaccagcctgaccaacatggagaagccccgtctctactaaaaatacaaaattagctgggtgtggtggcgcatgcctgtaatcccagctgctcgggaggctgagacaggagaatcgcttgaacctgggatgcggaggttgcggtgagccaagatcacgccattgcactccagcctgggtaacaagaatgaaactccgcctcaaaacaaaacaaaacaaaacaaaaacaaaaacaacagatttcaaaccatgacctaacctttgacaacctgtacaagatctagcccttggctacctgatactaccattcccaccatcctccctccttctgtagtccaaccacactgatttttctctgttcttccagtacaatggttttcccagtacagtacaggggtaattatgtcatacctcttttcctttctttccccgagacatatggcaatgtctgattttcacagctgagagggtgctactggcatctagtggatagaggccaggtatgctgctgaataccctacaatgcacaggacagcacccactagaatcatctgtcctaaagtttgtaatgccaacgttgagaaaccccgttcctgaccatcaagttcccttctgtctaaaggccttcacacaccctgttctctctccctgaaatactcaatgcccccttctcccatggatatatcctactcaacctacaggcttcaccttaaatgttgcctcctcagaggagctttactggatcaacaccaattctggttctaagctagattcccctgattataaactttaataaatactctgtgcttttctttcatagttcttatcaagaatttttttttttttttttttttgagacggaatctcactctgtcacctaggctggagtgcagtggtgcaatcttggctcactacaacctccacctcctgggttcaagcaattctcctgtctcagccttccaagtagctgggactacaggcacgcgccaccatgcctggctaatttttgtatttttagtagagacagggtttcactatgttggccaggctggtcttgaactcctgacctcgtgatctgcctgcctcggcctcccaaagtgctgggattacaggtgtgagccaccgcacctggcctcatcaccaatgctaaacacacagaaacaactgtggattttggtcactactgtttttccagcacccaaaacatgctatctacatagccggtcatcaataaatatctgggataaacccctctatattgggacaatgtttgtggcacgcttccaatgtccatcatatctacttttttttttatcacacttagagtgcaaaacatttttataaataatgaacacctgtgtacccaccatacaggttaaaatacttaacattaatagtggccagacccagtggctcacacctgcaatcccaacactttgggaggccaaagcaggaggactgcttgagctcaggagttcaagaacagccttggcaacttggtgaaaccccatctctacaaaaaatacaaaaattagccagtgcctttggactgtaggatgaggaaaaaaaaaaaaaatacaattagccaggcattatagctacagtcccagctacttgggagattgaggtgggaggatggcttgagcctgggaagtggaggttgcagtaagccaaggttgtgcctctgcactccagcctaggcgacagagccagaccctgtctcaaaaaagaaaagaatattaacagtacctcagaatctcccagtaagcctacgcacaggtggaaacaactctctcctctcctcctgacagtgataacaaacattctgagttagttttgcctgctttgagccttctataaatgtaatcatactgtattcttctgcgacttctttcaagttcacattttttctgctatagagtattgtgtggcttaacaatttgtttatccattcaactactgatggctacctgggttatctcctcattggactactatgaacaattctattaatatacttacacagatttcctgcggcaaaactgagggtaaatactcaagcaaaaatccttagtcaaagggtatgtataataaccaattgtattcagcaatgccgagtgctttccaaaatatatgtgctatttacactataagcaattccacattcctgtcaaaacttggcagcaagtttttttctttattaatctgatgtgtatacattatctcactatggtttcgattagatttcctgcattattgatgagtttaaacatattttcatgtttatggacatacatacttccctagtatctcttccctttcctcttttttttgtttttgagacagggtcttgctatgttgcccaggctggagtacagtggtgcgatcatagctcactgcagccttgaactcctgagttcaagcgatcctcttgcctgtcttccaagtagctgggactacagaaatgcaccaccatgcacggccaatttttattattttttgtagaaacagggtctccctatgttgcccaggctggtctcaaactcctagcttcaagccaacctcccgcctcagcctcccaaagtactgggattacaggcaggagccattgggttcagcccatctttcctcaaacatttcttctttcaccttgcagatgtgtgcaaaatattttcgttttgccatgtcaattccatttccatccttctctacctggctctatgcttaaataggctgacctttacagcctccaccaagactccccttgccctctagattctggtgagttcagttcatagggagcatgagcagaaaaccaggagatggaagtaaagcatccttggggtgtttatttccaaatgcctccctaggaggatggttacagttacagttttctctcactaccatagtactcttcaacaacagcagctactcttttctagttcctgtacccactccctccctctgcttccttggggtttagaaatgataaagtcttccccaactgctgataggtatgaggcactcaacctttccttgttaagttttccttaaccctgatcagactgctgtctgctgtcaacagcccctttattaaactcaattcaattacatttgagtatgccatctgtttcctgccaggacactgactgatataaagtatgtgattagaacccactaatggtcagccacagtgattcatgcctgtaatctcagcattttgccaggccaaggtgggaggatcatgcaagtccaggagtctgaaaccagcctggacaacatggcaagaccctgtttctctataaaaaataaaaaacttagctaggcggccaggcgtggtggctcacatctgtaatcccagcactctgggaggccgaggcgggtggatcacgaggtcaggagatcgagaccatcctggctaatacggtgaaaccccgtccctactaaaaatacaaaaaaattagcgaggcatggtggcaggtgcctgtagtcccagctacttgggaggctgaggcaggagaatggtatgaacccgggaggcggagcttgcaacgagccgagatcgcgccaccggactccagcctgggcgacagagcgagactctgtctcaaaagaaaaaaaaacttagctaggcatggttttgagtgtctacagtcccagctactcgggaggctgaggtgggaggactgcttgagcctgggaggctgaggctgcagtgagctatgatcacaccactgcactccagtctggaagacacagcaagaccctgtctcaataaaaaacaaacaaagaaacaaaaaccccactagtactgccagacatgacaaataaaaaagaactagctaggagatagaaaggagtcagagtaaattattgaaacaaagaaagaacaagaactttgaaaccagagagacaggtgtgaatcttggccccatcaagtactggctattgtagcacaaactgctgctgagctagctaccaagctattccctccctcttctctcttgccagcctgtctcttttgagacttaaatacaaaggaagatactctctttctcagcccccgctgcagctctgggtggttatgtaagccaaggtctagccaataacatgtaaagataaagggtggagctttctattttatgcttcaagaaagatttttccagatatgcttctggaaagattttcttagcctgctttgataagtattccctcactctgaatacagtcacattttttcacaactcaggggacagcaaagctaaggaccagaactcaacacactgagaagaacagaacagaaagacagagaaagtctaggtcttgacaatagtattcagcctctataccaaacttggaactatctaagacttactacatgagataatcacgtctgtcttgtttaagccagtactactaaagtgttgtacctcatgtaacagcatcactaccaccctgcagactgttagaactgaaaaatgttaggtctatcctagaccttctgaactctcaaggaatgggctgaagaacagttcaagcatgatggagaagcaaattaaacatttgtcctgagagggaaaaaaaaaaaacagttcaagcaattctcccacttcggcctcccgagtagctgggactacaggcatgcaccaccatacctggctaatttttgtattttttggagagatagggtatcgccatgttggccaggctggtctcaaactcctgacctcaggtgatctgcccaccttggtctcccaaagtgctggtactacaggcctgagccaccatgcccagccaagaacgcattttcagtagcttaagtatcacaccaaagtttgagaactacggactattattacaatttcgctacataacggctgaaagcactcataactagtatgtatcaacctcaacatgtcatttaaatgtacaaggctacctaccacttcaagatttccgtgcaaattctgcaagacattatgtaaagcaattagcccagtgtcaagtacatacagatagatatttaacaactgtttagttttttctcctgaatcttactttcagctgttacaagattatacagggattgctttagtgttcggtatcacttttgtaatagttatcctttagctattttgactggataattaaaaaacaaataaggccgggcgcactggctcatgcctgtaatcccagcactctgggaggccgagacaggtggatcacaaggtctggagattgagaccatcctggctaacacagtgaaaccccgtctctattaaaaatacaaaaaaattagccgggggtggtggtgggcacctgtagtcccagctactcgggaggctgaggcaggagaatggcgtgaacccaggaggcgaatcttgcagtgagctgagatcatgccactgcactccagcctaggcaacagagcgagactccatcttaaaaaaaaaaaaaaatttaagtagaaaaagtccaactctcattacagcgaggacttggattaaacatgtctgaggccgggcgcagtgactcacgcctgtaatcccaactctgggaggctgaagtaggcatatcacccgaggtcgagagttcaagaccagcctgaccaacatggagagaacccgtctctaccaaaaataaaaaattagcagggcatggtggcaggcgcctgtagtcccagctactcgggaggctgaggcaggagaatcacttgaaccagggaggcggaggttgcagtgagccgagatcacgccattgcactccagcctaggcgacaagagcgagactccacctcaaagaaaaaaaaaaaaaaagtcttaaagtctttttttttttttttgagatggagtcttgctctgtcccccaggctggagtgcagtggcacgatctcggctcactgcaacctccgcctcccagattcacgccattctcctgcctcagcctcccgagtagctgggactacaggcgcccgccaccacggccggctaattttttatatttttagtagagatggggtttcaccgtgttagccaggatggtctcgatctcctgaactcgtgatccacctgcctcagcctcccagagtgctgggattacaggtgtgagctaccacgcccggcctgcaagtcttttcaacatagtaacaattatgtgctcactttgtcagcacatataatgaaactggaataatatggagaagattagcatggtcattgcatgggttgggcacagtggttcatgcctgtaatcccagcactttggaaggccaagagaatagtttaggagttagagaccagctggggcaacatggtgaaatcccatctctacaaaacatacaaaaaattagtcaggcatggtggcgcacacctgtggtcccagctacatggagggtgacatgagaggatcgcttgagcccaggaggtagaggttgcaatgagccaagatcgcgaaactgcactattccagcatggatgacagactaagaccctgtctccgaaaaataaaaaaagaaaagaaaaatcaaaaccaaaaagacaaaataacagaattatcaaaaaaggatgaaaaagacaaaggacagaccagtacaacaaagtgttgcaattattacaatactaaaacattctcagtgatgaatgtggttctaaaatttggttcaaggccaagagtgatggcacatgcctgcagtcccagctactcagaaggctgaggtgggcggacggcttaagccagggagtccaaggctacatacagtgagctatgactgcaccactgcactctagactctgtgacagaacaaaaccctgtctctaaacaaataaataaaaataaaatttagtccttataataattgatgggaggccaaggtgggtggatcatctgaagtcaggagtttgagaccagcctggccaaaatggtgaaaccctgtctctaccaaaaatacaaaaaactagccgggcgtggtggtgcacacctgtagtcccagctactcagaaggctgaggtgggagaatcacttgaacacgggagaatgaggttgcagtgagccaagattgcgcactgcactccagccttggcgacagagtgagactccatctcaaaaaaacaaaaccaagaaaacacacaagtattaacgtaaagtattaatacttaacattaaatataatactaaatataacacagttttacacacatagaaatgtgttctgtaacctacgatgacagctctaattctgatggtaagtcaaatcagaaacgaacaggcactcacctcgaagtcacactcttctcccacagcatatttggtcatgatctccaaccaagcagtatctactaacttctctaaggaggctgtgttatggtgaaccatttccagaacaagcttctcataccaggcaggaaactcctccttcaaactaaataaatgtaattagttatcaagaaaacacagaaacacctacccagagatttaattcaagtcaattcaaacatttctttctttcttttccaaacatttcaaacatttatcgctctgtcaccaaggctggagtgcagtggcacaatcatagctcactagcctccacctcctgggctcgaacaatcctcctacctctcaggtagctgggaccacaggcatgcaccactgcacctaacctcttttaagacttaacttttgggcagggcgcggtggctcacgcctgtattcccagcactttgggaggccgaggcgggtggatcacgaggtcaggagatcaagaccatcctggctaacacgatgaaaccccatctctactaaaaatataaaaaattagccggccatggtggctggtgcctatcgtcccagctacttgggaggctgaggcaggagaatggcatgaacccaggaagcggagcttacagtgagccgagatcgcaccactgcactccagcctgggcgacagagcgagattccatctcaaaaaaaaaaaaaaagacttaacttttggctgggcgtggtggctcacacctgtaatcctagcactttgggaggccaaggcgggcagatcacctgaggtcaggagttcaaggccagcctggccaacatggcgaaaccctgtctctactcaaaatacaagaattagccgggcgtggtggcacatgcctgtaatcccagctactcgggaggctgaggcaggagaatcacttgaacacgggaagcgaaggttgcagtgagccaagatcacaccattgcactccagcctgggcaacagagagagactcagtctcaaaaaacaaacaaacaaaaaaaaacacttaacattttacgagttttaggttcacagcaaaacaacactgctttagcaaatatacgtaaagcactggggaatacaaagattaaaaaaaaacatgcagtttgctggacacagtgggtcccagcactttgaaaggcacaggtgggaggattgcttgagcccaggagtttgagaccagcctggccaacagagtgagaacctgcctctataaaaaactaaaataattagctgggtgaggtggcatgcacctatagttccagctacgtaagaggctgaggcaagaggctggcttgatcccaggagctatgtgcataccactgcactccaccctgggcaacagagcgaaactgtgcctcttaaaaaaaaggaaaccaggaagcgttaacatgttggaaacgtgacttgaacaccagagctgttgcaaaaggacagcaatgatttaacacttttcacttattaaactagcaaaaaaaaaaaaaaatttaattatcatacccggttgggtgcagtggttcacgcctgtaatcccagcactttgggaggccgaaatgagcaggtcgcttgaggtcaggagttcgagaccagcctggctaacatggtgaaaccccatctctactaaaaacacaaaaattagccaggcgtggtggtgagcgcctgtagacccagctactcaggaggctgaggcacgagaatcacttgaacccaggagatagaggttacagtgggccgaaatcgtgcccctgcattccagcctgggcaacagagtgagactccatctcaaaaataaaaataagaataagggccaggcgcggtagctcacgcctgtaatcccagcactttgggaggccaaggcgggaggatcacgaggtcaggagattgagaccatcctggctaacatagtgaaaccccatctctactaaaactacaaaaaattatccgggcttggtggcgagcacctgtagtcccagctacttgggaggctgaggcaggagaatcacttgaacccgggaggcggagcttgcagtgagccgagatcgtgccactgcactccagcctgggcgagagcgagattccgtctcaaaaaaagaaaaagcaaaaaagaataaaccacattaccagagtacttacaaggtcaaagtatggagcaggaacactcaaaggcctggtaaatacctaaacaagtgcacctataactaaataaatattccatattgctactgcaaaatgccattaggcaaaggaacccagaaacccatacagtacactaatgtaatatagtctaatttgtgccccataaacttaaatacacatactgctttagggttaatattccctcctttcctaacaatgtgaagatggtggcaaagagcaatacttccattacttacagctcagcaacttcctgttcttcctcccaggcttccttgtgtgttagctgactgcttccagtactcttgcacgtccaaatgcgctcactgtacctttccaagcgggcttcatactctctgttggcagtagttcaggaaaacaatatgcaagcaacagagacgacaaacccatacccataagatacttatatacagaaaaaaatctagtctcctttttaaaatgtgtagcatgagaggataaaaatggaattggaggccgggcgcagtggttcacgcctgtaatcccagcactttgggaggccgaggcgggcggatcacgaggtcagatcgagaccagcctggctaacacggtgaaaccccgtgtctactaaaaatacaaaaaattagctgtgagtggttgtgggcgcctgtagtcccagctactcaggaggctgaggcaggagaatggcgtgaacccgggaggcggagcttgcagtgagccaagatcacgccactgcactcaagcctgggagacagtgcggctccgtctcaaaaactaaaaaaaataaaaaaaaatgaaaaaaatggaatcagggcccaaagcaagatgactaagactgaagtataatgagaatggattgtcatgggctgggcacctgcatgggatttacagactgggatgatcacgtctctaatctcagcattttgagaggccacggcaggacaatcacttgagaccaggagttcgagaccagcctgggcaacatgatgagacctcatctctacaaaaaataaaaataaaaaataataaaaatggtttttcgtgttttacaaaaaaaattaatattttagtacaaatgtgatttcctcaattcaccaaagtttcattacacaagacttacgctgtaccaaaaactcataagaaaaagtaaaggtacattaaaacacaagtcataaaaaataacaatgtaaggtaagcaaaattttcagaaaactcagacaagtttaagagtcagtccaccactgccaggcgtggtggctcacgcctgtaatcccagaactttgggagtccgaggcaggcagatcacctgaagtcagatgttcgagaccagcctgagcaacatggagataccccatctctactaaaaatcaaaaaaaaaaaaaaaattagccgggcttggtggcacatgcctgtaatcccagctactcaggaggctgaggcaggagaatcacttgaacctgggaggccgttgcagtgagccgagatggcaccactgcactacagcctgggtgataagagcgaaactccacctcaaaaaaaaaaaaaaaaaaaaaaaaaaaaaggaatcagtctacagtaaaatgaggtgactaggccacagtctcacaggcagtttggaataaccttgagcatacattaatgatccatttacccacagccctccagtccaccttggaaacatgttacttcttagggtttacaagcttgtccaacctttgtccaacctgcggcccaggacggctttgaacacagcccaacacaagttcataaagtttcttaaaacattatgagttttttgtgtgattttttttttttttagctgatcaactgtttttagtgttagtgtattttatgtgtggcccgagacaattcttcttccaatatggccaaaagattggctaccctggtttaaaaaataaatttcataaaatacttagaagtattccggaaagtacttttgatataatatttatccagtctctatgatgtctccaataatactgagattcagaagatcatttactagccgtttagacagtcttcgtgagggagacgagggaaagaaaaacatcaagttggtagtgtaaatatggcaactttccacacaaaaccaactggaattcaccatcagccagccacttccaaattcaaacggcaagtaactaatttacttttaagcacagcaacagatgctatgtaagaaaatcaactgacataagtagaaagttagtgaacaatacctgtatattccaagtgacacattttatagtggttgaaataaaagtatttaaacagtttcctctacaatactatctaacaaataaacaaatattctaatttttgttttttggaaacaaggctggcctgtatctcctgagctcaagagatcctcctaccttagcctcctgaatagctgggattacagacttacactgcagcatctagctcatttttatctatttatgtatttatttttgacacagggtctcactctgtcacccaggctgaagtgcagtggtgggatcatggctcactgtagccttgacctcctggggtcaagcaatcctgggcctcagcctcctgagtagctaggactacaggtgcacaccaccatgcccacctacattttttatctttgcagagtcagggtctcaccacattgcccaggttggtcttgaactcctgggctcaaacagtcctcctgcctcaatctcccaaagttatgggattacaggtgtgagccaccacgcccagccgcatgtttaataaatatagatgcttggttttccaaggttatgatcagcaaaaacgcaaacaagaacaaacccacaggtaatccaaaatagtaactttatgcaatagtataagcacctttgctcattgtggatctttccccagatctgctaaaactgagtaataaatccattttccttacaggggtggtgctaatatctaagtgattaaacaaaatatatagaatgtttgagtaaaaacctgagtcagacttccatatacagatatgtaaatccaatcaccgaaaaattttcaaacttatacccagagaagagcaacggaacggcttccagaggacattatcccaagacggatttgtcttatttttgtctactgaactaggggagtggaagggatgggtagtaaaataaggacagaggaggaatcagtaagtggacttatttaagctttcaaaaagcttgataacattctaacacattatttagccatatttaagaagctccaacaggcatggtagcttacacatgcaatcccagcatttgggaggacaaagtggggggatcttgagcccaggggttcaaaaccagcctgaacatagcgactttacaaaaaactattaaaagaaaaaaaaaaactcactgtgtcatcagagagaatgtaagagaaatacattaacaaatatgtcttaaagagagaacagtaagtttttattattacaggttgaggatcccttatccaaaatgcttagaaccgggagtattttggattttgaatttctttcagattttggagtatttgcattatacttactagttcagcatcccaaatccaaatatccaaaatgctccaatgagctcttcctttgacgatcatgttggggctcaaaaactttcagattttggagcatttctgatttatggatttgggatgttcaacctagagttgttactttaaaaagcaggggccagaaaaaaacaaaacaaaaaaaagtaggggccggccaggcacagtggctcatgcctataatcctggcattttgggaggccaaggcaggtggatcacctgaggtcaggagttcgagaccagcgtggccaacatggtgaaacccccgtctctactaaaaatacaaaaaattagccaggcgtggtggcgtgcggctgtaatcccagctactcgggaggctgatgcaggagaactgcttgaaccttggagacggaggtcgcagtgagctgagatcatgccattgcactgtagcctgggcaacaagagtgaaactcagtctcaaaaaaaaaaaaaaaaactgcatagtggcagtttatgaggcccaggcacgaacatcgctcaagcccaggagttcaagagcagcctgggcaacatagcaaaaccccatctctattaaaaaaaaattagttgaatgtggtggcacaggcctgtagttccagctactcagggatctgaggtgggaggatcacttgagcccaggaggtggaggttgcagtgagctgtgatggagagcaacagagggagactgtctaaaaaaagaagattagcccgggcatggtgggtcacgcctgtaatcccagcactttgggaggctgaagtgggtggatcacgaggttaggagttcaagaccagcctggccaagatggtgaaaccctgtctctactaaaaaactagccacgcatggtggcgggcgcctgtaatcccagctactcgggaggctgaggcagagaactgcttgaatgaggaaggcggaggttgcagtgagccaagatcacaccgctgtactccaccctggatgacagagtgagaatctgtctcaaaaaaaaacaaaaaacctccaaactcacacaatcacgacgaactcatcacaccttctctgccaagaatatacagtcctctattattcgtctaaattctaatcatcctttagatctcaaaaataacttttcccagaaaacattcattgaaccttcaaatatgatagattgtattagtttctaactattcacctcctttccataagaggatttttacatctccacccactgccatgtggcttgtctacaaggtccctgaagaggaatgtacctcccctcttcattaacatcaagcttgaccccgtgactggtttcgaccaatagatgtgagcagatgtaatatatgtcacttcccggaagaggcttaaagtcatgatgtcttctagctctttctttgtgccactagcaaactagcaagcaagacatgtcacacacagggtctgcccctccagccttgttccttttttttttttttttttttttttgaagcagggtcttgctctgtcacccaagctggagtgcaatagcaccatctcgcttcactgcaacctttgcctcctggactcaagtgatcctcccacctcagcctcccaagtaattgggaccacaggcaaacgccagcatgtccagctaatttttctattttttttgtagagacagggtttcattcactgttgtccaggctgacctcaaattcctgggctcaagcaattcacctgcctcagcctcccaaagtgctggcatgaacaaccataccaggtgtcagccttggtcttaaaatgagaaaaatgtggaagggtgtggtggctcacgcctgtaatcccagcactttgggaggcagaggggaacggatcacttgaggccaggtgttcgagactagcctggccaacacggtgaaaccccgtctctacttaaaaagtgcaaaaaaggagccaggtgtggtgcacgtgcctgtagtcccagctactcgggaggctgaggcaggagaatcacttgaacccaggaggtggaggttgcagtgagccgagatggcaccactgtactccagcctgggctacagagcgagactccactcaaaagcaaagagaaaaatgtggttttcttttttattatttatttatgtttttggagatggtggtctcactacattgccttgtctggtctcaagcttctgggtttaaggaatcctccagctttggcctcctgagtagctgggactacaggcgcacaccaccacatccagctgttttcttttttcccaccatttttttctttttttaatatgagagtactacaaaattttaaattacatatggcttacattatacttttgttggacagcactgaaacctgaagtatacatctcagaaaatgtcctctgacagtattaacttaaaattaattgcctagtcaaactgattataaaatctggggccaggcgcggtggctcacgtctgtaatcccagcactgtgggaggccgagggggtggatcactgaggtcaggaattcgagaccagcctagccaacatggtgaaactactaaaaatacaaaaaatagccaggcatggtggcaggcgcctgtaatcccagctacttgggaggctgaggcaggagaattgctcgaagttgggaggcggaggttgcagtgagccaagattgcaccattgcactccagcctgggcgacagactgtgactgtctcaaaaaaaaaaaaaaaaaaaaaaaaaaacaactgtaaaagaatttcctacaacccctaacaacggctattttaagtttgtgtaactgttctggtaactgttctggtaattatattaagagaaagcaaggctgggcatggtggctcacgcctgtaatcccagcactttgggaggctgaggccggtggatcaacttgaggtcaggagttcgagaccagcctggccaacgtggtaaaaccccatctctactaaaaatacaaaaaattagccaggcgtggtggtgggtgcctgtaatcccagttgcttgggagtctgaggcaggagaattgcttgaacccaggaggcggaggttgtagtgaaccaagatcgcaccactgcactccagtctgggcgacacagcaataacccagctcaaaaacaaaaaaaaaagagagaaagtaaggccacacacagtggctcatacctgtaattccagcactttgggaggctgaagcgggaggatcacttgaggctagaaatccaagaccagccggggcaactttgcaagacctcgtctcgtctctacaaaacatacaaaaattaggcgtggtggtgtgcacctatggttatagctactcagcaggctgagtgggaagaatcacttgagcctgggaagttggaggctgcagtaagccatgatcacacatcactgcactccagcctgggcaacagagtgagaccctgtctcaataaataaatgaataagaaaaaaagggaaagcaagaaaaaaaatgaaaatgaaaaggcaaaaaggcccatcagaaggatattgagtcagctgcctctaaatcctatttcagattttaggttaccaaaataagtcactcactctcaaataacctctcagagcaaatgccaattgaggtttttatgttccagcaactgctgcacatataattgcagacaaaatgtcaaagcaattctccaaaggttgtgtaagctataaaagataagatattttcgaatcctagactatctcattatgtatctactttgccatcagctacctccttatcacaatatgctgctgctttgttctcttcagtcttgcagggattgtttctttcaattaagtacttgatatcctgaaaagatgtggcccagataagtatagagtcaaacaagcataactgtaactaacctaagtgctctaagtcagaagatggcaaagagtgagccaactcaagatttgctttttactcgatattctctcttactcgattttttctcttaaagactccagactgtctttaagttaaaaacaagtctaatatggcataacgtattactttaaagaatgtataaaaatcaggctgggcgcagtggctcacgtctgtaatcccagaactatgggaggccgaggcgggcggatcataaggtcaggagatcaagacaatcctggctaacacaatgaaaccccatctctactaaaaataccaaaaaaaaaaaaaaaaattagccaggcgtggtggcgggcgcctgtagtcccagctactcaggaggctgaggcaggaaaatggcgtgaacccgggaggcggagcttgcagtgagcctagatcgcgccactgcactccagcctgggcgacagagcgagactccgtctcaaaaaataaataaataaataaataaaaataaaaataaaaataaaaatcaacgtaagagctcagtattccaaatgtccagtaaaactctatcttacaactacaacttaactccatctatagctactcaactcttaacacatgctctaaggcagacgcagtagtgcgtgcctgtagtcccagctactctggaggctgaggcaggaggatctcttgagtccggttcaaggcttccctgtgctaccacctcgtctgtgaacagctgctgcactccagcctgggcaacacagcaagattccatctcttaaaacaaaacaaaaacatgctctagtcacacttgtgtagagccagattaacagtatgaataagcccctcattatcataccctcaataaattctcacataatgatgctacaaaggtcgtgaactagttatttctaagctttagaaactatgacagttgaagtaacacaacaaaaatactcatctacaacacgctgcttgtagctccaattcctgcctaaaacctatcttgacttaaatacagtcagtgtcacatcaagaactgattctgataaagttagtgttttccaagatctagtgtcctgcctgtgggaataccttaggaagtaatgtaccatacaaagctacagtacaatcaacataatcaccaatatttaacacctagtcattaaatgtgtgcattactcacaacttccactaagtttaatgaagattcacaatatactccaagaacataccaacatacagctttaagtcagtaaaatatcacacaaagttctgtgatacatgcaatcaaaaggtaggtattaaaagaaaattaaaatatcaagtcccattaaaaacataattgtaaatataagttgagaactgggaatactacttcaaaggcagctgttacctaaccacatatttgttctcctctatgaaaccactaatagcctaataaagaaatatgccaatctgccaaccatacagtacaattgtttaaaaaccatcctcaaagtgcttccacttgcagaaattcccgaaagagcaatttccccccaatatataatatgttttaagacttcttttgttaaaacagttttaaatgctgttatgggaaattaaaaaatgaagaatgtttattaaatacataccacttaaaatgtttccggtttcagttttaaattgttaccatcaaaactcttcatatatatatttcaatttcattcattcaataatatgaaaaagcctgcgttgccagtcctaaattaacttcctacagccattttttacatagctcagtacctgaaatatacttagaaattgtctcttctctatggcatgtttcttatactctgctagaaccagacctgagaaagtatcatctgaaagtgtgtgagcatccatcaacggctcaaaacattaatgacattggaaaagtatatgtcggattctcacaagttgctactccactgccgattcgaatgtattaaaaagtagggtactggccaggcgcggtggctcacgcctgttaatcccagtactttgggaggccgagatgggcggatcacctgaggtcaggagtttgagaccagcctggccaacatggtaaaaccccatctctactaaaaacacaaaaagttagccgggcgtggtggcacgcgcctgtaatcctagctactcaggaggctgaggcaggagaatcacttgaaccctggaggcggagatggcagtgagcccagatcgtgccactgcactgccacctgggttaacaagagggaaactccgtctcaaaaaaaaaaaaaaaaaaaagtggggtacttcggtataatgcagtatttggtagagctagtggaacttctccagaacattccaagtcttcacaggacaagaaaaaaaccagatcaccacccctccactttaaagtgccttaccttataccataatgacaaaaaagtgaggtaatatttaaattaattgaaagtgaaggagtaacattccaccttcttctgttgattgacttacagggatgaggtaggaagagcggtggattctactcctctttcatcatttgaccttcaacaagtcaacctccactctctgggccaactcagcaaaccaagcccgaggacccgaccacctccaagatccacttcagctccaagatgctacagctctatttctccaagagccttcctccagcatggactgattttccaggcccctttgtgtgtatactccccacaaagggacactcacaaattgcactccaacaagaatgagattatcctctaaagtactgcgttaaagtgaggatcagggagaaatgaaataactctgagagacacttcctcctatacagaagcaagcaagaaactgagaaatgaagtccttccgaacagaaggggctgagaaaactcataacacattagccttcactcttaaagctttcagtcaccaaagaaatgcttgattccgaaatcgtttttgttttttttacagataagcctcaaaaacgattcttctggcacccattaaaaaaaagcaaataaaagctgcacaacttttcactaaaagataatgcttatgcaagaaatcttagtcatgacgagaggatgcttcctttgtaaaacatccaatttcatgttcctaaaatacaacataaaaacttcacgtcttggtttttttgtttgtttaattttaacaaataccaatctccttctaaaccttcaaaatttcaaacctgtgtctgcccagggaaggcaggcatcagctcctccacaggcagtttccttccctccctttcctctaagcggggaatctcattcctagttttctgccccagggtcctgtcagttcatccccggcctaaagtcccctcgggagacgaaaaaaacgccaagtatccccgcagagatcggggtaagacgcagttgagtcttgcacacgccgcatcacgaggccgcgcgagtacaatttcaaaacttaagctgcaggtttcatttaaatttttaaaaaatttttgtaaaaattaaaggagaaaacctagctccccctccccacgcctcctcctccctctcgggtcctcaaggcctaaagccaacccggggaaggtaatggggatgggggatgcgctcctcgccggcgaggccccgggacaaagtgcggggccccgggggcggccgaagcgggcccttctccttccagggccggtgcgcgccccccgccggatcccctggaaggatcggcgggcgcaggctgagactcagcctccaggcccgcgagcggccggggcgcgctgacagctgccccgggccggggatgcgcggctgacctggtctcgcgagccccaggccctaccccggcccagcccggcccagcccggcccgcgcggctggaaaaggatactcccgggtgcggaaggcctcctgagtgtgcgggatggtgaagagcggctcctctccgggcaacggcttcaccagcgggaagggcttgcggcccaggagcggcgccatcgcggcggcggcggtggggactggcggctgctggggccggccccgcggcgcagcactaggccccgcggcccggagcgagcgccaggcgcccgggggtggggtgggggaagggaggggtgagagggcggcgcgaactccggctccctcaccgccggcgcggccgcgcgacagtcatggagcggaacgccacggcgcagagctcccgcgcacaccgccgcgcctcccagcagccccccgccgacctccgcttcgggtcccggcggccggcagtcacgactcctcctcagcagcaccggaggaaattattgaaaaatggcgggagattcccctcctcccccgggcccggccaacgcacacactaacttgctcccccgtggcgccggtggcgaatgctccaataggcggagagctggtcagcgctcacagcctattggctcggaggagctgccgctccgcgcctgggtcccgcccccctgcccctgtcgcgtagttgggttgcagcgcactagagggcagtctgaagaggtgaaaggtcacgttatgtaagcgcccgtgataggcgtgcgggcctccgacggcagagttaaaagtgggggacagcgggggatggagaggacgagaactcaaagaggtcaagccggagaagcccctcgcatatacagatactgcgccatctgtcaccgacggcgacaccgacatccgggcaccactgtccgtgtggtgcgccggagggggagggtgagcgcgcggccaggggctttgtctttcctcttgggcgcctcccccttcttaaaggcgccgtgctcggccacgcccggggatgcgcgggtggggctgggctgcagggaggggttggcgggaagtggccccgggagcttaccctaccaaaggttctgcggaaggacaacgtgggggccagctttgctcaccccagagttaacttctgggcgggagtgtggttgagatctgggtagaagtatactgcttgtttctaggggctggctggaaagtagaatatagaagcttctttggagaaatagattaaaagacgtacttagttttttggtttttggtttttgttttttttgagacggagtctcgctctgtcgcccaggctggagggcaatggcgcgatatcggctcaccgcaacctccgcctcccgggttcaagagattctcctgcctcagcctcccaagtagctggaattactggcgtgcaccaccacgcccggccaattttgtattattagtagagacggggcttctccatgttggtcaggctggtctcaaactcccgacttcaggtgatccgaccgcctaggcctcccaaaattatcattatttttttttttgagacggagtttcactcttgttgcccaggctggagtgcagtggtgcagtctcggctcactgcaacctctccctcccgggttcaagctattctcttgcctcggcctcccgagtagctgggactacaggtgcgcgccaccacacccggctattttttgtattttgtagagacggggtttcaccatgttggtcaggctggtctcggactcctgatctcaggtgatccacccgcctcggcctcccaaagtgttgggattacaggcgtgagccaccacgccctgccagagctgtgactctggctttttttttttttctcccatgatactcagcacctggctcggaacattgtaggtgctagtgaatactatttgaatgaattggatctaccttttattttttattttttttgtagagacagggtcttactttgttgcccagactggtctcgaactcttggcctcaagcaattgtcccgcctctgcctcccaaagtgctgagattaggcgtgacccactgtgcccagccaggatgtctctttaataggtacgtctgggccgggcgcagtggctcacccctgtaatcccagcactttgggaggccgaggcgggcggatcacggggtcaggagatggagaccatcctggctaacacggtgaaaccccgtctctactaaaaatacaaaaaattagccaggcgtggtggcgggtgcctgtagtcccagctactgggaagctgaggcagaatggcgtgaacccgggaggtggagcttggagtgagcggagatcgtgccactgcactccagcctgggcgacagagcgagactccgtctcagggaggcgggggggggggggaaataggtacgtttggtcgggcacgatggctcacgcctgtaatcccagcattttgggaggctgaggcgggcgcctcacctgagctcgggagttcgaaaccagcctgagcaccatggagaaaccctgtctctactaaaaatacaaaattagccgggcgtggtggcgcatgcctgtaatcccagctattcgagaggctgaggcaggagaatcgcttgaatccgagagggggtggttgcggtgagccgagtttgtgctattgcgctccagcctgggcaacaagagcaaaactccgtctcaaaaattataataataatcacagttctatacaaagtgcagaataagaaaatagcatcaactattttaatgctattaaatggggagcatttcagttgcttctccaagcagacaacacccacatccagaatttgtttggctttccagtacaatcaaaaacacactcattaagttatctccctattaaactgtctcccttagtttaaagaacttcactttaaagtttcccagcctgtaccttcccagctgtaccttcccagcctgtccttcaacggggctagactgcgaggtgtctctaaatgcagtctcctaatgtcagacctctatctccttttcttctcacctcaaggatctcctatccccactaggaggtctaggtcaaaagctacctctgtgaagtttcctctgatcacctagcagaaaagatctcggttccttttccttgaggcagtagacttttctcccaagaacagcaggagaagccttgccagagcacatagcgtttgagttaattgagaaaagaaaagagttctctagacagagaaggagggacgaacattatagacagaacagcagagtgaagcctggaagttcaagatcgtgtgcccaaaatgtgaggatttgaggcagaatatatcagatgagaatggtaaaggaagtgaccatcctgatatattctgtaatggctgaatcggagtgactacttagaagggaattacagggctaggcatggtggctcacacctgtaatctcagcactttgggaggctgaggagagaggatactttgcggccaagagtttgagacaagtctaggcaacatggcaaaaccccgtctctgctaaaaatacaaaaatcagccgggcgtggtggcgcatacctgtaatcccagctacttgggaggctgaggcaggagaattgcttgaacccgggaggcagaggttgcagtgagctgagatggtgcccagtctgggcgataaagcgaaattccatctcaaaaaaaaaaaaaaaaaagcaaaagaaaacaatttgatatttcagaacagcatctcactttgcacatgtgaactgggcaccataatcatttcagcgcttgggtccgctgtgggctagaatccattgctgggattggtgaagatgggatctgagatgggaaaatcggtaatgggcttggtttcagccatgtgaactccaggtaccctgaagagccatccagaacacagccggaaattctgagggaggaagtgggagctggaggtggggcttggtggtcacagtacagaaacttgagcttcaggaaccatatagagcttatgaagagaccccaaataaagaacagtgctcatctcggggaaatggatttatggtttttgcgttttgtctcattttgagacaagatcttgcactgtcgcccaggctggagtgagtgcagtgggggatcacagctcactgcaacctcgacctcctggactcaagatcctcagcctccagagtagctgggactacaggcacacaccaccatgtcctgctaagtattttcttttttgtagagacggtgacggggatggggtctcactgtgttgcccaggctggcctcaagcccctggcctcaaggtttcctccctcctcagcctgtcaaagtgctgggattacaggcataagccaccgcaccaggcctggaattacaattttttttcttttcttttttttcacccctcctttttcactggaattacaattgatgtgattttcttctttatatttttctatattttatgattatgtttttataatgactacattattagtttgtttttgagatagggtctcactctgttgcccaggctggagtgcagttgcacaatctcaactcactgcaacgtccacctcccaggctcaagtgatcctcccacctcagcctcccaaatagctgggaccacaggcacacaacaccatgcccagctctttttttgtgtttttggcagagacagggtctcaccatgttgcccaggatggtctcaaattcctgagctcaaatgatccacccacctaagcctcccaaactgccaggattacaagcgtgagccaccactcctggctctttttctttctttcttttttaaaatacattttaaaaactattttaggccgggcaggggtggatcatgcctgtaatcccagcactttgggaggccgaggcgggcaaatcacgaggtcaggagttggagaccagcccggccaatatggtgaaaccctgtctggctctactaaaaatataaaaatttagctgggtgtggtggtgtgtgcctgtagtcccagctactcgggagactgaggcaggagaatcgcttgaacccagaaggcggaggttgcaatgagccgagatcgcgccactgcactcctgcctgggtgacagaatgagactccatctaaaaaaaaaaaaatatatatatatatatatatatatattttaataaagacacgtctcactatatattgcctgggctattctcaaactcctgcctcctgggctcaaatgatcctctcactctggcctcccaaagtgctgtaattacagtcatgagccaccgcacctggccctggttttatttctcttaatggcttcgccttcctgtttagcccacaggctcagcctctgacctctctcttgagctccacagcctcaggggcaactagataacatccattctagcagcctaaaatcttgaactgtttccccttcctgtctttccacagcacctgcttcaggcctttattatttctgcccaaaattgctatgatactgacttgttgcttaaaaaaatgttttcagttgcattcaaattatgtattatcatggtaaaatgaaaacagttccaaaaagaaacatatatcagtgtgcagatggatggatttttaaaaaacataaaaacatagttccaaagaaaatcaaatactcctacaaaaagcagcccagccacactcctctaaccacttcctgctccccttgggcatccatttccaactccttaaacgtttcctctagtctttagctctatatttttaataattcatatactgctattttcagtttcagtttttttttccttttttttttttttttttttttgagacagggtctcactgtgtcacccaggctggagtgcagtggtgtgatcaaagctcactgcagcctcgaagtccctttctcaagcagtcctcccacctcagcctctagagtagctgggaccacaggcatgtgccacccagttgatttttgtatcttttttttttttttttttttgagaccaagtctcgctctgttgcccagactggagtgcagtggtgcaatcttggctcactgcaacctccacctcccgggctcaagcgattctcctgcctcagcatcccaagtagctgggattacaggctcctgccgccacccctggctaatttttgtatttttagtagagacagtattgcaccatgttggccaggctggtctcgaactcttgacctcaagtgatccacctgcctcggcctcccaaagtgctgggattacaggcatgagccaccgcacccagcctaatttttgtatcttttgtagagacagggtcttgctcgctgtgttgcccaggctggtcctgaactcctgagctcaaacaatccacccacctcggccttccaaagtgctgggattacaggcgtgagccaccgcgcctggcctagtttttcagttataaatattagctattgactttcttcagtggaagatgagaacttagccccacaaacaccacgcacatatgcaaacatattcccaaaagaattatattgcaattggctaaatcagcatgcagcgtataacttatgattatgcattattcagatgattcatgtggtaaactcattacatttcctttcttttgttgtctctggatgacttcagtctgtttttacttcgttttctctggacctatctctgctctgtccccagactgacagaactgtaactcttctctcaatatatgcaaacacatccggcaggcactgtccttcccatctgtctccctgcctcccctctctttcctctccatggtatccagcacaccgtggcactctaatgtttacagcttccaatggatggctccttaaagcaaacagaattaaaccaaactgtggcctaaccttcaaggccctccacaatccatccaccatcttggtacttctgccctcaaactccttatgctatcaaaacctaggtttatctaggttttttttttttttttttttttttttttgcgacggagtctcactgtattacccaggctggagtgcggtggcgcaatattgcctcactgcaaccttgcaacctctgccgcccaggttcaaccgattctcctgcctcagcctcccaagtagctgggattacaggtgcctgccaccacaccaagctacttttgttttttagtagagacggggtttcaccatcttggccaggctggtcttgaactcctgacctcgtgatccacccacctcagcctcccaaagtgctgggattacaggtgtgagccactgcacccagctggtttttttctttcttttttttgagatggagtttcgctcttgttgcccaggctggagtgccatggcgcgacctctgctcaccacgacctccgcctcctgggttcaagcaattctcctgcctcagcctccagagtagctgggattacaggcatgtgccactatgctcagctaattttgtatttttagtagacatggggttcctccatgttggttaggctggtctcgaactcccaacctcaggtgatccgcctgcctcggcctcccaaaatgctgggattacaggcgtgagccaccatgcccggccagtttttttgttttgttttgttttttgtttttctttttttttgagatggagtttccatattgttgccgaggctggagcgcaatggcccaatctcagctcaccgcaacctccgcctcccaggttcaagcaattctcctgcctcagcctcccaagtagctgggattaatggtgcctgccaccatgtctggctaattttttgtattttttttttagtagagacagggtttcacgatgttggccaggatggtctccaactcctgacctcaggcagtatgcccgccttggcctcccaaagtgctgggattacagttgtgagccactgcactggcctatctaggttttaaaatactacgccagccaggtatggtggctgttgcatgtaatcccagcaccttgggaggctgaagcaggaggattgcatgagcccagaagtttgataccagcctgggcaatatagtaacatcctgtctctacaaataatttttaaaatttacccaggcatggtgccatgtacctgtagccccagctactcaggaggctgaggtgggaagatcacttgagcctgggaggtcaaggctgcagtgagctgtgattgcccccctgccctctagcctggatgacagagtgggaccctgtctcaaaatataaaaaaattaaaaagattcccccctaaaaagatccagggctccttgaaaaagggctggggctggacaagttcggggccgggcacagtggctcacgcgtgtaatcccagcactttgggaggccaaggtgggtggatcacctgaggtcaggagttcaagaccagcctggtcaacatggtgaaaacccgtctctactaaaaatacaaaaattagctgggtgtggtggtgcatgcctgtaatcccagctacttgggaggctgaggtgggagaattgcttgaagccggtaggtggaggttgaagtgagccgagcctgggtggcaaagtgagactccgtctcaaaaaaaaaaaaaagtgagtctggaacatttcgtacctgacagtaaggcactgctgaaatcatgatgcagaaatgtcaaagggcacaggcgctaactggcccaatctggaacaatttggacatttattttattttattttattttatttatctatttagagacagagtctcaccgtgtcaccaaggctggagtgcagtggcatgatctcggttcactgcaacctccacctcctgggttcaagctattctcttgcctcagcctcccaagtagctgggattacgggcatgtgccaccacgcccgactaatttttgtattttttgtagagatggggttttgccatgttgtctaggctggtctcgaactcctgagctcaagcagtccacccacctcggtctcctaaagtgttgggattacaggcatgagacactgtgcatggccgttaaatttcttgggtgtgatttggtagtctagttgtgttagggaacgtctttgttcttgggagatagaagctcaagtatttaggggtaaaatgtcttagtccatttgtgcagctctacctaaatccctgagtctgggtaatgtacaaggaacacaaatttatgtggccacagttctggaaactgggtagtccaagatcaaggtgctggtttcattatctggtgagggctgctctctgcttccaacatggtgccttgatgttgcaatctccttgtggggaggaacctgtatcttcacatggcagaaggcagaagggctagagagccaaacactgctgaaaccttttataagggccttactcccattcatgatggagaagccccatggcctaatcacctcttaaaagccccaccttttggccgggcgcagtggctcacgcctgtaatctcagcactttgggaggctgaggcaggcggatcacgaggtcaggagatcaggaccatcctggctaacatggtgaaaccttgtccctactaaaaatatgaaaaattagccaggcatggtggcgggcgcctgtagtcccagctactccagaggctgaggcaagagaatggcgtgaacctgggaggcggagcttgcagtgagccaagatcgtgccactgcactccagcctgggcgacagaacgagacccgtctcaaaaaaaaaaaaaaaaaaaagccccacctcttaatacgatcacagtggcaacacctgaattttggggaggacacattcaaaccatagcagagtcataatgttgcaacctattttcaagtaattcagccaaaaagctgggggggggggggaatatctgtaggccgagcacaatggctcatgcctgtaatcccagcactttgggaggcagaggtgggaggattgcttgaacccaggagtttgagaccagcttgggcaaaatagtgagatctcatctctacaaagaaaaatttttttggcctgacgtggtggcgtacgcctgtaatcccagcactttgggaagccgaggcaggtgaatcacctaaggtcaggagttcgagaccaggctgaacaacatggcaaatccccatcttcactaaaaataccaaattagctaggcatggtggcgcatgcctgtaatcccagctacgggaggctgaggcaggagaatcacttgaacccgggagttggaggttgcagtgagccaagatttcaccatcatactccagcctggacaagagcgaaactccatctcaaaggaaaaaagaaaaaaaagatctcatatccaaatttctcaaggcccaactcaaacaccacctattttataaacttttttttttaagatgtctcactctgtcgtccaggctggagtgcagtggcatgatctcagctcactgcaacctccacatctcaggttcaagtgattctcctgcctcagcctctggagtagctgggactacaggtgcccaccatgcccggctaatttttgtgtttctagtagagatggggtttcgccatgtttgccaggctggtc

SEQ ID NO: 1223 - DNA, 41339 bp, Homo sapiens
ctgggaccacaggcacacaacaccatgcccagctctttttttgtgtttttggcagagacagggtctcaccatgttgcccaggatggtctcaaattcctgagctcaaatgatccacccacctaagcctcccaaactgccaggattacaagcgtgagccaccactcctggctctttttctttctttcttttttaaaatacattttaaaaactattttaggccgggcaggggtggatcatgcctgtaatcccagcactttgggaggccgaggcgggcaaatcacgaggtcaggagttggagaccagcccggccaatatggtgaaaccctgtctggctctactaaaaatataaaaatttagctgggtgtggtggtgtgtgcctgtagtcccagctactcgggagactgaggcaggagaatcgcttgaacccagaaggcggaggttgcaatgagccgagatcgcgccactgcactcctgcctgggtgacagaatgagactccatctaaaaaaaaaaaaatatatatatatatatatatatatattttaataaagacacgtctcactatatattgcctgggctattctcaaactcctgcctcctgggctcaaatgatcctctcactctggcctcccaaagtgctgtaattacagtcatgagccaccgcacctggccctggttttatttctcttaatggcttcgccttcctgtttagcccacaggctcagcctctgacctctctcttgagctccacagcctcaggggcaactagataacatccattctagcagcctaaaatcttgaactgtttccccttcctgtctttccacagcacctgcttcaggcctttattatttctgcccaaaattgctatgatactgacttgttgcttaaaaaaatgttttcagttgcattcaaattatgtattatcatggtaaaatgaaaacagttccaaaaagaaacatatatcagtgtgcagatggatggatttttaaaaaacataaaaacatagttccaaagaaaatcaaatactcctacaaaaagcagcccagccacactcctctaaccacttcctgctccccttgggcatccatttccaactccttaaacgtttcctctagtctttagctctatatttttaataattcatatactgctattttcagtttcagtttttttttccttttttttttttttttttttttgagacagggtctcactgtgtcacccaggctggagtgcagtggtgtgatcaaagctcactgcagcctcgaagtccctttctcaagcagtcctcccacctcagcctctagagtagctgggaccacaggcatgtgccacccagttgatttttgtatcttttttttttttttttttttgagaccaagtctcgctctgttgcccagactggagtgcagtggtgcaatcttggctcactgcaacctccacctcccgggctcaagcgattctcctgcctcagcatcccaagtagctgggattacaggctcctgccgccacccctggctaatttttgtatttttagtagagacagtattgcaccatgttggccaggctggtctcgaactcttgacctcaagtgatccacctgcctcggcctcccaaagtgctgggattacaggcatgagccaccgcacccagcctaatttttgtatcttttgtagagacagggtcttgctcgctgtgttgcccaggctggtcctgaactcctgagctcaaacaatccacccacctcggccttccaaagtgctgggattacaggcgtgagccaccgcgcctggcctagtttttcagttataaatattagctattgactttcttcagtggaagatgagaacttagccccacaaacaccacgcacatatgcaaacatattcccaaaagaattatattgcaattggctaaatcagcatgcagcgtataacttatgattatgcattattcagatgattcatgtggtaaactcattacatttcctttcttttgttgtctctggatgacttcagtctgtttttacttcgttttctctggacctatctctgctctgtccccagactgacagaactgtaactcttctctcaatatatgcaaacacatccggcaggcactgtccttcccatctgtctccctgcctcccctctctttcctctccatggtatccagcacaccgtggcactctaatgtttacagcttccaatggatggctccttaaagcaaacagaattaaaccaaactgtggcctaaccttcaaggccctccacaatccatccaccatcttggtacttctgccctcaaactccttatgctatcaaaacctaggtttatctaggttttttttttttttttttttttttttttgcgacggagtctcactgtattacccaggctggagtgcggtggcgcaatattgcctcactgcaaccttgcaacctctgccgcccaggttcaaccgattctcctgcctcagcctcccaagtagctgggattacaggtgcctgccaccacaccaagctacttttgttttttagtagagacggggtttcaccatcttggccaggctggtcttgaactcctgacctcgtgatccacccacctcagcctcccaaagtgctgggattacaggtgtgagccactgcacccagctggtttttttctttcttttttttgagatggagtttcgctcttgttgcccaggctggagtgccatggcgcgacctctgctcaccacgacctccgcctcctgggttcaagcaattctcctgcctcagcctccagagtagctgggattacaggcatgtgccactatgctcagctaattttgtatttttagtagacatggggttcctccatgttggttaggctggtctcgaactcccaacctcaggtgatccgcctgcctcggcctcccaaaatgctgggattacaggcgtgagccaccatgcccggccagtttttttgttttgttttgttttttgtttttctttttttttgagatggagtttccatattgttgccgaggctggagcgcaatggcccaatctcagctcaccgcaacctccgcctcccaggttcaagcaattctcctgcctcagcctcccaagtagctgggattaatggtgcctgccaccatgtctggctaattttttgtattttttttttagtagagacagggtttcacgatgttggccaggatggtctccaactcctgacctcaggcagtatgcccgccttggcctcccaaagtgctgggattacagttgtgagccactgcactggcctatctaggttttaaaatactacgccagccaggtatggtggctgttgcatgtaatcccagcaccttgggaggctgaagcaggaggattgcatgagcccagaagtttgataccagcctgggcaatatagtaacatcctgtctctacaaataatttttaaaatttacccaggcatggtgccatgtacctgtagccccagctactcaggaggctgaggtgggaagatcacttgagcctgggaggtcaaggctgcagtgagctgtgattgcccccctgccctctagcctggatgacagagtgggaccctgtctcaaaatataaaaaaattaaaaagattcccccctaaaaagatccagggctccttgaaaaagggctggggctggacaagttcggggccgggcacagtggctcacgcgtgtaatcccagcactttgggaggccaaggtgggtggatcacctgaggtcaggagttcaagaccagcctggtcaacatggtgaaaacccgtctctactaaaaatacaaaaattagctgggtgtggtggtgcatgcctgtaatcccagctacttgggaggctgaggtgggagaattgcttgaagccggtaggtggaggttgaagtgagccgagcctgggtggcaaagtgagactccgtctcaaaaaaaaaaaaaagtgagtctggaacatttcgtacctgacagtaaggcactgctgaaatcatgatgcagaaatgtcaaagggcacaggcgctaactggcccaatctggaacaatttggacatttattttattttattttattttatttatctatttagagacagagtctcaccgtgtcaccaaggctggagtgcagtggcatgatctcggttcactgcaacctccacctcctgggttcaagctattctcttgcctcagcctcccaagtagctgggattacgggcatgtgccaccacgcccgactaatttttgtattttttgtagagatggggttttgccatgttgtctaggctggtctcgaactcctgagctcaagcagtccacccacctcggtctcctaaagtgttgggattacaggcatgagacactgtgcatggccgttaaatttcttgggtgtgatttggtagtctagttgtgttagggaacgtctttgttcttgggagatagaagctcaagtatttaggggtaaaatgtcttagtccatttgtgcagctctacctaaatccctgagtctgggtaatgtacaaggaacacaaatttatgtggccacagttctggaaactgggtagtccaagatcaaggtgctggtttcattatctggtgagggctgctctctgcttccaacatggtgccttgatgttgcaatctccttgtggggaggaacctgtatcttcacatggcagaaggcagaagggctagagagccaaacactgctgaaaccttttataagggccttactcccattcatgatggagaagccccatggcctaatcacctcttaaaagccccaccttttggccgggcgcagtggctcacgcctgtaatctcagcactttgggaggctgaggcaggcggatcacgaggtcaggagatcaggaccatcctggctaacatggtgaaaccttgtccctactaaaaatatgaaaaattagccaggcatggtggcgggcgcctgtagtcccagctactccagaggctgaggcaagagaatggcgtgaacctgggaggcggagcttgcagtgagccaagatcgtgccactgcactccagcctgggcgacagaacgagacccgtctcaaaaaaaaaaaaaaaaaaaagccccacctcttaatacgatcacagtggcaacacctgaattttggggaggacacattcaaaccatagcagagtcataatgttgcaacctattttcaagtaattcagccaaaaagctgggggggggggggaatatctgtaggccgagcacaatggctcatgcctgtaatcccagcactttgggaggcagaggtgggaggattgcttgaacccaggagtttgagaccagcttgggcaaaatagtgagatctcatctctacaaagaaaaatttttttggcctgacgtggtggcgtacgcctgtaatcccagcactttgggaagccgaggcaggtgaatcacctaaggtcaggagttcgagaccaggctgaacaacatggcaaatccccatcttcactaaaaataccaaattagctaggcatggtggcgcatgcctgtaatcccagctacgggaggctgaggcaggagaatcacttgaacccgggagttggaggttgcagtgagccaagatttcaccatcatactccagcctggacaagagcgaaactccatctcaaaggaaaaaagaaaaaaaagatctcatatccaaatttctcaaggcccaactcaaacaccacctattttataaacttttttttttaagatgtctcactctgtcgtccaggctggagtgcagtggcatgatctcagctcactgcaacctccacatctcaggttcaagtgattctcctgcctcagcctctggagtagctgggactacaggtgcccaccatgcccggctaatttttgtgtttctagtagagatggggtttcgccatgtttgccaggctggtctcaaattcctcacctcaggtgatctgcctgccttgacctcccaaagtgttgggattacaggcgtgagccaccacgcccagctctataaactttctatgatctcaaagcctccaagattcttctccagaccctaatggtattccaccttcacgacccctcatggctcctacttctccaccttctctgctgcatcagaccataagctccttaaaggcagtgaccatgtgtttaccagttatactttacaaagaacctaccaagattatgtttgcaacaaatacagttgtccctcagtatccacaaattcaactggtagtggatcaaaaataccggattcaagagatgcagaacatggcctactgtgggacttgagcatctgcaggttttggtatccaccagggtcctggaaccaacccctccagataccaagggacaactgtatttgtaaaatatttttatttatttatttttttgagacatagtgttgctctgtcgcccaggccaggctggagtgcagtggcaagatctcggctcactgcaacctccacctccagggctcaagctgggattacaggtgtgtgccaccacacccagctgatttttgtatttttagtagatggggtttcaccatgttggccaggctggtctcgaactccaggcctcaagtgatccatctgcttcagtctcccaaagtgctgggattacagacatgagccaccacgcctggccaatatttttattttttaataagacaaggtctctttctgttgcccaggccggagcgcagtggtgcaatcatggctcactgcagccttgacctccagggctcaggcaatcctcctgcttcagcctccagagtacatgggtccagaggtgtgcaccaccacactcagctaactaaaaaaaaaaaaaaattatttgtagagatggagtctccctttgttgctgaggctggtcttaaactcctggactcaagcagtcctcctcctcagcctcccaaagtgttgggattacaggcatgagctactgcacccagcccattatactttcctttgtttaaacacattaaaacagttatgttggccaggcatgatggctcacggctgtaatcccagcactttgggaaatggaaaccgaggtgggtccagcctgggcaacatagtgagaccttgtctttacaaaaaaaaaaagggtcaagcgcagtggctcacgactgtaatcccagcactttgggaggctgaggtgggtggataacgagattgggagttcgagaacagcctggctaaggtggtgaaacgtcgtctgtactaaaaatacaaaaattagccaggcacagtggcaggcacctgttatcccggctactcaggaggccgaggcaggagaattgcttgaacctgggaggcggaggttgcagtgagccaagatcacgccactgcactctagcctgggtgacagagaacactctgtctcagaaaaaaaatacgtattttgtgtaccacatacaatcacattatctgtaaaattcatttgacaatttgattttatatgtctctttttttgagactccctctgtcgcccaggctagagtgcagtgtcatgatcacggctcacgacagccttgacctcctgggctcaagagatccgcccacctcagccgtcgagcaggggatgctacaggcatgcaccaacatgcccagctaatttttgtttttgttttagagatgaggtttcaccatgttgcccaggctggtctcgaacttctgggctcaagcgatcttcccaaagtgctgggattacaggcatgagccactgtacctggctgttacatttttaaaagattattacttatttttttagagacagagtttcaccctgtcgcccgggctggagtgtaatggcgcaatcgggctccctgcaacctccgcctcccaggttcaagagattcttgtacctcagcctcccaagtagctgggattacagacatgtgccagaacgcccggctaattttttgtatctttggtagagatgggggtttcaccacgctggtcaggctgatctcgaactcatgacctcgtgatccgcccgcctcagcctcccaaagtgctgggattacaggtgtgagccaccacgcccggcctacatttttgtatttgttaatgagacagggtcttgccatgttgcccaggctcgtcttaactcccaggctcaggcaatcttcctgccttagccttccaaagtgctgggattacaggccactgtgcccagccctatatatataaaaatatttatatatatatatatattttgagatggagtcttgctctgtcgcccaggctggagtgcagtggcgtgatctcagctcaccgcaagctccgcctcctgggttcacaccattctcttgcctcagcctcccgagtagctgggattacaggcgtgagccaccgtgcccagccccagccctatttatattttgtaagaaaagataaaacaggggccgggtgcggtggctcatgcctgtaatcacagcactttgggaggccgaggcgggcagatcatgaggtcaggagatcgagaccatcctggctaacacagtgaaaccccgtctctactaaaaatacaaaaaattagctgggcgtggtggcaggcgcctgtagtcccagctactcgggaggctgaggcaggagaatggtgtgaacccgggtggcggagcttgcggtgagccgagatcccgccactgccagcctgggtgacagagcgagactccgtctcaaaaaaaacaaaaacaaaacatagaacagtagaacttgtattatagtctcatccatgacacctggagcccctgtgagaaatgaggggaatcactccgggaaataaacagatctgtggctgccagggcccgaggggaggggaagaaatggtgaatgatgctaactggacatgaggtttccatttgggataataaaaaagttcggagctggactgtgaggactgcccagcactgtgaatgtactcagtactcagtaccactgaaatgcacacttcacaatggtgacaaaagtaactcttggccaggtgcagtggctcacacatgtaatcccagcactttgggagcctaaggggttcgaaaccagcctggccaacatggtgaaaccccacctctactaaaattacaaaaattagtcagacgtggtggtgcacgtctgtaatcccagctacttgggaggcagaggttgcagtgagttgagaacacaccactgtactccagcctgctgggtgacagagtgagactctgtctcaaaaaacaaacaaacaaaaaccttttatgttacgtgtattttaccacaaggggggaaaaaaagaactcatgaatccctccgaactacatggacctgtggaaaacacatccatgggctgcatttggtgtacacagggatggaatttggttttgttttttgagatggagtctcgctccgtcacccaggctggagcgcagtggcgcagtcttggctcactgcaacctccacctcccaggttcgagcaatgctcgtctcagcctcccaagtagctgggactaaaggcgcctgccaccatgcctggctaatttttgtatttttagtagagatggggtctcattttgctggtcaggctggtcttgaactcctgagctcagatgatccacccacctcagcctcccaaagtgctaagattacaggcgggagccactgcgcctggcctggtttttatgttttaatttaaaaatattgtttagatagagatagggtcttgctgtgttgcccaggctggtctcaaactcctagcctcaagtgatcctcctgcctcggcctcccaaagtgctgggataagaagtatgagccaccacgcccagcgagaagcataatttgaactacgtgacagcttcaaagggaggctagaaatcactgtcatgaagtccacactgtgggagtgaaaggatgggcaggcccagcccacagtgaccccacaagcactcagccaccacccccaccccggcccgcaaccttcaagaaggaagcactcagataccaacaggacatatttcaaatagtttaattttaaaaatattctattcagtgctaaaatatgtcttcactcactgttgcccatttccattttcttaaacttttttgaaacaaaaaataaaatcacaaagttcaattcaacatgcagatttcaaagaaaagggagctttctagaaactgagctgaaggggtactgtgggggatgggtactgttgtcagaacctcaaattcttgctggggcagtttgtgacaagaggcagggatgctggaatgacaggtagaggtgagaacaaagctgcgtgtgtgcagatgtgtgtgctgagggcaggggatggggacggcggccacaaagggctgtcagcagctagggtgcccgtgagaggtaggaccacctcaggcatgggcagagctggcaggacagcaagaaatctagacggactctctgcccttgtgtggagaaaagcccttcccttccctccaatgtctctacccagtcctccaacagcagcctacagggcccccagtcctaggggaaagtccgggagtctacagtctccgttcaagttcaagtaacctgaggcacgctctcttctagaaggtgccttccacatctctctcttctcgcagaagctgccagcagctccgtccagagattctggagcagagactgctgcctggaggtcacagatgaatcttggggtggccgatgctccagccaacttggggtgcaaaaaagacatgagcgctcctcttctcgggagcaagtagacacaggtgccagggtcaggaagatgatgctacagccccaagtcctacgccagccttccagcccggaaggctcatgtgtgcaggctcttgaccccagtgcttgcccttaccccagcaacgcggcgcggccagaaccagaatgcaataaatagaggcagggccaggaggcggagggccgggatggtgctagctttctgacgccgtctgcggcactgtgggttggtccacacagaagcgcttcaggggcggggcacctgagtcttcctcttcctcaacgacctaggagcaggcagagcatggaatgccagggccacccctcccaaccagaaccttcccacccacccgaattataatgggatgtccactctgctccttccagcagatgatcaaacatcctcccctgcctacaaccctgggactcatttccggcgctgcagatccaaccccacatccacagtctttcctggttttttgacttagaaactgggaagcctggccgggcacagtggctcacacctataatcccagcacattgggaggctgagatgggtggatcacttgggctcaggagttcgagactagcctggccaacatagtgaaaccccatctctactaaaaatacaaaaattagccaggtgtggtagtgggcgcctgtaatcccagctactcaggaggctgaaacaggagaattgcttgaacccaggaggcagtggaggttgtagtgagccaggatcgcaccactgcactctagtctgggcaacagcgagaccctgccttaaaccaaaaaaacaaaaaactggaaaactcaaagtgattgcttacctgtgtctctagtggaactggttcttccttggtgagggtaggaggttcatcagcaacttccgaggagggcagggagggctctgaaaaggcagtagggtcggcctgagggcagggctcccctgaggcctggacctgggggagcttccttagagctgtgtggaggtggcttggtgaggaggggagaatactggcctgagaagcaaacattcattcagggcccagctggaccaggtcacagccaagaatggtggaagggcaaaatacggctagactgcagagggccatctctgctgggctggagatatctggaaccgacaaagcagctcatcttgtcatcctctagcccaaacatcacaactctaactcaatctcccagttttctgagagttgctatgaggacgagatgaagtaataaaacacaggagctaagaacagcacatgccaaatagtaagaacacaataaatattaactacaattggcatttcccatggagaaacaagttccattttgtagttggctgttaacaggtcacagcacaggagaaggtaacaagggcctaagacacatctatatatccatattataacaagaaacctgggtcgggcatggtggctcacacctataatcccagctactctggaggctgaggtgggaggatcacttgaagcccaggagttcaagaccagcctgggcaacatagtgagactccatttctacagaaaattaaaagaaagccaggcatggtggcaaaggcttacagtcctactactacggagtctgaggcaagaggatcacttgaccccaggagttcaagactgcagtgagctaggattcagccactgcattctagcctgggcaacagagcaagaccctatctctttaaaaaaaaaaaaaaaaaaaaaaagaaaagaaaaaaatttagcatgtaatgcagacagcataaatgctgaaaatagaaggacttaaagtgacattcattccaacagttactagactggctatgtgatctcagacaagcgatttaacctttctctgtttttttttgagatgaagtctagctctgtcgccaggctggagtgccctggtgcgatcttggctcactgcaacctctgcctcctgggtttaagtgattctcctgcctcagcctcccgagtagctgggattacaggcttgcgccaccatgcctggctaatttttgtatttttagtagagatggggtttcaccatgttggtcaggctggtctctaactcttgacctcaggtgatccacccacttcggcctcccaaagtgctgggattacaggtgtgagccaccgcgccaggtcttttttttttgagatggagtctcactctgttgcccaggcaagaatacactggtgtgatctcagctcactgtaacctctgcttcttgggttcaagtgattcttctgcctcagcctccggagtagctgggattacaggcacatgccaccacgcccaactaaattttttatgtttttagtagagacggttttgccatgttggtcaggctggtcttgaactcctggcctcaagtgacccgctcacctcgacctcccaaagtgctgggattacaggtgtgagccaccatgcccagcccaatttaacctttctaagctttgaatgtccattttcctcatctgtaaaagaagacaatagctgccacctcacaggatttttgagagaattatagcaggcgtcaaatactcaagttccttccacacagcctggcacgcaactctaatgcttgttttctcccttccctctgtgaaaggggaaactataatcattcctaagctatcgagaaagggcttggtgctgcctggctctgaggtgctctctcgagcctgttactctaaagacgagacacaacaagagcagaaagcaaggcccttctaggaaactcatcctcggccaaccacgactcaccctccaggatctcctggcccagcgttgggggctgggagtcatccgtgcggaagtcggaggtgtgtgctgggctcagggactcactctgctgggggctggggcttgagttggtgctgctgtccaccttaagctgatagacgtcagacacggaactctggttgctgttttcgtctgaaaaccaaacagaacaaaggcagcagctgagcgtggtcattttcctcaagaggaactctggacagagccaagggcctggcatcactttaggcagccaaggatacaactgagtataataatcattgtgcccggcctacacgacatagattctaagcaccagaggcagccagaatctttatgtttatgcaacattacactttaggaaggtcaggatatgcttattaaactcttctttattatccactgattgcagcttgtggaagggagggatgtagctgtgtctctggtcagtacttctcaatccttctcacatcataagatgtgtagaaaatgacatttgtcaggcatccttgggcatctgaaggaggctggtggtgtctgaaggtggtgagctcaggcttcggctgccggactgacggattagcacctgggagttctgcctgaaggcttaaagtcaccatcaaggtgcaaaacttaagagttaccaggccgaggccaggcacggtggctcacgcctgtaatcccagcactttgggaggccgaggtgggcagatcacaaggtcaggacatcgagaccatcctggctaacacggtgaaaccccgtctctactaaaattacaaaaaattagccggctgtggtggtgggcacctgtagttccagctactcaggaggctgaggcagaagaatggcatgaacctagaaggcagagcttgcagtgagccgagatcgcgccattgcactccagcctgagcaacagagcgagactctgtctcaaaaaaaaaaaaaaaaaaaaaaaaaagagttaccaggccgagtgcagtggctcacgcctgtaatcccagcactttgggaggccaaggtgggcggatcacttgaggtcagaagtttgagaccagcctggccaacatggtgaaaccccgtctctactgaaaatacaaaaattagccgggcatgatagcacgcgcctgtaatcccagttacttgggaggctgaggcaggaaaatcgcttgaacccgggaggtggaggttgcagtgagctgagatcgtgccattgcactgtagcctgggtgacatggcgagactccgtctcaaaaaataaaaattaaaattaaaaaaaaagaaaaaaagtaagagtcaccaatgcattcctccgctgcacctacagtagccagtcaccaaagtgtttccccctcctgctctggtatcatttgtgctcattccttcctctcctactgcttcagttcaagcctcatcatctccagcctggcctcctgcaacagccacatacctcactgccctgcctccagtctcacgtaccttaaactgaactgcaaaccactgccagagagacctttctaaacccttcgacgctccactgctgcctaagggagaaatgtcatacccagtactttttttttttttttttttgagaccgagtttcgctcttgttgcccaggctggagtgcaatggtgctatctcagctcaccacaacctctgcctcctgggttcaactgattctcctgcctcagcctcttgagtagctgggattacaggcttgcgccaccacgcctgggtaattttgtatttttattagagacggggtttcaccatgttggtcaggctggtctcgaactcctgacctcaggtaatccacctgcctcagcctcccaaagtgctgggattacaggcatgagccaccacgcccagccatacccagtacttcttaggagaggcaggagctggccttatcgcaacataggaagtcctttctgatctctggcctcagtgcctactgttctcctacaagcatcctcagctccaggcagactggaccctaacccaagagcttcgtcatgcatgggtgcttctgcccagctgttccttggctaggctgccttctcttgtcctggaaagcctcagacctcccaacacagccccgacatcacttcttccgcggagccctacctccctggctcgcataggtggaaatgcccaccctctcttactctcctgtgatagcctgtgcacgcctgcatttatcatttcgcacacgtgcttcctcccatgagcctctgtggacaggctctgtggctcacttgtccttgactccccagtgcaacgcacggtacctgcatacagtgggagttcattaagtgtttactaaatgaaaaggaggagatggtggccagactgaggaaatggagcctcatatgtctcccagagccttctgactactgaacacacgttggtgttccctttccaacagcacatggttgaccttggtggggcctgggaaagaggtggggaaggaataactacacgctgggttagctccaatctggttttgaagagaaagtcataaactcatgctagtcttgactcctataaagacctttaatacccacactaaaatggaagtagcattttgtcaccaaatgaataaaactgtcacttttgagcttagacaaaacactgttcctccctgagcatcagtttccttaaatagggatgataataactgcctggtttatatcacaggctgatacatgggtaaaaatgagaaagtaaagtaaaagtgcttcgtagacagtacctagcaggtaggtgtaaaaggcagtatcatgactacggtgatgatccggcgggattggtttaggaggcagaacatgtcctaacagtgggtaagcagaagcttcggctttgggtagcctactctaagcgactatgataaaacatacagtctaggccaggtgcagtggctcatgcttgtaccttgggaggtcaaggctgggggactgcttgaggccaggagttcacaaccagcctggacaacatagccagactctgtctctacaaaaaataaaaaataaaaaatgaagtacaatctaaaaaaaagcttctgattcggacaaccaggacctgacatggagtctgtcacttacaagttatgtaactttagacacgtaacttaacctctctgagcctcagtttccttaactggaaaatgagaataccattacctatcttgcagagttatcgtgaagtttaaatgaaaagatttaggtcaagtgcctcgcaaaataccagcgaaacagcaggcactgaattgatacacagaattctttttttttttttttgagacggagtctcactctgcagcccaggctggagtgcagtggcgcaatctcggctcaccgcaacctccacctcctgggtttaagcgattctcctgtctcagacccccgagtagctgggattacaggcacgcgccaccacgctcagctaactttttgtatttttagtagagactgggtttcaccatattggccaggctcgtcttgaactcctgacctcaggtgatctgcccgcctcagactcccaaagtgctgaggttacaggtgtgagtcactgcacctggccaattcttcttattaatgcattcatccaagttttcattctcctgcaaggaagacacagagatgcaactcaccctggaattcaagaaggagagaggaattggctgaggcatcagaaggaaagccattaggttctcgggctgctgaactgttcgattttgacttttctttctagaaaaggaaaaaaagaggaatatgacagagccaagcaggagactcacagagagggaggagggtgctatgtgacagaccacagaggtctggattaggactgaacaggaaaaacgacagcagcgtgagaatccaaggacccaaggaagaacagaatcctggacaagcaacttctcctcaagcctcagaaaaatgaacccttccagcaggaatactgtgaatcataagcaacaggcagatacatacacttcgactagaacatcccatagtatccctctcctgccctgatcaaattgcgccaggcaacccttctctatacgaatgggcaagaaatacaaaacactcatttgagaaagattcctgtttcagtagcagagtggggaaaaagtgagagaagaaggaacctcatgtaacacagacagtgacaggacaaatgggcccaggctggctctattcctgatccgtcatcctcatccattcaaaacgaccaccccagccgggcgcactggttcacgcctgtaatcccagcactttgggaggccaagacgcatggatcacctgaggtcaggagttcaagatcagcctggccaacattgtgaaaccctatctctactaaaaatacaaaaatcagccgagtgtggtggcatgtgcctgtaatcccagctacttgggaggctgaggcaggagaattgcttgaggtggaggttgcagtgaaccaagatggcactactgcactccagcctgggctacagtgcgagactccatctaaaaaaacataaaataaaacaaaaaataaaataaataaataaataaataaataaaaatacaaaaatgagcctggcatggtggcatgtgcctgtaatcccagctactctggaggctgagacaggagaatcgcttgaacctggggggtggaagttgcagtgagccaagattctgccacttcataacagcctgggcgaaagagcgaaactccatctcaaaaagaaacaaacaaaaaaacccaaaaaacaaaatgatcaccccatgtttatttttacctataacatttgtttcaagaaagatgtaggttataagtgcagggcaaccacagtgggcaggtaagcaccagcttgcaacaagaaagcccaagggccaggcacagtggctcatgcctgtaatcccagcacttgaggaggcggaggtgggaggatcccttgagcccaggagtttgagaccagcctgggcaacatagtaagaccccatctctacaaaaaaataaaaaatgagccatgtatggtggcataggctggtggtcccagctactgagaaggctgaggtgggaggatcgcttgagcctgaaagtttgaggctgcagtgagctatgactgtgcactccaacctgggcaacacagttagaccctaactcaaaaaaaaaaaagcccagagtaaatccaagcatatgaaaatgagagcatcccaaaagccaaaagtttaaatctgagtagcctcaaatttaccagttcacactttttatacatttccggtagatgcattatattagtaacgtaatttttgttaataactcaattttttgtttgttttttgagacagagtcttgctctgtcacccaggctggagtgccatggcacaatctcggctcactgcaagctccacctcccaggttcacgccattctcttgcctcagcctcccgagtagctgggactacaggcgcccactaccatgcccagctaattttttgtattttttagtagagatggggtttcaccatgttagccaggatggtctcgatctcctggctccaggatggtctcaatccgcccgcctcagcctcccaaagtgctgggattacaggcgtgagccatcgcactcggccaaggaaagggggttttctagcagcatctactcctgtctatacacaatgcccaagagatttaactgcttgacctttgacccctgtgggtaatggccagagccaggctggatgggggaataaacagttgctccagaaccacgccccatcaactccatgagtttggcatcctagaacttcttgggatggctgctctcagataaaggcagagtccatacagttggtgctaggaggttccctggagccagagaggacagcagagagcaaaagggagaggctgaaccctgaggctaacctcaacctcctaaattcatttacagaaaggaaaactggccgggcgcggtggctcacgcctgtaatcccagcactgtgggaggccgaggtgggccgatcacgaggtcaggagattgagaccatcctggctaacacggttttcacccgcctccactaaaaatacaaaaaaattagctgagcgtggtggcgggtgcctgtagtcccagctacttgggaggctgaggcaggagaatggcgtgaacccaggaggcagagcttgcagtgagccaagatcgtgccactgcactcgagcctgggtgacagagcgagactccatctcaaaaaaaaaaaaaaaaaagaaagaaaaactacggatcaggcttccgtcctcctcgtagttacacattaccagccaatgcaattgagagtcccaagggaataaaaggtgagtgcacgcataaaactcaccagagattggaggaacacaggcaccctgataaacagaacagtctgtaccagaaggagcagaataactgaaattaaacatggatttgctcagaaagataaggataatattgaaaagttgttttagccaggggcagtgactcacagcctgtaatcacagcactttttgggaggccaaggtaggcagatcacttgaggtcaggagttcgagaccagcctagccaatatggtgaaacctgtctctactaaaaatagaaaaaaattagctgggcatggtggcacatgcctgtaatcccagctactcaggaggctgaggcagtagaatcatttgaacctgcaaagtggaggctgcagtgagatgagatcatgccactgcactccagcctgggtgacacagcgagactctgtctcaaaaaaaaaaaaagtcgttttgaggaagaaccaattgaggcaatttgttatgaaaaatacaattgctcaaataaaaattaagtgaatgaggttaattgaaatacatacagctaaataaaagattaatgagcaaaaactgcgttgagaaactcagaatgcaccaggaaagacaagaaatgaaatgaatgagagaaaagttaagaaataaagcagttggccaggcgtggtggctcacgcctgtaatcccagcactttgggaggccaaggcgggcggatcacctaaggtcaggagttcaagaccagcctgacaacacggagaaaccccatctctactaaaaatacaaaagtagctgggcatggtgaggcaagcgctactcgcgaggctgaggcagaagaatcacttgaacctggtaggtggaggttgcggtgagctgagattgtgccattgcactccagcctgggcaacaagagcaaaactccatctcaaaaaaaaaagcaagcaagcaagcagctgcgtgggtgcagtggctcacacctgtgatcccagcactttgggaggccaagacagaaggatcgcttgagcccaggagtttgagaccagcctgggaaatacagcaagaccctgtctctacaaataatttaaaagtttgccaggcgtggtggcacgtgcctgtagtccccgttacttgggaggtggagacataactatttcttgagctcaggaatttgaggctacagtgaaccatcattgcaccactgtactccagcatgagctatggagtgagacagtctcaaaaaaaaaggaaaagaaatattacaggatattttgagggaattcctaggagatcaaatatagaagaaatgctaaagtttccaggaagccaagtagatcacctacaaagactcaagcatgggaataacatcacatttcttaacagcgacactggatgtacaattcagtaatagcttcaaagtgctgaaagaaaataattttgaacctagaatttcatatacaggtaaaatcatcaattttcaacatgaaagtgaaacaaagatattttcagaaagttttccccacagaagctctctttgacaaaactcttgaaggatgtattctagcaaaaagaaaaacaaatgtaggagaaaacagtaagaagtcggtgcatgaggctgagcacagtggttcacacctgttaccccagcactttgggaggcctagatgggcaaatcacttgaggtcaggagttcaacaccagcctggccaacatcatgaaaccccgtctctaccaaaaaatacaaaaattaggctgggtgtggcagcatgcacctgtagtttcagctactgggaggctaggcaccagaactgcttgcacccaggaggcggaggctgcagtgagccaagattacgtcactgcactccagcctcagagtgacaccctgtctcaaaaaaaaaaatgtaggtgcatgaaattttaggcgagcctgggcgcagtggctcacgcctgtaatcccagcacttcggaaggcggaggtgggcagaacacgagctcaggagatcaagaccatcctggccaacatggtaaaaccctgtctctactaaaaatacagaaattagccgggcctggtggtgtgtgcctgtaatcccaactactctggaggctgaggcaggagaattgcttgaacccgggaggcagaggttgcagtgagcttagatcgcaccactgtactccagactgagcaacagagtgagactctgtctcgaaaaaacaaaacaaaataaggaaacaacaacaacaaaaattagctggatgtggtggcatgtgactgtagtcccagctactcaggaggctgaggtgggaggatcactggagcccaggagacaaaagtagaagtaaaccgagattacatcactgcattccagcctgggcgacagattgaaaccgtgtcttacaaaataataataataataaaaaaaggagcaggccgggcacagtggctcacgcctgtaatcccaacactttggcaagccgaggcgggcggatcacctgagatcgggagttgaagaccagcctgaccaacatggagaaccctagtctctactaaaaatacaaaattagccagatgtggtggcgcatgcctgtaatcccagctacttgggaggctgaggcaggagaatcgcttgaaaccaggaggcagaggctgcagtgagccgagattgcgccactgcactccagcctagtcaagagaagcgaaattccgtctcaaaaaaacaaacaaacaaacaaaaaaaactccaaaaaacaaaactcctgtttctggtgggaatataaattggtacaactaccatttcagcaaatagtttagcatcagctaatataggtcaaaacatacataccctaagacccagccacttcccttccaagaatatatcctaggaaaactcatgtacatgttgatgtggattctgaacaagaatgctcacaggggcattgttcctattggccctaactgtggacaacctcaatatctacaggagaaccagaaaaataaactacacttagccatgtgatgaatatgcagcaaaatacagcagagagagcaatggaaaggaatgggtaactccaaggacaacatggatgcattttacaaacataatgctgagcaaaagaaacaagacacacgaaaatagatactttatcatgctgtttccataacactcaaaatgttagaggctggtgcagtggcacatgcctgtaatcccagctatttgggaggctgagataagatcccttgagcccaaaagttcaaatccagcctgggcaacaatgagaccccccaccatctctaaaaaaggaaaaagcgtgggtacgatggctcatgcctaaaatcccaccactttgggaggccgaggtgggaagatcatttgatcccaggaatttgagacctatcagcctaggttgacatagcaaactcccatctctccaaaacaaacaaaaaaaagaaagaaaaaaaattagctgggcatgatggcatatgcctgtggtcccagcttctcaggaggctgaggtgggaggattgcttgagcctgggaggtcaaggctccagtgagctgagatcatgacactgcactccagcttcggtgacatagtgagattttgtctctggaaaaaaaatctcaaaaataataataaaggaaaaactgtttatgaatgactagacaagtggtaagaaaagcaaaagtaggagagtcattacctttagagggacaggaggaagaggatgggaagagctgcagagaggtctgctggggtcttggcaaagctgtgttttgcagagtggttctcacaagagtgttagctttatatttattcatacactgtacatttatgttttatatacttctctgtatgtgttttatatttgaaaatttaaaaaacaattagaaaaaataaagttggaaacaatctgggtatttatcacccagaaaatatgtagataaaggtactcactgcaaataagaaaatgcaatgcatgagtcaaaggtaataattctatttatatttacagatacatggagggttctcaaaacaaggttgggccaggcacggtggttcatgcctgtcatcccagcactttgggaggccaaggcaggcggattacttgaggtcaggagtttgggaccaacctggccaacatggtgaaacccgtctctacttaaaatagaaaaattagccaggcgtggtggcaggcgcctgtaatcccagctgctcaggaggctgaggcaggagaattgcttgaacctgggaggcagaggttgtagtgagctgaaattgcaccattgcactccagcctggcgacagagcgagagtccgtctcaaaaaaacaaaaaagcaaaaaaccccaaattaaaaaaccaaagttgaaccacagagaatacaaagaggttctggcaaaatactgtacatattttttttttgttttttttttgtttgtttgtttggtttttttgagatggagtctcactctgtcgcccaggctggagtgcagtggtgcgatctcggctcactgcaagctccgcctcctgggttcacaccattctcctgcctcagcctcccgagtagctgggactacaggcgcccaccaccatgcccggctaattttttgtacttttagtagagacggggtttcaccatgttagccaggatggtctcgatctcctgacctcgtgatccgcccgtctcggcctcccaaagtgctgggattacaggcgtgagccaccacgcccggcccacatatttaagttttgtttaaacacaaaaatacacatatgaaacaatgctatgtatttttaaagaatatacaggtatccaaatacatccaacaaagatgaagcacaaaggtctacaccagaattagaaagatgtatatacatatgatacacacaatacagtgggggactaatcgcataagagcaagtatcagcaaactttttcttaaagggtcagatgataaatattttaggttttacgggccatttggccttatggcaaccactcaatctgccactgtaattcaaaagcaccacagacaataaggaaatcagtgggcatacttatgtgtttggttttttttgtttgtttgcttattttcgagatggtgtgtcacactgttgcccaggctggagtgcagtggcgggatcttggctcactgcaacctctgccttacaggttcaagcgattctccttgcctcagcctcctgagtagctgggattacaggtgcctgccagcaggcctagctactttttttgtatttttagtagagacaggggttgcactatgttggccaggctggtctcgaactcccgacctcaagtgatccgcccaccttggcctcccaaagtgctgggattacaggcgtgagccaccacgcccagccagttatgttctaatagaactatactgacaaacctaaggaatacgccagggctgtagtttgtcaagccctggaaaagaggcttgggttaagggaaaggaataaagtaggaaaataataaagagaggccttgcatggaccaataacagggtaccttgaagtattttccactcaattctgggcaaataaattcctttaattaaaaggcaattaggccgggtgcagtggctcacgcctgtaatcccagcactttgggaggctgaggcaggtgggtcacgaggtcaggagttcaagaccagcctgaccaacatggtgaaaccccgtctctactaaaaatacaaaaatcagctgggtgtggtggcagatgcctgtaaccccagctacttgggaggctgaggcagagaactgcttgaacccaggaggtggaggttgcagtgagccaagatcatgccactgcactccagcctgggtgacacagcgagactccgtcccaaaaaaaaaaaaaaagaggcaatcaaataaagaaataaagaaaatggtatcttttgattttcttccacacttacctccttgctgtctgtcacaggaacccacttaaatatcctcagggacgtgtcacccacagtcacccacttcttctccctaaaagaaagacacttcttagaacggataaaacaatgcaatgtgttttctgttcatcacttgtgtttttctactactcagcagatcattccttcaatctggaatccttctgaacttcctcttggtggggtatggtagctcacacctgaaatcccagcactttgagaggctgaggcaggaggatcactcaagcctaggaggttgagaacagcctgggcaatttagcgagacctcatctctaaaaaaaaaatacaggccaggcgcagcggctcacgcctgtaaacccaacactttgggagactgaggtgggcagatcgcttgaggtcaggagttcgagaccatcccggccaacatggtgaaactctgtcgctacaaaaaaaaaacaaaaagtagctgggcgtggtggcgtgtgcctgtaatcccagctactccggaggctaaggtgggaggatcccttgagcccaggtggcagaggttgcagtaaactgagatcacgccaccacactccagcctgggcaacagagaccctgtctcaaaagaaagaaagaaaaaaaaaaggatgtgggacataaggctggaaggtagcacacacagcaccatattcttttttacttgcatgcgagttactttgagtgcttttctctttaccaaatatatgagttctattactacattccttttctttgtttgttttagtgagacagggtctcgttctgcctcccaggctggagtgaagtggcacaatcataactcactgcagccttgacctcctgggctcaagcaatccttccacctcagcctcctgagtagctgggactagaggcgcacaccaccacgcccagccaaatttttattttttgtagagatggttggggtggtggggtgggggtggggggtctctctttgttgcccgcgctggtcttgaactcttggtctcaagcagtctgcccaccttggcctcccaaaatgctgggattacaggcatgagccaccacacctggcctcctgtgtccatttaaagacccttccaaggggcaaacaatctcaggagagacacctgctgctggggggtatggcctggtgggtgtgaaatgttaggaacctttccctttctgggttactaagactgcataaagaaaaagaaaactaggccaggcgcgctggctcacacctgtaatcccagcactttgggaggccaaagtgggcggatcacgaggtcaagagatcgagaccatcctagctaatacggtgaaaccctgtctctactaaaaatacaaaaaattagctgggtgtggtggcacgcacctgtagtcccagctactcaggaggctgaggcaggagaattgcttgaacctgagaggcagaggttgcagtgagccgagattgcgccaatgcactccagcctgggtgacagagcgagattccgtctcaaaaaaaaaaagaaagaaaactagtctaaagaaatttttaaatttcaactttgaagttcaaagctttgtagaaatcctgtctcttgctgtgttccaaaggggtaaaaatggcagagtttatcagtccactacgctcacgaaataagcaaagggataagccttgcacaaggtcactctctaaatgactaaggacccccaactatctacaccagattagaatgccactgttctgagcttacccacagagtgccttcgaggtctgcaaacaaatgtgtggaggagatagaacaaaggagactttttttttttttttttttgagatagggtctccgtcacccaggctggagtgcagtggcgtgatcaccactccttgcggcctcaaaatcccaggctcaggtgaatctcccatctcagcctcccaagtagctgggactacaggccaccacgcccagttaattttttgtatttttagtaaggatagggtttcaccatgttgcccaggttgatcttgaactcctgggctcaagcgatcctcttgcctcagcctctcgaagtgctgggattacaggtgtgagccaccgtgcccagcctctccttcattccaagaaggttattccctaagcgtgcaggcagagaacaaatttgcttattttaaggtccaccaataccttaagaggtacttgctgtcagtaggaacaagggtcaaatgcagggaactgctttgtcacagatctgagccaacttctcaaagagtcaagtccaaatatgaagtcacgaaaaagcaaaaaaaaagcaactgctgttgtagttgttgatgctgttcagcaaatgatgacataatagggccgggcacggtggctcacacctgcaaccccagcactttagaaggctgaggtgggtggatcacttgagcccaggagttcgagaccagcctgggcaatatggtgaaatcctgtcctcactaaaaatacaaaaattagccgggcatggtggcgcacacctgtagtcccgactactcaggaggctgaggcggaagaactgcttgaaccccagaggcggacactgcagtgagccaagaccacgccactgcactccagcctgggtgacaggcaagactgggtctcaaaaaaaaaaaaaaaaaacagatgacatactgggagtgtaaagagactgtgatgtaacagaaggagcgaattaaagtcttagaaaataactaaaattaattcctgaacagaccactccattttctcatttattcaaccaattagtatacaacaggctgtgctaggccctggtgatgcagggaacaagatccacagtccctgccctcacagaccctgtcttatatctggaaacagacatgaatagctcaattcaagattagtcacttaatcatcaggttcaaccatatcaaattgccatttttgtaggttaattagtcaaatacaggaggccaggcacagtggctcacatctgtaattccagcactttgggaggtcatggtgggaggaccacttggaattcaggagttcaagaccagcttggccaacatggtgaaacccggtctccacaaaaatacaaaaaattagctgggtgtggtggtgtacacttataatcagctactcgggaggctgaggcagaattgcttgaacccgggaagcagaggttgccgtgagccaagatcgcaccattgcactccaacgtgggtgacagagcaagactctgtctcaaaaaaaaagaaatcaaatataggaaatgtcttatgagtccatctaatacaactgtggaaaggtctatgaaggagacttgatctagattgggaatctcaagtggtaaacctaaggaagcaacttttgagctgagctaggagttaactcggcaagagggaggagaggagagaggaagaagaatgccaggcggcaggaagagcagagtgacttcattggtaagacagcgggcatcctgggaaagagccagccaagtgaggcaggaaggagggccttcttcagtatttatcctaaaagcaagaagggaaccactgaagcattactaggggtgctaggataagatgcacattttatatatttttttacagatggggtctcactgtgttgcccaggctggagtgccatggcatgatcatagttcactgcagcctcaactcctgggctccagcgatcctcccaccacagccttccaaataaggctgtgcactttaaaaaggtcactccgctactcggaagagagaaaaataaaatcactcagtgcaaatgaacagactggggaatgagcaagagcagaagcagagagtttacagggaggctggtacagagttccaggtgacaggggatggcccttcagcctagcctgctaggggcgggggggtcaaaaatggggagaagagaaaggtgtacctgttcttaggtttcaccaaaacctcggaggattaaaggtggacgaggaaaaccatgagtatgttaaactaatatttatactgaaacccaactatatatgaagccctcagacataaaaaagagaaggaacttccctcttgtggggaaatggacagataaacacacaaataaagtccaacgtaccaacgaccttaaaggaggtaaagggatgggaggagttaaggaaagcttcctggcgggaggtaacatctacttgaacttttattttctgtagagacggggtctcactatgttgcccaggctggtctcaaactcctggcctcaagcgatccgcccacctcagcctcccaaagtgctgggattacatgcctgagccacctcacctagccagacctgggtttttaaattattagtagtaattggctatacaaaagagctgacgaagttggctgtgaaagtttaatgtgatgactccgatacacaccgatatagtatgtatcggagttccggatactaaacaggggctcaatcggcatcttccatgaacattttagacacggggtctctctccgtagcccaggctggagtgccgtggcacgatcatagctcactgcagcctccaactcctgggtcccagcaatcctcccaccacagcctcccaagtaaggatgtgcactttaaaaagaccactctgctacttggaagtgagaaaaataaaatcacacagtgcaaatgatgaacggactggggaatgaacaagagcagaagcagggaaattagagggaggctggtacatagtttgcaaaggactctcctgacagccgccggggcagcaagagaaaatgcctaccaagctcgcggcgcaggggccggttactgggggaaagggaggggtatccctctggatgacaccaggcttgctcccttgacagatggactaacccagaaactcacccaacttcaacgcctgaatacgcagagcgctcagcctggcgggctgacaccactccagggctactcgctattatcaagaggaagcctggaaacgcaggcggggccactgcccaggaagaggggagggcgggccccgggctgggccgggcgcgggcaccgacgccaggcagctccagtccgggccggaagccggaatcccctcccaggcggcgcgcggcagcagccgcagcaggtgggcgggcccgcgagccgggaggaccgctgattggccgcggccggcgcgccctctgacctcacgccgacgccagcggcgccctcctcccgccttctcccgcacccccctcccccagcgccggccggtcggctcccacctgacccgccagtcccacgctcctcagggcctggatccgcgacccccgccagccccctaagctccggcccctcaccatttccgcactttctcgatggccgccatcaccttcttgatgtcgtccttggcccggctgcgggtctccgcccggaccgaccggcccgacatggcggcggcgggagcggcgggggccggggcactgctcccaagacaccggggatcgcgcgcctcacgcgccgccgcccgcccgccgccgccgcagcgtcacagcggccgtcgccccctccgtgcgcgcgtgcgcgagaaagcgcgcgcacccgcccgccccttggggctcacggcctcagcgcgcctgcgcgccccgcccggggcgtccctcctgagtgccccgggagtcccctgagccccctacccgggccggggtgcgaggcgggttgggcgcacgtgcttgtggtcagggcgaggtgcgaggtgccgccggtgggcaacctggttctcttccctgagagtttggaggtcggctccctgctctggccagcgtgttaggaacctgaccctgtggaaccgcactcctgcgccatctctgtcctcccgcctctcctgcccagcacctttgccctctggctcctacgctgtgctccaaccacgcctttcttaaggatggcttccggtctttgcacacacctgttcctcacctggaatcccctcctctctttaccagatgaactgctttcccagcattcagaccacattcttgccttttctcgagtatctagtagtcccaagtatttgggaggctgaagcgggaggatcacttgaccccaggaatttgaggctgccgtcagctatgatatgatcgcacctgtgaatagccactgcactccagcctgggcaacatatggagaccccatgtctaaacgagaccccgtctctaaagtaaataaataaaaagatgtctattttgtgcaagactctgtacctaaagctgaagacatacgtggttttggtttcaaagagcttccagtttgtttatttattgagacggagtctcgctctgtgactcaggctggagtgcagtggtgtgatctccgctcactgcaacctccgcctcccgggttcaagcggttcttctgcctcagcctcctgagtagctgggattacaggcgggtgccaccacgcccagctaatttttgtaattttagtagagacggggttttatcatgttggtcaggctggtctggaactcctgacctcgtgatctgcccgccttggcctctcaaagtgctgggattacaggcgtgagccaccacgcctggcctttttttttttgagacggagtctcgctcttttgcccaggctggagtacagtggtgtgatctcggctcactacaatctccgcctcccgggttcaagcaattttctgtctcagccttccgagtagctgggattatagtcgtccgccatcacacccagctaatttttttatttttagtggagatggggtttcaccatgttggtcaggctggtcttgaactcctgacctcgtgatccacctgcctcggcctcccaaagtactgggattacaggcgtgagccaccgcacccggcccagtttatttattcatgtggagaggggatctcactatgttgtccaggctggtcttgaactcctggtctcaagggatcctcacaaagtgctgggattacaggcatgagccactgtgactggctgagcttccagtttagtagaacattcagacgaaaaaaaaatatttattttttacttttacttattttttggtacagggccttgctcaagtgatccttctgcctcagcctcctgtgtagctgagaccacaggcgagggccaccatgcctcgctgacatttttttttttttttttttggtagagacagggtcttcctatgttgcccaggttggtcttgaacacctggactcaattgatcctccttcctcggcctcccacagtgctgggattgcagacgtgagtcactgggtccagcttcccaaagcatatttaaaatgctatttgataaatgctagcctaggcggagcatggtggctcacgcctgtaatcccagcactttgggaggccaaggtgggtggatcatttgaggtcaggagtttgagatcagcctgtccaacgtggcaaaaccccatctctactaaacatacagaattagctgcttggaaagctgaggcaggagaatcgcttgaacccaggaggtggaggttgcagtgagccaagatcgcaccattgcactccagcccgggcaacaagaacaaaactccatcttggaaaaaataaattaattaaacaaataagtaaaatgctatttgataaatgccagcttaagtaggggaggggaggtgtaagatgctatggcttttattcctagtctgcagcaaagaaaaaagaggtgttatgacaaccttaatcttgaagctgacctctaaaaatagggtaggtgctgttactcccagggcagtgttcacagatgctacagatgctcaataaatgtttgcatgaatgttgaatccagtgcaagctcttgtcctctttgcccccacccaattgcaggcaggtgtcacccacgcttgcagtatgcggagagggtcctgtagcagctgtttcaggacacagcttgggacagaaagcagattggtagtggctgttctcacctataaagaaactaatttccatgtgctccagagaaatgcctagctagccctgaacttgagacagcctctgattatgagtcagcctttcatgatcaagcaacatagggcaagcatatgtcatcttactggcgagggggccagaaatagcttctgcctgactgaggagtgcaaaagctgaaccagcatgtggagtgaaaagatgattctagaaataacgggatcaaaggtggcacatttgttgttcagacccagccgatccaaaataaccgcagattgcctaagcacctgctgtacgccctagcacagtggacactgcaggtgatgtgaagttgagtaagacacactccttgtccttggggtgaaggtgaggaaagcagtagaaaggcagaacatacgtgccaagagagaggccagcccttgagacttctccagttctgcccatagatccccctggttgaggcacacagcccctgtgtctgtctcacccttgtccaaatcctcccacgtgaggtttcttgtctgtagcttccttctcgtccacagcccagcgctcctcccagctgcacaggttccctgcacacatgtctcccccagctcacccagccagtcgtcttcctggggcaaagtcccagagacccccccaaccttgttttctccctacatttgtccacctagtcctacattccccacctcatcttccactggggctcggtctgtgtaagagagtgatcaaagtgggcacctaccacctattcctcatagcctacccaaatgctctgtgttgataccctttttttttctttttctttcttttttagacagagtttcgctcttgtcacccaggctggagtgcagtggcgcagtctcggctcaccgcaacctccgcctccctggttcaagccattctcctgcctcagccacctgagtagccgggattacaggcatgcgccaccacgcctggctaattttgtatttttagtagagacggggtttctccatgttggtcaggctggtctcgaactcccgacctcaggtgatccgcctgcctcgacttcccaaaatgctgggattataagcatgagccactgcgcccagcctcttttctttttttcccttaagacggagttttgcttttgtttcccaggctggagtgcagtagtgcgatcttggctcactgcaacctccgcctcctgggttccagtgattctcctgcttcagcctcctgagtagctgggactagaggtgcccaccaccacactcggctaattttttgtgtttttagtagaaacggagtttcaccatgttggccaggcttgcctcgagctcctgacctcaggtgatatacccacctcggcctcccaaagtgctgggattacaggcgtgagccaccacacccagcctgacaccattttcttaaaataataataataataataataataataataatcaggtccggcacggtggctcacacctgtaatcccagcactttgggaggccgaggctgttggatcagaaggtcaggagttcgagaccagcctggccaatatggtgaaaccccgtctctactaaagacacaaaaaattagctgggtgtggtggcgcgcgcctgtaatcccagctactagggaggctgaggcaggagaatcactttaacccaggaggcagaggttgcagtgagccgagattgtgccactgcactccagcttgggtgacagagcgagattctatctcaaaaagaaaaaaaaaatcacatcttgtcattttctaggtgaaaggcttgtgctagatgagatgccgaggtggatacagaggagccaccccagatctctgcattgggcgacctgcattcaagggctcagcttcctttctcactttgagtacaagctacagcggctgacaaggccccatccatccccaggcatcatcctgttaattctctgacctcacctcctacaactctacccgtgctgtctctgctccaaatccactggcctccttgctcgtctgaaagcacagtccagctcctgcttcaagtctctgcacttccgcttcctctactgcagcacccatcaaccatatatttacatggctccctcccttacctccttaaggtctttattcaaatgttatcttcttggccaggcacagtggctcacgcctgtaatcccagcactttggaaggccaaggtggacggatcacgaggtcaggacctcatgaggtcgagaccatcctggccaacatggtgaaaccccatttctactaaaaatacacaaattagccaggcatggtgatgcatgcctgtggccccagctacttgggaggctgaggcaggagaatcgctcgaatccgggaggcggaggttgcagtgagctgagattgcgccactgcactccagcctggtttggcaagagtgagactgtgtctcaaaaaacaaaaaagcaaatgttatcttctcaatgcagccctctccgcccaccctatctaagactgcggtatccatccccacacacacgctatatcctccttcccctatttatttctctccaaaacagtcatcaccactgtgatagttaatactgagtgtcaacttgattgggctgaaggatgcaaagtattgatcctgggtatgtctgtgagggtattgccaaaggagattaatgtttgagtcagtgggctgggaaaggtagacccacccttaatctgggtgggcaccatctaattagctgccagtgcagctagaatatgaagcaggcagaaaaaatgtgaatagactgtcctagcctcccagcctacatcttactcccgttccagatgcatcttgcccttgaacactggacaccaagttcttcagtttggggacttggactggctctccttgcttcttagtttgcagatggcttattttgggaccttgtgattgtgtgaattaatacttaataaactcccctttacatatatatatatatatatatatatatatatatatatatctcctattagttgtgtccctttagagaaccctgactaataaaaccacttaatatcctattttatttttctagccaggcgtggtgacccacacctgtaatcccagcactttgggagactggtcgggggggtggatcatttgaggttaggagttcaagaccagcctggccaacatgatgaaaccccatctctactaaaaattctaaaattagttaggtgtggtggcatgtgcctgtaatcccagctactagggagactgaggcaggagaatcacttgaacctgggaggtggaggctgcagtgagcagagatcgcaccactgcactccagcctgggagacagagtgagactctgtttcaaaaaaaaaaaaaaaaaaacaacaacacaaaaaagccagctgattagcaaccttaattccatctgctactgtaattccctgttggcatatcacccaacaaattcctgagttccaaggattaggatgtggatatcttcagggaatcattattctgttaccacatcatagaaatctgtccacactagtggaaaaacaaagcatatcatatatgtatacatatatgaatatatatacacacatatgtacatatatacaaattatatgtttaagagacggagtcttgctctcttgcccaggctgcagttcagtggcacaatcataagtcactgcagccttgaactcctgggcttaagtgaccctcctgcctcagcctcctgagtaactgggattataggtgcgcgctaacatgcttggctaatttttaaattttttttagagatggggggggggtctcactatgttacccagcctggtcttgaactcttggcctcaagcagtcctctcgccttagtctcccaaagtgctgagattgtaggaatcagccataaatgggattacaggcatgaacaaccatgcccagccacctagtgcttttgattacccagtaaaccacacagaatcctctgtttccagctggcagaaaagagagtatggagagcctcaggagggtttttgtttgtttattttattttatttttttgaaatggaatctctctctgccacccaggctggagtccagtggcacaatcttggctcactgcaatctctgcctcccgggttctgggttgaagggattctcttgcctcagcctctcaagtagctgggactacaggcgtgcacctccacgcccacctaattttcatatttttgtagagatggggttttgccatgttggccaggctggtctcaaactcctgacctcaggtgatctgcccgcctcagcctcccaaagtgctgggattacaggggtgagccaccgtggtttttagaggcagccctcaggagggtttttagaggcagccagagactcaacagatcacttctgcacacattccattggcctgaagtcatcaaagggtctcacctaactgcagggaagcctgggacatgtagtccagctttgtacctaggaaactgagaagcggagttggggaacatagcaatctttgccactgtgggcaagtccctggcagtcatgacacgctcagtgaattaacgtggggttgaggaaatttggggtgcagcacatcaagaaattcacttttgccctgggttcttttttgtttgctgttagttttgcttcttattctagagagatgccctaggttctagatcacaaaaggctaaaatatgcagggcagaggccattattatggtgaaataaagactcaagggccagagaccaacacagttattaccaacataattatcgccttccgtatcatcatcatcaactttatcattttgggggttgttgtttggttgatatttttcctgcctctgggctccaaaagcaactgaaacatacctgggctgtcaaacctactagctggctgggcacggtggctcatgcctataatcccagcactttgggaggccaagttgggccgatgactgcagcctcaacctctgagtctcaagcaatcctcccatctcagcctcctgagtagctgtgccaccatatgcccgactaatttttgtgttttttgtagagatggggtctccctgtttcccaagctgatctcaaactccggagggtttttgtttattttctttcatttttttgagatggagtctcctggactcaagtgaccctcctgcctcagcctcccaacgtgctatgattatagccgtgagccactgtgcccagctggcactcttttatttgtattttttcaagaggtggagtctcactctgttgctcaggctggagtgcagtggcatgatcatggctcactgcagcctccaactcctggactcaagtgatccccctgcctcagtctctcaagtagcccagtagctgggactacagaggtgtgacaccatgcccagctgattttaaatttttttgtagagatggggtctcaccacattactcaagatggtctcaaactcctagtctcaagtgatcctctcaccttggcctcccaaagcactgggattataatcatgagccaccctgcctagcccagttttggaattttgatcatctcctcactttggaaccattagtccctgggagaatcacactgaagtgtatgaactcacaagatgcagtgacttttgaaagtaatagaatgatttctgctgccaatgcaactgcgtggtggatgcacaagtggtggtcaaagtgagctcatttgctgttgggcaatcagtatacaggttcgtcttattagtcaacaaattgaaatagtggctactgtgtgctcacttgcatgggtgcaacagaaagagatacaagacgaatttctaacactataaactccctgccctcaaagagcttattttctggatggcaaggtcagaggctgtatggggtcacactaggaaccagctcgagctctgtactcagacccagagttgaattcctgcttgccacttaacttccacaaaccttggtttttccaatggggataataattgctacttcacaagagctgctatgaagtgaaagtgaaagagtatgtatcacgggaggctatcgttaatgctttcaatatatcatgttactgattttttctaagagacagggtctcaccgtgttgtccaggctgtgatcatagctcattgcagctttgaactcctgggctcaagcaatcctcccactgcagcctccagagaggctgggactacaaatgtccatcaccatgccccaatttgtgcgtgtgtttgtgtatagacaggggtttcagtatgttgctcgggctggtcttgaactcctggctccaagtaatgcccctgcctcggcctcccaaagtgtcaggattactggtgtgagctaccactcccagtacctgttatttaattaatgaattttaagttccagggtccatgtgcaggatgtgcaggtttgttacataggtaaatgtgtgccatggtgatttgctgcacctatcaacccatcacctaggtattaagcccagcatgcattagctattcttcctgatgctctccctcccccaacaggcctcagtgtgtgttgcctcctctctgtgtctatgtgttctcattgttcagctcccacttataagtgagaacatgcagtgtttggttttctgttcttgggttagtttgctaaggataatgacctccagctccattcatgtccctgcaaaggacatggtcttgttctttttgtgactgcatagtattccatggtgtatatgtaccacattttctttatccagtctatcattgatgggcatttgggttgattccatgtctttgctattctgaatactgctgcaatgaacattacataagaattgcacattcattgtagataacacagtaacaaaactttttgtgcctttcccaagctgtcagtctctgaaatgtgactttactggagtagctataattgtgaaaacatgtccatatgcaagacactatccagggcttcaagttatcacagataagcaaattaaagagttggttttcctcatgcgcccgagtgttggatgcaggtggtggaagacccacttgcaaccaaaccccaggaaagtagccaggaggagggtggactgcactgaggaaggaagactccctgggaagtggcaggccactgttgagatggcaccaccatcttaatctgtgtattgcatggtttaaacgactgcaagccccagcctgggcaacacagtaagacccccatctctacacaaaacagacaggtgtgatggcatgcgcctgtgatcctagctacttgggaggctggggtgagaagatcacttgagcccaggaagtcgaggctgcagtgagccatgatggcaccaccacactccagtctggatgaaggagtgagaccccaactctaaaacaaacaaaacaccaaaataggctatacaccgccatttaaaatatttccccaaattttttttttgaaaaatttcacacccacagatgttgaaattataatattaagatacaattactgccttcacatgcaggatttttgattaaaaaaaagaaaaaccttggtggcctctgctctatgttaatatccagacac

SEQ ID NO: 1224 - DNA, 32727 bp, Homo sapiens
taggttaaagacaagaatacagttacgtgccacataacaatgtttcggtcaacaagggaccacatatgtaatggtggtcccataagattataatggaactaaaaaattcctatcgcctagtgatgtctagccatttgtaacatcatagtgcaatatattactcatttgtttgtggtaatgctggtataaacctactgggctggtggttataaaaagtgtagcacatacagttatgtacagtatacaatatttgataatgataataaacaactatgttactggtttatgtataatatttagcatgctatggccaggtgcggtggcttacgcctgtaatcccagcactttgggaggccaaggcgagcggatcacaaggtcaggagctcgagaccatcctggttaacacagtgaaacctcatctctactaaaaatacaaaaaattagccgggcgtggtggcgggcgcctgtagtcccagctactcaggaggctgaggcgggagaatagcatgaacccacgaggcagagcttgcagtgagctgagatcgcggcactgcactccagcctgggcaacagagcaagactccatctcaaaaaaaaaaaaatatattcagtatggtatgctctttactgtttagagtacactcctacgtattcaaaaaaaaaaaaaaaaagttgactgtaaaaaagcctcaggcaggtccttcaggaagtattccagagggcactgttatcataggagatgacagcttcatgcatgttattactactgaagcccttccagtgggacaagatatggaggtgaacagcagtgatactgatgatcctgaccctgtgtaggcctagactcgtgtgtgtgtcttagtttgcaacaaaacaagtttaaagccaggcacagtggctcacgtctgtaatcccagcactttgggaggctgaggcaggagggtaacttgagcccaggagttcaagaccagcctgggtaacatagcaaaaccccctctctacaaaaaatacagaaattagccaggtgtggtagcttccgcctgtagtcccagctactcaggaggctgaagtgggagaatcacttgagcccaggaggttgaggttgcagtgagccgtgattgcacaattgcactccagcctgggcgacagtgagaccctgtctccaaaaaaaaaaaaagtttaaaaggtaaaaagaaaaaaaaagtaatagaaaaaagcttgtagaataaggatataaagaaaatatttttgtacagctgtacaatgtgttttatgtcttagctgtgttataacaagagtcaaaaagtgtaaaaaaacttaaagtttataaagtaaaagttacagtaaactaaggtttactgttgaaaataatattttaataaatttaatataggtgaagtgtacagtattcataaagtctacaatactgtaaagtaatacattcactcacctcttactaactcactcagagaaactttcagttctgcaaactccattcatgataagtgtcctacacaggttgtgccctttttttttttcctgtatacagtattttctttttttctttttctttttttttttttttgagacagtctcgctctgtcgcccaggctggagtgcagtggtgcgatctcggctcactgcaacctctgcctcccaggctcaagccattctcctgcctcaacctcttgagtagctgggattacaggcgcccgctaccacacccggctaatttttgtatgtttagtagacacagggtttcaccatgttggccaggctggtcttgaacttctgacctcaggtgatccacccacctcggcctcccaaagtgttgggattacaggcataagccaccacacccggccaggtgttttcactgtaccctttctatatttaaatacaaaaatgcttaccattgtgttacaattgcctacagtattcagtacagtaacttgacgtacagctataccatttagcctaggtgtacaggaagccataccatctaggtctctggaagtacactcaaagatgttcgcacaatgacgaaatcgcctaccaactcatttctcagaacataaccctgctgttaagcaatggattactcttatttcccaaggctcaatcctaacattctcgggaagccttcttgactcctatcattaagccaaatacccctcttatgcactctcccagattcacgaatattttcttcccaaaagttaccactattgcaatttttttttttttttttttgagacagggtttcaatctgtcacccagcctggagatcagcagcacgatcacagctcactgcagcatcgacctccccaggctcaggtggtccacctgcttcagcctcccaattagctgggaccaccacgcccggctaatttttttttttttctgtattttttgtagaaacggggccttgctatattgcccaggctggtcttgaattcctggactcaagtgattctcttgccttggcctccggagtcgctgggattataggcgtgagccactgcgcctggccctatcactatggtaactttacatttatctgaattcctttttttttagacggagtctcactctgttacctaggctggagtgcagaggtgcagtgtcggctcactgtgcaacctccgcctccgggttcaagcgattctcctgcctcagcctcccaagtagctgggattacaggcacgcgccaccacgcctggctaattttttttttttgtattagtagagacggggtgtcaccacgttggccaggctggtctcgaactcctgaccgcaagtgatccgcccgcctcagcctcccaaagtgctaggattacaggcgtgagccaccgcgcccggccattatttgtattgttttttgtttgttttgttttgttttgttttgttttgagagtctcgttctgtcgcccaggctggagtgcagtggcgcgatctcggctcacagcaacctccgcctcccgggttcaagcgattctcctgcctcagccaccgcgcccggcccattatctggattctttagtacctgttcctctagactctacgctccattaaagcaggaactccatctgttgcaacacctagcacagcgtccggcacactgcagttcttcaataaatacttgctgcatgaagccctctcttcaccaccacccccacccctcctcctcgcaaaaaaaaaaaaaaaaaaaaaatgccccagggaagggtccctatctactctgtccaccactgcccagggcccatcagtgggcccaatggctatttggcgagtaaataaatggggtcaggagaaacgaaggggaaaggatgtgtcagaggccaggactgccccctaagatggaggaggcctaactctgggagcttccgcctctccgaacgagcgtcgccaagagaaaccccctcagaagcgaaaagggccaggaaaagaggtcagccccggccaggcaaagacatcacctaagctccccagcagccccgtgtctctccgccttttccttctcccttcccgtcatgggaaagactcccgcccgtgtcgtcacctacacacacgaaagagacacagggagagaggcttccattcacggtcactcacaggcgcagcggtttctgtgccatctgtccgaatagtatgggttgcgactgccacctaaaattgggaatgcgaatccgcgctccccggaaaaatgcgaccgcgcaacaatcagacgtcagcgccctccagccaataacggttcacttacttacggagaccgccgagggacagaagcctctctcaggtgtttgcgcctcaaggaagaatcaagagggaaagggaggaacgaagggagaaagagaaagtgaccgaaaggattccaactatgattttttaaattaaatttcagagcacttgaagcgaatgaatggctaggaagtacagagcacaatgtcgggttctaacctaacctaacctaacctaacctaacctaaccatatcggtctagtgggcaagacagaccccctctatccacgttttttgtaagtttttaacctatcaaaaagttaagaggccgggcgtggacgctcacgcctataatcccagcactttggaaggctgaggcgggcggatcacttgaggtcgggcgttcaagaccagcctgggcaacatggtgaaaccccgtctcttctaaaaatacaaaaattagccgggcatggtggagaattgcttcaaccagggaggcgggggttgcagtgagtcaagatcgcgccattgcactccagcctggacaacaagagcgaaactccgtctcaaattaaaaaaaaaaaagttaaaagaataatggctattaccttgattcagtaagtctcagcatgttggcaaatttgcttgtgttctctttctctcaaagtgcccaagcccttccattctcactcaatcatttgaaagtaaagtacaggccgggcgcagtggctcacgcctgtaatcccagcactttgggagatccagaccatcctggctaacacggtgaaaccccctctctactaaaaatacaaaaaattagccgggcgtggtggcacgcacctgcagtcccagttactcgggaggctgaggcaggggaatcgcttgaacccaggaggaggaagttgcagtgagccgagatcgcgccacttcactccagcctgggcgacagagcgagactccgtgtcaaaaaataaaataaaataaagtgcggacaacaggaatacatctccatttatctcctaagattaggatatcctcctacataaccgtaatactattaacacagctaagaaaattaacattaattattcaataatattacctaatatacatccatatttaaagttctccatatttccctacaaactgattttatatttggggcttgttttgattcagatgcaatcaagtttcacacttgcatttggttctgtctctattttaatctacaaaagccctcctacctatttggttttagtttttgtaatattgacttttttgaagggttcaggccaagtggtaggaaacaagtgtgtaaggaaatggaaacaagagagagttcctgacgactgcggggaaaggaagactcatcaagggcatctaaataattcaaaattaataaaacataagattaaagaagaactacaggccaggcacagtggctcatgcctgtaatcccagcactttgggaggctgaggcgggaggttcacttgagaacaggagttcaaggccaacctgggcaacatagccagacctcgtctctactacaaatttaaaaagaaaaaaaaaaaagttagctgggcatggtggccgtatgcctgtactcccaggtactccagaggctgaggtggggagatcacttgagcccaggagatggaggcttcagcgagctattaccttgccactgcactccagcctgggtgacacagcaagccctgtctcaataaccaaacaaaactacaaagttctggcttttcccacagcctacaagccttcttttttgtttgtttcttgcctcataactggtggctctgctttgctggcacataagcatgcattttttcctactctttggataatacagcactgcccaggagtagcactcaagactgaatcttgaagaagagtagaagtttgccaaacatgagcaggtaataattcccagaagaggatacaaaagtaagacataaaaactcatcgtattgaaaaatcaaaagactccacgaaaaagactgttagaaataataaacgaattcagtaaaagtttcaggataccaaatcaacatacaaaaatcagtagcatttatatgcaccaacagtaaacaatctgaaaaagaaatcaaaaaagcaatctcatttacaacagctacaaagaatataaactacgtaggaatcaatttaactaaagaaatgaaagatctatacaaggaaaactatacaatactgatgaaagaggacacacacacaaaaaggaaagatattccacgcttatggattagaagaattaggcgggcagatcacgaggtcaggagatcgagaccttcctggctaacacggtgaaaccccgtctctcctaaaaatacaaaaaaattagccaggcgtggtagcgggcgcctgtagtcccaggtactcggaaggctgaggcagcagaatggcatgaacccgcgaggcagagcttgcagtgagcggagatccagccactgcactccagcctctagcctgggcaacagagcgagactccgtctcaaaaaaaaaaaaaagaaagaaagaaaaaagacaacactacctaaagcaatttacagattcagtccaatccccatcaaaatacaaatggcattctctagatagagcaaggatccccaacccccgggctatggaccagtacccatcagaaaccaggacgcacagcaggaggcgagcggtgggcaagtgagaataaccgcctgagctcacttcctatcagattagtggtggcatcagattcttacagaggctggaaccctattgtgaactgcacatgcgagggttctacggcgctgcgtaccttacaagaatctgatgcctgatgatctgaggtggaacagtttcatccccaaaccatccccccatccctactttcagctctctttttctaatgtaaatgtcatgtacgagcgtttgttttttttgttttgttttgttttgtttttgtttttgtttgagactgagtctcgctctgtcgcccaggctgcagtgcagtggcgcgatctacgctcactgcaagctccgcctcccgggttcacgccattctcctgcctcagcctccagagtagctgggactacaggcacccgccaccatgcctggctaattttgtttttgtatttttagtagagacgagttttcaccgtgttagccaggatggtctcgatttccttgacctcgtgatccgcccgcctcggcatcccaaagtgctgggattacagacgtgagccaccgcgcccggccacaatagttttatttgacgtcaggactgttttgtagaccgaggtgtgatagatgtggcacgcaccagccacggtttccaccgtccccagagcgtggagaggcagcgccactgctctcaaggttaatgacaactcaataaagcactgcttttattttttgcagtcttcaatttgagaaaggccagaaataatgttttcaataaatatggttcataccattaaaaaaaaaaatccccccgcgtccacggaaaaattgtcttccataaaagcggtccctggtgccaaaaagattagggactgctgctctacagaaatagaaatagaaaaaacaatcctaaaatctatatggaaccacaaaagaccccaaagagccaaagcaatcctgagcaaaaagcacaaagctgaaggcatcatactgcccaacctcaaaatctactacaaagctatggtaacccaatcagtatggtactgacataaaaatagacacatagaccaatggaacatatataaatccatgcatttacagccaactcattttatgtcaataccaaaagtacaaaggtgccaagaacattcaatgaggaaaggacagtctcttcaataaatgattcttggagaactggatagccctatactgaagaatgaaactcaactctatctctcaccatatacaaaaatcgcatcaaaatggataaagacttaaacctaacacatgaaactatgaagctaccagaagaaaatactggagaaatgttccaagatattgatctgggcaaaaattttttgtataagacttcaaaagcacaggcaacaaaagcaaaaatagactaataggattatatcaaactaaaaagctctgcacagcaaaggaaacaatcaacaaagtgaagaggcaacccacagaatggaagaaaatatttgcaaactatccatctgacaagagattaataaccagaataaatataacaaggagctcaaacaactcaatagcgaaaaaaacccacaaaaaatcctgtctaaaaatgggcaaagccatatgtggtggtgcttgcctgtagtcccagctactcaggaggctgaagcaggagggtttttttgggggagggggagggggtggggagatggagtctcactctgtcacccaggttggagtgcagtggcacagtctcagctcactgcaacttccacctctggggtccaggtgattctcctgcctcagcctcccaagtagctgggattacaggtgctcaccaccatgcctggctaattttttgtagttttagtagagatagggtttcactatgttggccaggctggccttgaactcctgacctcagatggtccacctactcagcctcccaaagtgctgggattacaggcctcagccactatgcccagtcccaggaggactgtttgagcccagtttgattccagcatgggcaacataatgagaactcatctcttaaaaaaacaaagcggggggagcaaaagatcaaaatagacatttctcaagacatacaaatggccaacagctataagaaaaaatgctcaacatcaccaatcatcagagaaatgcaaatcaaagccacaacaagatatcacctcatcccacttaaaatttcctatcaagacgacaggaattaacagatgctggcaaggatgcagagaaagaggaactcttgtacacagttggtgggaatgtaaattagtacagccactatggaaaattgtatagtttcctccaaaaactaaaaatagaactacaatatgatccagcaaattccactactgggtatgtatccaaaagaaaggaaatcaatatatcaaagagatatatgcactctcatgtttattgcagcactattcacaatagctaaaatatggaatcaacctaagtgtccatcaatggatgaatgggtaaagaaaatgtggtatatatacacaatggaatattgttcagccataaaaggaatgaaattctgtcattctcagcaacatggatgaaactggaggtgattgtgttaactgaactaagccaagcacagaaaagacaaatattacatgttctcactcacatgtgggagctaaaaaagtggatctcatggagatggaggtagattggtggttaccagaggccaggaaaggtggtggggacgtgaggatgaagagtttgattagtggacacaaatacagaagaaataagacctatgatagatcagtagagtaactatagctaatgttaatctattgtacatttcaaaataggtaaaagagaataattcaaataatgttcctagcataaagacaagataaatattaaggtgaaggacatcccaataactcttgatttaatatttacacattatatacatgtattaaattatcacttgtactctgaaaatacatacatctattacacatcaataaaaaaactcatccattaaattctgtattatctttgcaactttcccgtaaatctaaatctattttcaaaaagtttatgaaaactcatccatgggaatttaaggtggctgaagatagctgaacacagtgtaacaggaaataaaaactttttaaaaatagatcaacatggctgggtgcggtggctcacacctgtaatcccagcactttgggaggccgaggtgggtggatcatttggggtcaggagttcgagaccagcctggccaacatggtgaaaccccgtctctactaaaaatacaaaaattagcctggcatggtggtgggcacctgtaaatctcaactactcgggaggctgaggcaggagaatcgcttgaacccaggaaacagaggttgcagtgagctaagatcgcaccactgcactccagcccaggcgacagagcaagacttcatctcaaaaaaaaaaaaaaaatagatcaatacatgcacggaaaaggaaaagggttggaagaaggggtaagactgattctatgttaagatagtagagttacagtttaattcttttgttttttatttaagaaaaatgtttaaataggggccttatgttaggcacggtggttcatgcctacaatctcagcactctggcaggctgtggtaagagaatcacttgaggccagttcaagaccagcctggacaacatagtgagactccatctgtataaaaaataattagcaaggcatggtggagcgtgctggtagtcccagctattcaggaggctgaggtgggaagatcagttgagcctaggaggtcaaggtgagctattatcacaccaccacactccagcctgggtgacaatagagaccctgtctataaacaaacaaaaaaacacaagggacttgtatgcataatgaaagtctagatttttcagaggccatgataagtcactacagggttctaagcaggagtaatagggccagtttacatttttaagattgctctggcagcagtgtggagggtggttggaagggacagttaagatgagaagagaccacagcaacagtccaggaagaacagaggataaatgatgactgtctggaacagaggggaaatgacagaaacagaagtaagaaactctttgggatatgtaattggggacctcagacaccttcccagctgctaatgttgtgttctgggtaaggctgcctatctttcaacctagactggtcagtcagtatgtcccattgtctgatgtttttagtgtgcaaagaagtcgattaggtccctaagatccccccaaatcctacatacacagtaggaaggtattttataaaatcctttattttatgagtggcaatcgtcacctccctacccaacacataaacacacatacccatctagtctttgttttcatcacatttcccaaactgatcgcatgtcaatgtgactcacatagaaaataaacaagaggggcccatcacatacgccaagttatcaatactcctttcaccatttctgctcaatctagaagactcagcttggaattattttaagattttatgttatttgcaatattatggaaaagtaagttaccgacattcacaaggtgataagctgcaaagaacaagtttgttttgttttcctttttaaatttagaatcttgtttacaacacattagcatcattaacagaaaaacgaccatttacatagtaactaaaaaaccagccacttaagaaaataatgtagtaatcaaccactaccagagaaaataggtcctctcatttgattttactggtaagtccagctgttttctgaactttgtgagagtctctgtcctgaatatggcaaagcattcaagtaaaaggtaggaagttataagtgtgagattctgagggattctgtctcaaagaaggttcaggaatagccacagtcctccagtttactcgaacgttgagatgttcctgtgatgaccagcataatttccttttgaggaattttcacaattcatcagcctcaggattcaggttttataagacattcttccacattaaaaaaaaaagactctgtcccatagaaataagtttctcatcgcttctccagcttcttgtacttggcttctgtgagggatgagggagagttacatcttttaaaactggctcttacaaagacagtttttagttagcatttccagtcaagtttaaaaaatatgtataatattactaaaaatctattagcttcaatctcatcatctgtccaaatatacggatcactgatctgtaaaacttggaataagaattcaagcacagacactcagaactgagagcctaacacaggttcacgaagtcctcaccctgtcaacagcacctacttagacagctccaccaggatggggcacatctgtcacttgacctatcgggagccttactaaaaaactgcctctctcagcactgtcccaggtgccctctggaaccagactggaaccctcaggaagtataaatgtatgtttcctcctgtatgttcttatccttacaccttactccaggaaagcaattttgaaagatacagatatttaaaaggccatcaaataagcctcttactctgacattccgtttttctattaaaaccatgaaagcacctggtttcacaattttaacagaaaaagggactctgtcacaaatggttactgtgaaccaagatactttctacatggtaaggttacccctgccttctacgcggtaaggttcacggtaatcactggctaaatgtaactgtagaaaataaaactgattgttaatcgccacccatatcaaatcccagcctactacaaactactttcttgaagtagtcagcccttgttaaatgatgaaaataaaataatctgtaaatgttataaggacaaaaacaaactcaggcccgtctccctctccatctccctctcccgtctccctctctctctcccgtctccctctcccgtctccctctcccgtctccctctcccgtctccctctcccgtctccctctccctctcccgtctccctctccctctcccgtctccctctccctctcccgtctccctctccctctcccgtctccctctccctctcccgtctccctctccctctccctctcccgtctccctctccctctcctttccacggtctccctctcaagccgggccaaagctggactgtactgctgccatctcggctcgctgcagcctccctgcctgattctcctgcctcagcctgccgagtgcctgcgattgcaggcgcgcgccgccacgcctgactggttttcgtgtttttttggtggggacggggtttcgctgtgttggccggactggtctccagctcctagccgcgagtgatccgccagcctcggcctcccgaggtgccgggattgcagacggagtctcattcactcagtgctcaatggtgcccaggctggagtgcagtggcgtgatctcggctcgctatggcctccacctcccagccgcctgccttggcccccccaaagtgcggagattgcagcctctgcctggccgccaccccgtctgggaagtgaggagtgtctctgcctggctgcccatcgtctgggatgtgaggagcccctctgcctggctgcccagtctggaaagtgaggagcgtctctgcccggccgccatcccacctgggaagtgaggagcgcctcctcccggccgccatcccatctaggaagtgaggagcgtctctgcccggcagcccaccgtctgagatgtggggagcgcctgtgccccgccgccccatctgggaggtgaggagcgtctctgcccggccgccccgtctgagaagtgaggagaccctccgcctggtaaccgccccgtctgagaagtgaggagcccctccgcctggctgccaccccgtctgggaagtgaggagcgtctccgcccggcagccaccccggccgggagggaggtgggggtcagccccccgcccggccagccgccccgtccgggaggtgaggggcgcctctgcccggccgcccctactgggaagtgaggagcccctctgcccagccagccaccccgtccgggagggaggtgggggggtcagccccccgcccggccagccgtcccgtccgggagggaggtgggggggtcagccccccgcctggccagctgtcccgtccgggagggaggtgggggggtcagccccccgcccggccagccgctccgtccgggagggaggtgggagggggtcagcccccctgcccagccagccaccccgtccaggagggaggtggggggctcagcccccccgcccggccagccgccccgtccgggagggaggtggggggctcagccccccgcccggccagccgccccgtccgggaggtgaggggcgcctctgcctggccgcccctactgggaagtgaggagcccctctgcccggccagccgccccgtccgggagggaggtgggggagtcagccccccgcccggccagccgccccgtccgggagggaggtgggggggtcagccccccgcctggccagccgccccgtccgggaggtgaggggcgcctctgcccggccgcccctactgggaagtgaggagcccctctgcccggccagccgccctgtccgggagggaggtgagggaatcagccccccgcccggccagccgccccgtccgggagggaggtggggggctcagccccccgccgggccagccgctccgtccgggagggaggtgggggggcggtcagcgccccctcccggccagccaccccgtctgggagggaggtgggggggtcagccccctacccggccagccgccccgtccgggagggaggtgggggggtcagccccccgcctggccagccacccggtccaggagctgaggggcgcctctgcccggccgcccctactgggaagtgaggagcccctctgcccggccaccaccccgtctgggaggtgtacccaacagctcattgagaatgggccatgatgacgatggcggttttctggaatagaaaagggggcaaggtggggaaaagattgagaaatcggatggttgccgtgtctgtgtagaaagaagtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcattaccactccctaatctcaagtacccagggacacaaacactctgcctaggaaaaccagagacctttgttcacttgtttgtctgctgaccttccctccactagtgtcctatgaccctgccaaatccccctctgtgagaaacacccaagaatgatcaataaaaaaaaaaaaaggcctgtgattccagctacttgagaggctgaggtgggaggattgcttaaggccatgagttcgagaccagcctgggcaacacagcaaggccttgtttcaaaaacaatttttttaaagtagctggatgtgatggtgcacacctgtagtcccaggtactcaggaggctgaggaaggaggatcactagagcccaggagttcaaggctacagcgagctatgatcacgtcattgcaccctagcctgggtgacacagcaagacctcatctcttatagaaaaaaaaaacaaaacaacaacaacaaaaaacccactaaattctttacttttaaccatgtatgtaagagccagagccagttagcaaaccactagtactaaaaatactagtttcttcctcaaaggaaaagtgatctttcaagaaaatcctcaactgactattcatttaagacatatttatctacattattaaaggtgcttctgctttctcaactacaaataagaacttgagctttgtaagcaaacagacctgcttagaaatatggctcttccctgtactggcttagtgtccttaagcaacttacttatccccttaaaccagtttccttgcctacaaaatgaggataaaaatcatgtacttgaaccagatgtggtggctcacacctataatcccagcactttgggaggctgaggcgggcggatcacgaggtcaggagttcaagaccagcctggccaacatggtgaaacctcgtctctactaaaagtacaaaaaaaaatcatgtacttacctcacagattattgggaagataaaaaacataatacaggccaggccgaggtgggcagatcacttgaggttgggagatcgagaccagcctgaccaacatgagagaccctgtctctactaaaaatacaaaattagccaggcgtggtggcgcgcctgtaatcccagctactcggggggctgaggcaggagaatcgcttgaacccagacccaggaggcggaggttgcggtgagccgagatcgcaccattgcactccagcttgggcaacaagagtgaaacttgtctcaaaaaaaacaaaccaaaaacaaaaaccaaacataatacatgtaaagcactaagaacagtgcctgatatatcattaagtaatcaggaaatgttatttttattaatataataataaattactaaggttttgtgaagattaatagatcactgtaggcacaccataaatgttaactattatgtttactaagaatatgctggcaagaagcagtctttattacatcaaaacagaagtaaaaacggttacccagtttttttgaatatgcatccaacttgtaagctgcctgctcaagagctgctacctgctcttcaatgacattgatctgatccagataaggctgcagtccagcatctttaaaaacaaagaaaaacttcatgtttatatggctttattaacaaagaatataggaaaagagtggaaaagtaataatgctagtgtctctccagctatgctaagacagattaggtggcgtgacatgattctgagcactagcagggcagatgctttagaagacagtagctagttgatcaggcacgactgtggcccagacttagtgtctctcatctactaattttccattctttttaatttcttgctccttgagcaatctttccattactgattctgtttcttgggtactcccataccaagaaagagcaccctagagaaaagaaacacaaaaataataagtcaatggaaaaaatatattcgactactctaaattagtgttttccattatagagtttttggttttctgcttatagagtaatcctttatggatttgtaaatcaattcattagaatctggccacccttcctttgccccctcccattccaggaataaactgataaaatcaagatttagaagcaaaaatacccatacaaacaaaacatgctaatcctcagaatggaagaaattcatcttaaatttggaattcatttttagaaaacaagctcccacaagacaaggatgtcatgttccctcctcttctccatggccccaagcacaaaagaacattaaatacaaacatgtttaattacaaatattattacttacatttctggtttaagtcctttaagttcctactaatgtttatagcaatatctttcatttcaagatacttcaagctggtgagtttattcatattttccaggagcttatagtcttcactggtggcttgaaaattaaacagaagatgtaatgtctttaagatttgtcttaaatcattagaatgtgggagtataagctaagtggtagttcaaggcaggaccaaggaagtgtcaaaggagtgggccacttttgatctatgacatttataactcagcctatgtactctgaaagtctaggtagaaattcaggcaacaatcagaaaactatttaaaccaaacaagatccagaaggttcaggatcatggttacaaagggaaatgataaactcatgtcctaagaaaagggaggtaaaatagtcttggtacttctacagcatgaaaacatttaacttatatacatataatatatatactatcaggctgggcgcggtggctcatgcgtgtaatcccagcactttgggaagccgaggcgggtgatcacgaggtcaggagttcaagaccaacctggccaagatagtgaaaccccatctctactaaaaatacaaaacaattagcgggcgtggtggcaggcacctgtaatctcagctactcgggaggctgaggcagagaattgcttgaatccaggaggcggaggttgcagtgagccgagattgtgccactgcattccagcctgggtgacagagtgagactccatctcaaaaaaaaaaaatatatatatatacacatacacacacacacacacacacacacacacacacactatcagctaggacctcactacttcttagtaactcgtttattaccatgtataattctatattgcattttatgcagtgacatttccaaaccatctgtctgcttctcatatcctcagttctttccctatccccattcaaagcaaatggtctctactccaattttcctaaaggccaagtccattaacataagctgcttcaacctctctgccttacttcttttgttttttgtttttctctctgcctcacttctaaacttctctggatcttaatatcttcccaagaggcagaagtgttcctattcttgccaagacaaccccctcctcttgtggccttgaacccaaacacttctacttcttcagggcctctcttcaatcatctcctttcacttgcatttccaaattctccctctctcctggcaccttcctctctatgtatcaatatattcagatttcttccagctcaaaagcactctctctattctgctacatctatatcatttgctcagtaaagcaaaggagcttcactgctaaacaatttgaaaaagtagctgacactcactacatcctcttccttaccatttacttgcatatacccttgtagtctggtttttggccctaccatccagagattacatgctccaaagtcatcctgctctgctaaccaccaaatccatggcatttgctcagttcttatcctcctaaacctctccattgtcttggacactactgatctccttctctttgggaaatgctcatttcctttggctgctatggcattgtactacaccgatgattttctaatctctaactgctcttcttagatgtctatgccagatgctttcttatcagacccccttaactatcagttctcaactgtttctcagctgtaacacataactgatgtttacatgggtagcacatacctatgggcattcccaggcttatgctagaaactagcatagtttaagaggaaatatcaatttactcttaaattcaataaagcatttgtgcgagtaagaataacaatcacaggaaaataacaatttgcttaaaattaattatataataaatcatttggaaacctaggtactttaagtgttactaaaaacaaattaagtgcaccatacaggcattccctgacattttagcctaggctctcttacctacttctaagctcttccttggcaatctcatcctgcacagcgtccaatcacaccactacgaaagtgactccgaaatctgtttcttgtgctctgatcaatctctgagctctggaatccaatgtacaagtcacctgagttccctagttacatcaacaagcagccaacccaaaactgaaaacattttcacactaaacatggttcctctttccagctattttggctgatggcaccacccaggcttaaaacctcagatacatcttggtctgcttccatccctcaatatctacttaaacaagtcctataaagtccacttctgtaatgctgttgcacccatgttctcctttccattccttttaccaccactctgcctcagatcttcattacttttcttttcttttattattattagattacttggagcatgtaacctctggatggtaggggaaaagacaagactacaaggatggagtcgtgctatgttgcccaggctggtcttaaactactggcctcaagcaattctcctgcctcccaaagtgctaggattacaggcatgagccacggtgcctggtcctctattacttttcatctgaattattgctcatctctctctgttctctctcccccatatctacactctcatatttatactgctatcaaattagtctctctaaaacaaaggtcacagctaggcattgcgcctcatgcctgtaatcccagcactttgggaggccaaggtgggcagatcacttgaggtcaggagttcaagtccagcctggctgacatggcaaaacctcatctctactaaaaataaaaataaaaattagccaggcgtggtggcgtgtgcttgtaatcccagctactttggaggctggggcaggaaaattgcttgaacctgggagacggaggttgcagtgagccgagattgcaccactgcattccagcctgggcaacaaaagcgaaaactccgtctaaataaaataaaataaaacaagggtgacatattcaaacacctagaagccagcaagataacgtaaatgagtaaagtaagccaagtgcttgcacattaaatgcataagaaaattattcacttccatgaagaaatgtgcttccccttacttcttgcaatatgcaatcctcttagcccatcatttactttaccagttttgatagagccattggtatagaaaaccatttctgtactgctactaataaaaataacagtagagaacagtgatcaatggcacttgacactagttcccagtaaagggagaaaacagaaagtggtaaggacaaattagatagcactagtccttttaagaggcagctgctcagctctagtcaattatagccttgaaagaatgcaggggctagtagcgccaaatctttggaattgttaaagagaagccaaacacctacattttgttacttggtttctcttgctcaaaaataaacaaacaaataatcaggctgataacttacagagtcacagctgggtgcagtggctcacacctgtaatcccagcattttgggaagctgaggtgttaggatcacttgaggccagcttgggcaacggagcagacctcatctctattatttatttatttaggacagagtctccctccatcacccaggctggagtgcaatggcacgatcacagctcactataacctccacctctcaggtcaagcgattctcccgtgtcagcctcctgagtagctgggattataggcgtgtgccaccacacctggctaatttttgtatttttagtagaagcagggttttgccatgttgagcaggctggtctggaactcctgacctcaggtgatccacctgcctaggcctcccgaagtgctgggattacaggcatgagccaccgtgcctggccatatttttttaaataataataataataaaagaaaagtaatgaagatctcaggcagagtggtggtaaaaggaatggaaaggagagcatgggtgcaagaacattacagaagtggaatttataggacttgttcaagtagatattgagggatggaagcagactaagatgtatctggggttttaagcctgggtggtgccatcaaccaaaatagatggaaagaggatcacttgagctcaggagttcaagaccagcccaggcaacatagtgagaccctgtctcttaaaaacagaaaaagaaaaaaaaaaattacagattcacaacccctactattctgtatcaagccttttctcatagattctgattcacaaatttagcttacagtaatttcctggggaagtgaaacaatttaataaatgtttttgagatgctgtactggaccagacttcactttctttctttttcttttttctttctcattttttttgagatggagtcacactctgtcgcccaggctggagtgcaagtggtgtgatctcagtccactgcaacctgcaacctccacctcctgggttcaagcgattctcctgccccagtctccccagtagctgggattacaggcgcccgccaccacggccggctaatttttgtatttttagtggagacaggatttcgccattttgcccaggctggtctcaaactcctgacctcaagtgatccaccagcctcggcctctgggattaaaggcatgagccaccgcgccctgcccatacttcactttctgatcctcctccacacataggtcatgtgtccacttggaaacgatcaaacactagtcatgtcccaaaggatgggttatcaaatcctcagaccaaactaataggtccctaaatctgcaggtcactccccgttcctcaatttcatttctctttatcccggtaaacacatcttctgctttagccaaacacactgcttgcacataccacctcattcgctagttgtatcatctcccccttttccaccaataattcccttcacaaccctgctcaaaatacactttccccaaggaagcacttcttgattactgttgctggatatgaactcttttttgttattgttttctcattagtctatgttacagaggcctgcagagttgtattttctttctctcccattcatggcctcccccaacttccaacaggcctgtctcagggcatgcagggtaggaagggagctgcagactgatgctgctaaccatctcccaggcctcctgggccaaaccgcacccgaatcaacccagaccccgcctcacccgtcagttccccagtcaggtaagtggccattttggagaacatgtcccggcagagctcagtgatgtcagcttcagcaggctcctttgcttcctcagctgtctccacggcggcatcgtctgggccaagggagaatgactaagtgtcccgcctacacccggtgctaatccagccaaagcagcctgttccgacatccctccacttgccttcattccatcaagtcggctccattctccatctgccataatttcaagtccttcactgcgtccctgcccatctgacacatcaactcgcctccctcgcaccgcccctcgcccatacccggcacccccgctcatcctggcaccatcccagtcaccctgacaggacaaacactcgcgcgcagcgacaagtgcactcctctcaccagcccgttcctgccaggtgagccaccacacactcaacctcgcccacccgagacggagccccaggccccccaccggacgcttcctccccatccattccgggtacctcgggcgggctcatcactccgggtcgccagtacgccctcggctgccgccgccatagcggaccccgcgctgtttccgggccggggtgctgcgcatgcgcactgggtgtgccccgcccacccggccggccctgcagtcctgcgcctagcggtccagtccagcctcaggtctatgacacagcaaagggcgattccggagccgaaattgaagctacgccaggctgttgtgaattgatccactgccaacagtcgcgacgtctgggactgagggcgagctcatccctacagtcacaccctggagggatcactcatcttgtaccactcacgacccgtctgggaatagtcaaccctgtttgtggcctgctgaccaaaaccactgaagacggattgcccgctctcctgacactccgcactggagttagtcatcaaaagattgctcagggaatccaaagttttacaggttgtctcgtccacactttgggaaaccttcaggcattgatccctggtcctaaatactgtccctcccaatgtcctgagttaacaccaactcactggcccctatttcttaaactgcaggcaggcatctacttctcttcagttgatacagccttccttgaagaaagcttagactgtaacttttttagggctgaggatacactctggttatcttaattgcatttaagctgtttcacaagcctcctaggtgtacagagtacttaatgggatgggagaacaggagtgagtgaaagagatggatgagaagaagtgactggggagcaattgaaggtgcaaaatgaggagggataaaggccacagaagaagggataggagatattcagcaggcctcaggcaggctcctggacacccaaaatcttggtagtttcttttcttatccctggttatcctccctctgcaccctctcaccccaccccgatgccagtacatacacacacacgccagctaccccttatccccagccctcctaccctgactgtctccaccctgaggactgagtctcacttgtcacctgtccccacttttcctatggtgcaaccatagtagccactatttcaagccattcctgcgagccagaagttcttttttttgaaacagagtctcgctctgtcacccaggctggagtacagtaacgtgatctcggctcagctcactgcaacctccacctcccgagttcaaacgattctcatgcctcagcctcccaagtagctgggataacaggcacgcgccaccacacctggctaatttgtttgtatttttattaaagacaggatttcagcattttgcccaggcttgtctggaacttctggcctcaagtgatccacccaacatagcctcccaaagtgctgggattacaagcgtgagtcactgtgctaggcctagaagttcttatagcccagctccttcacatcactgcacctactctatacctcctagagagcatgaacctattccagcccaggcacatggatgacccacaatttcagcctttcttccctctataataccagaagcaaatgcaaagtccaagttttcctaaggagttttattgatagccaccatggaaacccacatggtcttatggaagaataatgtcagaacccaccacatattaattcaaagatctctgaatcctgagttcatttccttgcctgattcccttcaggctccatttttatctcctggttaaagcccactcagtttccaggttcagtggaccaggaggcagcctcttgcagaagatccttcatagactttgctccgggagtgcctcacacttaactcctctgcaacgttggaatctcaccacgggagagtctcctctcctctaaggcttcctcttctcttttatagggaacctctgtgggggaaaacgagaaacccatgggtgctagcaacaaatcttgggatgcacaaaggataagaataggattcactgggaagtaggaagacatctagataccgcctactctcttggtttctacctttttcacagaccatggctatccaggtgcttaggaagagccattaccctccctctctttatcctgtttgttaacttttttttttttaattaacacacagagctaagtacacagggagtaaaaggcccagtggaagacgttatttcacagagctatgtggcaacacacagaaacactgattcacaagcctaagcatgatgcccaccacacacagaaacattggctcaaaaggccagatgcagggtggggctcagcagcagccatgatgggacctgttgtcctagaagtgcaggggatgtggcgagggggcctgtgcggaggcagagggagggaagcctgctgtctgatgctttaggcccccttcctcaccactctcctgcccaccctggactccccaggggtctggggtcacagctggggctggctgcgggtgcttccaaatagcttgttccttctgttggaagaagaaagggacaaatcatttgaagaaatagtttgtgtaccacttttcttttctctctatctgattccagagaactcagactgctatagactgtttgcgtccctcccaaattcatccgttaaaattgtaacccccaatgtgatagtattaggaggtggggcctttggcaggggattagatagtgagtatgtagcccttatgagtgggctcacgcctgtaattccagcactttgggaggacgaggtgggtggatcacctgaggtcaggagttcgagaccagcctgaccaatatggagaaaccccatctgtactaaaaatacaaaattagctgggtatggtggcacatgcctgtaatcccagctacttgggaggctgaggcaggagaatcacttgaactcaggaggcggaggttgcagtgagccgagatcgtgccattgcactccagcctggccaacaagagtaaaattccatctcaaataataataataataaataaaataaaaaaataaaataaaggagacttcccttaccccttccaccatgaaagggcacagcaagaagacagctctctatgaatcaggaagtgggccctcaacagatactgaatctactggcaccttgatcttagacttcccagcctcccaaactgtgaggaacaaatttgtgttgcttataagccacccagtctatgataatttattatatcagcccaaacagactgacacagaccatctcatgtggccaaggcagcccttaggccagggcaagcaacttccaggccttatctccatgacccatctctgctgatacactaaccgctatgaacatgtttccccaggagcctgaaaacataggtctttcaaaaatgttcttgccccacccactgagtggaaaagatggcagagttcagctgtgaggaactaggaggaccaggtgaagggccactcaccacgcctggggagggagccagccaccccttcctctccagcattttcagctttgagcctacagcatcaatctgggacactactccttccaggacagtctccagctgcagaactctccttgtgagcctgtgtgggatttgagagagacgaatggagcagaaatctgtgtctgggggctggatgtctaaagagccagggttcacagaagggcatgtgtcctgaatggaacaaggaagggaagacccagccttgtaggcagaattaaaggggagcggaggttctccctggggtaggacagagaattggaaagttgtgggaaaagtacaagacagggtatcgtaatagaagtgttgccagccctgaaccagcctttcttggctgcacgtacatgtagaattcttctcctgaaacccagcctcctgctctggcagcctctggacccgatttgccttgtgggctgctcacaatagatcggcctagtttctcaatctcagtgttgagggccacctgctcaggaagtcagaggttagaggggaggagataactctgggaagccatcagctcctgttctatcacctactctactgggatctcaggaccaaggctcaggtcctagttcttgctattccccttccctcccagactctggagacaatagggtcagggtggtggtgctggaccaacctctggaggagtcacctctcaaagaaaacacaagatcctagaaggcttgatggatgaggtatttactagaggccaactcattttagcagaggagggacactaccagtgttcttggcactttctaggctgctgtcaccctgcctttgactttttttggtccacactggatagggatggagcaggcacagtagggacagccaagaatccaagtctgaaaattcccaagagaaggcaagtcctctgagggaattatcagtgattcttgggcagttggtcatttttccctaagcctgtgttttagagcatgattctcaaccttggctatgtattggaatcacctaaggagttataaaaagtactgatgtctaggccccacacccagagattctggtttaattggtctagagtgtgtgtcctgagtatgaagatttttaaaggccccccagggtattctaatgtgcagcagtttgggaactactattctagagagttctttactatctatgggagagttttcaggtgggtttgtgttctaggtatgttgggggaaggagagggtgagctatttccttacactgcctctccacccatcagcccagctcaccctctcttcctccaggtcctgtcgcattttttcctgttccttctcatccagaatacgattcccatctctgtcaaacttggtgaaggtggccgtgagctcagtgatttcatgctctgcgtgtcccagtctgagaagaggatgatgaaatgatttctgcccagctgtggctgtgacctctcagttatggacttcctcactcttttgcttgactctggcaaaagttttgcttctggtaaagaaggttctccaaagtctagcaatcttacccccaggaaaacactcagttcagttcagtttcttcttcctctcctgactcctgctcaccaggttcagggcctcatgacctcctacagggattattgcaaaatctgtttgcctctaaataacctgctatcccccagcttcccctttactccctacccctgaaatccatcctccataatacaactagagtaattaacctttctaatatgcagatctaaaaatgtgccttcttgaaatcccttctggcaccctattcttttggcagagtggtagtgtggcctttctcagtgtggtccttgcctgtttctctggtctcatctcctgctatgaccaccacctgtccccgcccctttatttaatacttagcaatgctcaactacttattcctcctgtgtatgttgcttggtttcagacctctatgcttttgtatgtgctttcatctcttcttggaagagccttcctctgcttgtccacttgtgagctattcatcctccaatatcctatttagacattacctcttccaggaagccttcccttaagctcagagatagaattgatcaccctctactcctagtcacttctgttgaacttattctgtgattcagtttatttgcaagtctatgagctcttagaaaacaaagactttgtcccatttaattacgttgtctcctaatcccagcactttgggaggctgaggtgggtggatcacttgaggccaggagtttgagaccagcctggccaacatggcaaaatcccatctctaccaaaaatacaaaaattagccgggcgtggtggcacatgactgtagtcccagctactcaggaggctgaggcatgagaattgcttgaccccggggaagctgaggttgcagtgagccgagattgtgcaactgcactccagcctgggcaacagagcaggactttgtctcaaaaaaaaaaaaaaaattatgttgtctattactcagtgcctgatctgcagctggtgctcacaatgtatttgttcaatgtgtattaatatgtttgactgggaatcagggagtgaatggctaaaggaatagatgagtgtttgtggggaagcatagaacaaaaatcagagttttgtgggagtggggtgtgtattcaatgattagggaattattacattgtttcctaagagttgttcaacaagatccaggatgttataaaccacggtcagagatttttaaaccaagggcacagttctgaaggtcaggagcggagacctacgggcaaagatctgaagcctgcaagtcaagatcagaggcccctaaactaaaaccaaaggcttataagcaaatgaagtatggttgagggttgaggacttaagagactgttattagagaaggctgggtctctggttgctcactcccttaaggtgttggtgaaatcctcaaactggatctcctgctccccaccctgcaggaccttctgcacatccgaaaccctctccttcctcagacgcagtcttagtagggtcttgttgtagccctgaaagggaaaggaaataggcacaagttctcacaggctgctcactcatccctggcccccagccccacccatagtatgccaggcttccaaggataaatttaaaggcacacaagggcacaggcacctcaatcagtcaggaacagaccaggacacagagccttagactggggcactgatggaaatgtgtagctcaaggagattgagcaatcacctgtttcaggaggtcagaaagttgcagctcatccttctgtccagccagctcctccttgacctctgaatatgtgtcattgatgatggccaggaacatgttctggaaaatgaagtggggacctgggtcctcacccccagacccactgaaaggattgagcccactgaccccattaatgtccaagacacgtgttccaaaggggtcagtgctctcaaccccagttcggcagcccatcaatccctgcctctcagggtccccagagcccagcctttcagcacagttctgttagagatggatcatgcttcttgaccaacctggtgtcctcactctcagttgctgtagtaacctttctgaccacagagatacaataacatatgccacagacctcctttgtataagggcccatcaatcattggaactagaggcttttcagggtgagagtacaattgtgatctctttttcatctaccccccaatccatatctgtatccccatccattgatcaaataaagaaaattgctggccttgttagtaaaaataaaatccaagagctgggcacactggcctacacctgtaatccagcactttgggaggccaaggcaggcagattgcttgagtccaggagttagagaccagcctgggcaacatagcaaaacactgtctctacaaaagatacaaaaattagcggggtgtggtggctcctgaccataccagtggtcctatctactcaggaagctaaagtgggaggatagtttgagctcgggaggtggaggttgcagtgagctgagattgcaccactgcactccagcctgggtgacagagtgagaccctgtctaaaataaataaataataacccagatttttcatggttggcagggagagagaactaccaagtagtggcagtagaaatcagcatgagatccccagaggaaggggagtcttggaggacggtcgtagacgcttccaggtgcagctactgctcctcataaggcacttttctccccatttccatccttggagaatgagggtttgattttactgagggagtctgcaggttcccttatactctgcaaacctgcaaactgaccatgctggctgtactacattaaccatctctcagaagatccagacatcggcccccccactcactctccatccttgatttgagaaacttatcaatcctgagtgagggacatactaggaccaaaactccaccctgcaggctctctatgtccccacccctcagagagaccctcaccaggagcacgaagaagacgaagaagacataggtgacaaagtaggcagggcccaggatgcggttggcattgtcgatagcattgtagtcaaagtccccgaggattatccggaactgagtgaaactgagagaccaggtctgggctttacccagagcctaacaaacaccccccatcccactttcctaatcacagagagacccctcaccacacgttcaccccaatctgatagacacagggcagggtgcttagattatttaagcacacacaccagggcttctggagaccctcacacagatgctttgaacacagacatgcagacacgcacgtacccatcttccccaaggatacatacacccgtggagctggagggtgaggggccagggaggagtgaaggggacaggacacacacatgcacttgatgaaagtgctaaagttttccacttgggtcccgaaaagcaggtagccgagttgggcataggcgaagaaaacaatgaagaacatgacggcgaagcccaggatgtccttggcacagcgggccagcgtggaggagagctgggtcatggttttgttgaagctgatgtacttgaatatctggaaggaccatgttgaaccaagggatgaagaaggaaaagggaaaagcattgaaaagtccatgccaagggcctatggaggccacaggagttgccaagccagacaaagaaaatgagacacatattgaagaagggagaatgatacaaaaattagctgggcatggtggcacgcacctgtaattccagctacttgggaggctgaggcagagaatcacttgaatctgggaggcagaagttgcagtgagctgagattgcaccactgcactccagtctgggcaactgattgagggacatactgggaccattaaaaaaaaaaaaaaaaaaaaaagccaggcacggcagttcactcctgcaatcccagcactttgggaggctgaggcaggtggatggctcaaggtcaggagttcgagaccagcctggccaacatggtgaaacctcgtctctactaaaaatacaaaaagttagctgggtgtggtggtgcatgcctgtaatcccagctactcaggaggctgaggcaggagaattgcttcaacccgggaggcagaggttgcagtgagctgagatcgtgccattgtactccagccagacaacagagtgagacttcgtctcaaaaaaaaaaaaaaaaaaaaaaagtcaggggcggtggctcatgcatgtaatcctagccctttgagaggctgaggtaggcagatcacctgaggttgggagttcgagaccaccctggccaacatggtgaaaccccgtctccacaaaaaatacaaaaattagccaggcgtggtggtgggtgcctgtagtcccagctactcaggaggctgaggcaggagaatcacttgaactcaggaggtggaggttgcagtgagccaagatcgcccccacttcactccagcctgggcaagagcgagactccatctcaaaaaaaaaaaaaagaaaaaaaagaaaagaaaagaagggagaatgagtgcgccttgaagcaaagctgggtgtgggaatcccaggtaccttgatccaggcgaagaagaggttgacagcattcatgttgttgtactgtgtctgccagaaggcgaggaactcaaagtctgcatacgtgtttggctgctgcaggagcttccccatgagccgattcacctcgagggttcggaatatgtggaagcccacagccacaatggagagctgtcacacaggggtcatgggggtgtcagagaaggcaaggggatctcaagggaagttccaagatgaggccccaagggagagtcagggtaggtaagacaggtgggaaaaaagccatccttgctgacttgttcactatctcagtttcaaatggaacttggtaggatgactggggagcatcttaagtgttccaaagcccaagagaaggcattggggacaatggtaaatattaatgtatagattgtaaagggctgtagggaactggaaccagtcatttccttccgctcccaccacttccaagctttggtcaggaattgaatgtgtcttgttaataggagggagatgaagatgaaggggcagaatatttgaatagaagacaaaaggcatgggttt

SEQ ID NO: 1225 - DNA, 51618 bp, Homo sapiens
agacgttgtgtcctttggccccactcaagtggatatagtcaaagaagtttaggaacccctgagttaaggactcctagactgccctacctcttacagcttgaggctgcagatccaccctgaccgtgctcaaaatcctaagccaatgcagagtcagaagcagctcagaagcttccccggaggtccttgctgagaattccctaaccggcaggcagttcctcccgccctaggaagattttgtgtatagcctcctttgcatagtgtccgctatgaattctcttctctggctccattgcatgacaggaaggcaggagaggaggacagaaagctgctgcttattttcaagcttatctccagctgtcagaactctcattaggggctttttgctttggacttaatttaccttagtcctcacagcaatgctgtgatgtatgactgactctactttgtagatctggaacccggctgccctgacctggctcacctcgagccctggtctcccctccatgctccctcagcccctgaagtcccaaggaacccaggactccactcacctgaacaaaggtcacttgaaaactgggaaagggacagaagctttaaaaagcccaaacgaacaaacaagaggttgacaatttaaaaataaagccaacacaaactcagcctggaatggaagctcctgatggagtcatccttagaattcaccacccgcaatttaccccaaatcctgggtgacccctcctccactgctcagactgttcttaggtacagctgcttcacactgcatcgtggccctgtcatagatgactaagccatcagtgggaggcatctttccctacataccatctctttttcccggctcagagtgtcttttctaaaccatgtccttgctttacatttccagggggtcgtccttaacagtgggtaggtaaccctgtggtgacctgattcctgctcagctgtgagctttttctgtcctctggtgggggacagacactcagcattccagacagggttagtggtgggacttctatttatttaactactaatcctacttatgtgaaattaatttgctctcctattataactcaccttgcttcctgccctgaccgtctcctgtaattgacacctggctgctccattgtgctcctgcttcctgggctaaggggcagcggttggaagccaagtcttggagtgactcacattaggaggctgctctatacagaagagaggtttgctcattatagactgaggagggttactgtaaaaacagcggtggttttttttttctcctaataaccagttcccctttaggctagccctttccaaggaagtttgtgtactattattaaacttcttcctaactccaaatatgggctgctccagtttctgcagcgtgcagatgagtctctggcttctgtagtagaaatccaggcccaggtccccatctgcctcggtccttgatgagatgcaggtcatccacagtctcaaagcaggtagaggggtccatgctgccccaggggacaatacctacaaggtgttacaaacacctccagccaaaaacaggtgctgccactaaagcttcccagatccaggttccacagccaggatccgtcttctgtctgtggcagaggtgaatgaggagctgtttgcattgaggctgcagagaacatggctgtattatggagatgagaaggagccacgctggcctctgttcatggccctccactgagcacctgggcttggcagacagaggggtgtagtagtctgaagatctggctctagcctccaagtgagaagctcccactcccaactcatgtccatatctcaactgctcatttgagtccttgggagagggcgaggggaggtggggaggaggaagcccaagagtttgtcccctggcctctgccaacactgcaaatgtggccactttaacaggctaacagactggacgtcctcccatgtgtgtaaaatccccatacctcctccagcaaactccatgttggctgtagaatgaaggccaccttctgcccggcatggcatctgcagcttgaccctcttatccggccttattctcgcctttgctcttcacaatcctcatcccgtccgactgtggctctgaactctctgcccatccctccatcccaccgttgtcacatggtgcccagaagaccctgaatgcccaccttattcttttcactcatcatgtctagtgcatccttgaccccactctagctcagtcccctctgctgtgagaaatacttcctgaccctaccaattaacaggcagcttgtctctccaaattccactagtgtgctcacacagattcatgcagctagagttgttaataattcttatatgagtgttctttgtcgtcctccactagactgtaaatgctttgcaacaaggaaccattccttaacattcatgtatagccctacacaggtggccaacaattgatggaacttgatgaccctacaaccagttgtccactaggtgtgtccagagtgttgtttcttgcttagagcatgatttttgctgtcagaaggacctcagttcaaatcttgactgtgtcaactaccagctctgtgacctcaggaaactatttaacctaactgtgtttgtttcctcttctgtaaaagcagagatgtacagtaatcggcccccaggtttattgtagatttaaagcatgggaaattcttgcttggtgcagtacctggcatgaaatcaaggctcactaaatagcagccattattattatcgggttagtttggggctggtgcctctgctacagtgagtcttaacaagcatcaaattaatggagatagatcctggttttaggggaggcatcctggagagaatgttgaagtgagttttggaaatccgacaaggagagaaatcagaagttaacccaattgcatttctcccaacttttcaacagccttcaggcatactcatttttagctgattctccagatattgctagaacttttcccagaggcagatgcagagtgactgtgcagactctgaaaaacagtgcttgtcacctgaccttaaatgtaacaaacaacccctgaggaaggtagctccaattacagtcatgaagttggaggagccctttcaaggcagattgatttactggaccagaaatacagctcaacatcccacacacagatttctgcctttggcaaactgccctgcctgcttccttctctcttgccctggcgtattgatctgcatgtgtgagttggtgtagtttattgtatagggttgtgtgtgtgtgtttgtgtgtgctgtggtcccaggatggaagctcctagattgggagccctctaattgagtgatgtccaaagccttaatcgagggaaatcttgctccatttctttttgtggtggctttaatttcatccctctgcttcaggttggcatagaatgttccagaaggcctctcactctgtctgattcctgtgcttctgagtatatgtagtaacatgttgttgtataaggaaggaaaaaaactagtttttgttgtgtgccttgtgccagacaaaaaaaaattaccatctccatgagtcacataagaaattgagacttggaagcattaggaacatgcctaaaatccaatgctggtagagccaggatccaaacacaggtgtgtctgacttgatgccctctgtcatagtgactccaggcttggccctgctgggagatggacgcccagccactatgggagtgaagtccaactcatagggtcattttgaatgggaaaactttgaaatctaggggcataatttcaattcatatcatcgtattttgcacccatcatgtgcatggctatgtggccttctcccttgtattagttattgattgctgtgtgaaaaattagtacaaacttggtggctttgaacaacacacatttattatctcacagtttccactgttcaggaatctaggcacagctggactccctgttcagggtgtcacaaggctatactcacagtgccggccaggctgtgttctcatctggaagctcaactggggaagcatccatttccttgctcacatgtgttggcagcatccattctctgaggtagtaggtctgagagcttcagtcagctggaggctactgcagttacttgccacatggggttttcaacagggctacctgcctcctcacggccagccaggaactgaaattcctgcacgattatgctgtgtgtgatataatcacatacctcctttcacctttgtcatattctgttggttagaagcaattcatagacctcacccacccttgaggggaggggagcacacaaggccatgggcaccagtaagcaggggtcctgggtagggggcaccctacaggtctgtccaccacatccctctttccctttctcctcttctccttccttaccctctttcttcatttcccctttcaagtctagcctcagacatagggctttgccaataaatattagctttagagtaatgatgttaataagtgacatcactatattccaggcactagtttttttaactttctattgaagtataatatacatacagaaaactgcaacaccctaagtatagaaaccaatgaattcttcagaaactgaacatgcctatgtaaccatcacatagatcaaacaggaagatacactgctagcaccctgaagcccttctcaggcttccttctaggccttaacaccctcaatggtgaactttttttttcaatacagcgtctcattctgttgcccaggctggaatgcagtggtatgagcatagctcactgtagcctccaacccctgggctcaagtgatcctccctcctcagcctcccaagtagctaggactacatgcatgcactaccatgcctggctattttttttttttagaaatgaggtcttgctacattgcccaagctggtcttgaactccttgccttaagcaatcctcccacctcagcctcccaaagtgctgggattacaagtgtgagccactgtgcccaaccaaaggtgaacttttaacagtataggaactattaatttagactgtttctgtataaattataagcagaatcctacaacatgtattatttcatttctggtttctttgactcaaaatagttttgttgcatgtggttctagattgttcattctcattgctgaatagtagcccatcatgcgaaggtgccgcaatttacttatccgttctactttcaatgggcattggggtagctttctggttggaggtattacaagtagtgctgctaggagcagcctagtatgtatcttttggtgaacaccagtaagcatttctgctgggtatatctgggagtgggtgtgctgagtcacacagtgtgcatattttttgagctgtgtttatgtatatacaatcctcacatccctctatgggaggcaacatcatcctctttatacacaacagccttctgggtcagacctacactttctccatgggtcctgaaagatcagacaggaaggaaggccgacaggtgcagtgcagaaagtgtaggtttcacctatcttttcactattgacaaccttcttttttttttttcttaagagacacattgttttgaagacttctgcataccaatcaaatgtcctttggttagtctcatttaattcctctagtgattctcttattactcaaagacacatatagccagctgcagagctgctggtctgacaacctacataacagcattgcctagtttcagataaaaccagacaaaatccaggttcaggtccaccttggtcacctccttacaagaacacaggatttctgttgggctgtgtaaacactagaagatgccgccctttccctttgtgatgctgcagggaccttagatgaccaaagacgccacgtctccactgaggatctcttagaccgagaccaggtctgaagcgctctgacttatgccaatcgatatatatcaatgcataagccattcacacaccattttgaccaggcacaagccatcatttttaaacaaaaattcaaagtcccatccatttactttgggctggttcttatgctatgataggttccatgaaggtagtgaggaacattttccaagctgctgccaagtggtcagaaagacttcaggctactgctagcagactgtactttggggtatactttgttctttcccatttgtctctctgtttctatctctccatctctgtctttctctctgtctctgtctttctctgtgtgggtaagtatgttttttatagttagtatatgtaatgtatatttacatatatatgagagatctgtctacccatctatcaactatcaacaaaattcaggtcccattatatcttactttttattagcatattttttccatgtgataaaagaaaagtacattcaaaaatgtaacttttaaagttattgtttgatattctatcacgtgccgttaccatgattaatttaactaattctctattttgggacatttaggctgtttccagtattttgccattgcaaataatactgcatgaatatccttctacctaaatcctcagggacatttctgatattttccttaggctaagtgataagatgcagaataacccacaaagcacacggatgttggcttttgagtctcatgatcaaatacaaatttatgccgctgtcaacagcatagaagagtgtcttttttgcccacaccagtaattttctatacaaatattttttctcaattttataggtaaagcatgattgtttggttttcattgcatttaacggattccttgtgagtttaaatatttttttcaggtttgctgtccatttgcgtttctccttgctttgcattttgcattcctttttctcatttcatgtgtctccactcgctcacagaatgacatcctgtgctcagcaggtctcttttcccctcattccagacatcagggcaggagtattacgaaggtcccacagaataacttggtaattgtcacctgccttgcaaattgaacatatgttagaaagatgcacgctcacaagcccacagccggcttggtcagccacatctgtcattcctcccaccaggaaggccaaattcctcccagagctgtaaacctcacatctcactgagtctctggacaccatcacccaggggctgtgagatcaggagggcctgctggtaactacttaagcagctgaggttccagtgcacttcagggttttacaggactatgcctcgaaggaagtgttccctgctgctctggggaaacaggcaattgtaaatcaggtaacaatgaggccctgacttatttatccttctaaaagttttacatattagggccagcaagggacacatttgtccagttcatggctgatttgcagagtcagcactttggtaagaccagcccgccttgctcagcagggtcggcatgtgctgggggcttggaggaaccaaggcaccctgtagtgctgaggccttatcttgtctctcggtctggactaaatgttatctttcagagacatgagacacaggatgggaagtcaccaaacagtgggaaattcttcctcttggtgctaaaggtgctttttcccctctctccctggcctcctccaagttcctcctcctttacagggaacatttgcctggagaacagctgcacccttgtgatcccagaaatgacagggaaccattaaaacaggaacagcagtgataaaagaagttttcgggcctttggcttatactaattagcaatcaaggccaaagctgaacccaatgtcccataataaattatgacacatccttacaagagaatattaggcagctattaaaaataatgttttcaaagaatttttatggcactgaaaactgcttatgacatgaagtgaaatgaaggaaagatgtaaagcccacatacagaacacggaataccaatgacctgaaagactacctggaaatattgtaaaatgggaactgcaattatctctgcaggaaaaattatgtgtgcattttatgtttctctcttattatatttttaaaatttcctacattaggcatttgtaacctttgtttaccaaaataaataaataaagtttttttgtttgttttttattttttgtttttttgagacagagtctctttttgttgcccaggctggagtgcagtggcgcgatctcagcttactgcaacctccacctcccgggttcaagcaattctcctgcctcagcctccagagcagctgagattacaggcgtgtgccaccatacccggctaattttttttttttttgtatttttagtagagacagggtttcaccgtgtgagccaggatggtcttgatcccctgacctcataatccgcccaccccagcctcccaaagtgctgggattactgacgtgagccactgcgcccggctaaaaatcgttattatttttaaagaccaagtctgatgtgagctgccccaggcctttgaagattttctatgttcatttctccctccctccctccctcccttcctttctccttccttccctcactttctttgttccttcttctctttttcctctttcttcctccctccctccctttttttctctcattcttcctccctctctccctgtcttccttctttccttccagaaaaccagcaatattgaccaaaaacaaattttcaacaagatcaagaagttgatggtcctgatgctgaatgagggagggggcttggctactttcgaaaaagcttggggatccaaacattgttctgcactgtcctggtcacaatgcttctagggggctagtttcaattctgggtgccaggttaaaaagtatatagaaaagatcaccttctgcagaatacaaaaatgacaaaaacgacaaaaacgatttcatcaataaaagccacagcagcagctccaccatgtactgaatgcttatcatgtgctagatactggatggaaacatgatctattgtttgatgtgagctttaaaacaactcttttacagctgagaaatctgagtttaccaacattaagtaatgaggtggatctatttgatcctgtataaatttgcccaggaaatggaggaagggaagctttcccagggaagatcctgccttatctgcagatgggacggcttggactgtggccttggctgctggaactggagaagctggctgggagggctgcattaccacgggaactctggatggattttcctggacaagggtgacaattcaactctctttagaattctagaggtttatattgaaaggtgttggtgatgcaacagacttagctcatgggaggcagaagcctgaatgctctggaatcaggaagaccgggctcccagacggcctcagtggaatccactttgcagtcacccttggctgctttttgcctgactggaggattctgtggcttgagatgcccagcattgttcaggaccgtggcctttgagggtgactctgtggatcatggggaaattgggtccattcttatagcttgccaggaatgtgacagcggttgactgggccccacctgggcagtcctccaattgttggtagtgggggtcccaggcaaggacaggggatgcttggatcagactcttccactggttagatggactgttttttgttttgttttgttttgagatggagtctctgtcgcccaggctggagtgcagtggcacaatctcggctcactgcaacctctacctcctgggttcaagtgattctcttgcctcagcctcccaagcagctgggattacaggcgcccgccaccatgcctgtctaatttttgtacttttagtagagatgaggtttcaccatgttggccaggctggtcttgaattcctgacctcaaagtgatttgcctgcctgaacttcccgaagtcctgggattacaggcatgagtcaccatgcctggcctttaaatggactgcttcttagctgatgtaagaattatgagtaccccagagaagtctatcccaccaactaacacagagaaaaaatacaagcaaaataatctgtatgaaatattagttttaataaaacagaaccagtccatgtatggaggcatgggcataaggtcaacttgcactaaatgtaactcgtacgttttttctaaaataatttcttgagcattgtggtggccttatgtactaacccgaagctgaacttcctgggaagctgatccaatggagcacttggaattcaggggtggagtcttcttcctgggtcagagctggttcagggtcacatgctcttgaggtccctaaaggccacatgtgctgcatttcgcccagcagctcccatcacacctcctcctggaagggaatctcctatgaaccaaagctccgctcaaaaacctgccagggtgggggtggggacagggcttacagagatccagcaacaaagcagagtggggctggttagaggggtccgggggcatgggcactggaatcacctaagacagccgctcaatagattctggctccctccaggcttcctgcaccaaaggtctggggaggggccaggtccacagcccacagtctcaacggctgagggtggacgtgctggatgggcacacgcttagtaagtgaagttaaaatttcagaataaggggctggggggagggggaagatgtgtaagcccagactctttccagggtaccaagtctacacagctgagagaaagtgtgcatagcaaatagcctcagccagctccgttaggcttggaatgcgcacaagaaagaattgtaaagttgaagaagttaactttatccatccttcctggtctaaaatatggatggaggcctctaatcccagcactttgggaagctgagtggagaggatcacttcagcgcgggagttcgagaccagcccgggcaacctaacaaaacccatctccacaaaagaataaaaaattagccaggcatggtggcacacacctgtagtcccacctactccagaggccgaggcaggaggatcacttgagcccaggaggttgaggctgcagtgagctgtgatcataccactgcacctccagcctaggcgatagcgtgaagccctgtctaaatatatatacggatggggaatttagggacatgggtctctcacaaccccacattggaatgtggtgagatgcctccaccaggatgcatccccaggcctcctgaaggggaggtgtgagctcaactgtgggctgtggtcagcctggtggaggcagcggctgtgtgctcacctgtgcatggataattctgaacacagggcagcttatgttgggagttccctgctcccctccctctctgccaccttcattgcttaacttcctccttctccaagtctctggcctccagtgagccctcccagtccccacagggtagtgggactccaggtcactcaccaggatgagccccacttccacagagatacaggccctggagagggcagcggtagccagaatgcaggggcacggggcgggcgaagtagagctggtccagggacatggcgcagtggaatatgttctgcagaggcagggccacagtcatcagcacaggagagttacagcctttcctgctctggctgggtttcttcccctcccctgttcttcagcaaatgttcttctccttccaggatattttcttgggttttaaaatgcagaaagggaaggagatgagacggaatgggcacatgccctggggctgggagtgaagttttccagaggctttttgaggaagaaagcagggtggggaacacgaactgaacgggaaggaaaagagggttttgctctctactctgcatccctctccctctgttggaaaaacagaattgtctgacttattgtggctgttggcatgcgtctctgcgagaactcccttctctggccaaggcatccacctgagcccggaccccggtgtccaagctccagcaggatcactgtgaatggcagacaaggggcaacggagcccgagcacggttctgcccccctggcttgggtgagaccagccccaggctgagaagggaggcagcatgggacaagcgaaggtcagactcagggggcaggtctggacaagaagcctgacgtctgttgggcatcctcacaggagtgctcccccactgccctcttcacctttccccaaactgaggccatcctcttccctcgagtctgctcctccccatcctcctgcataagtgaatgacaccaccttcctccccctggcctctgtgcctacccttcacatcacctccaccctgactcctatgtgcacactgtcaccaaggcttctcaagtctgcccgccccatgcctgctgtacccagccattcccttccttcccgctgcctggccttctttcctctatacctggaccagtgctgttcagtgaacatgtaatgggagctacatatgtagtttttgatttattagtagctacatttaaaaagtaaaagcagagccggttgtggtggcccatgcctgcaatcccagcactttgggaggccaaggtgggaggatcacttgagccccagagtttgagaccagcctagacaacacagggagactcatctctacaaaaaaaaaaaaaaattagccaggtgtggtggtgcatgcctgtaggcccagctactcaggaggctgaggtgggaggatggatggcttcagccccagaggtcgaggctgcagtgagccgtgattgcactactgcactccagcctgggtgatagaacaggacctatctctagaaggaagagagggagggagggagggaggaaacaaggaagggagggaggaaggaaggaaggaaggaaggaaggaaggaaggaagggcaagctgatgaaactaatgtcaataatatattttatttagcccaatatatccaaaatattataatttcaacatgtaatcaatatataacttattgatgagatattttacatttttttctatactgtgtgcattctacacttgcagcacatctcactttggcctcagatctttcttttgctttttttttaaattttctttctagagatagggtctcattctgttgcccaggctgaagtgtaatgacgcatcacagctcactgcagtctcaaactcctgggctcaagcgatcatcctgtttcagcttcctgggtagctggaaccacaggtacgcaccaccacacctggcggggtttttgtttttgtagagatggggtctcactacgttgcctagggtggtctctgatctttcaagtgctcagtagctgcaatgaggcgattgaacctggcctcctatctggtctccctgtctccaatctctagtttttgataaattgacaagtctgaggatgtgctgctgccttgagaagggggtgctctctctcaagaaagtcagatggcagagccagcatagttgtcaaggcagagggccacaatcctggtgaccttctcagtgggggctgtcctgcctgtgtttctgagcccccactagggatcccccattccctcggtttgaccgcttctctgccctctctcagccggggtccctgccactgtcctcccttcctgatgaaagctgagtatggagggacaagataaagcagagaggtcatagccaggaagtgagggtgcagagggaaggctatggtgagagaccccctaggcttatacatacccctccaggaagcccgaagattctctccaaatctggtggtgtgaggatgtctctgccaaccacagagtccttgaagccaggggcatagacctcgatgcaatcaaacactggggtgccaaaaacagagaaatgagatggtgttaggaagaagaggaggcactatgggtgtacaacttggcaaatttactaacagtcattaaattacacacagaaatgggcttattttatcatatgcaaattatacctcaataggtgaaaaacaaaaatcagtccacaagcaaatgattaattcatcccaaagatgcatgggtaggccagtccagtccccagttttccccacttccctaccccaaccttaaacacgaagctgctgatctccttttgcatatgcagcttttttcacctcttcacttttctcaagctgttttttttttttttttttttttttttgagacggagtctcactctgtcacccaggctggagtgcagtggcgcaatctcagctcactgcaacctccgcctctgggttcaaacgattctcctgcctcagcctcctgagcagctaagattacaggcatgtgccaccacaccctgctaatttttttatgtttttagtagctacggggtttcaccatgttggtcaggctggtcttgaactcctgacctcgggtgatccgcctgcctcggcctcccgaagtgctggaattacaggcatgagcccccacgcctggcctgatcaagctgtttctcttgcttggaatgccctttgctgcctggccagctcctagtcatccttggaaacccagcttgaccatcccttcctttgaaagccttccttgtctctctggctcatgcgtctcctttggttcgtgcagtcagctgtgctgtaataaaaggtttcttaattagtctcctccatcccttgctagactgtgagcaactggagggcaggaactgtgtcttcttgactttcttagcccagttcctgacccctgcagtcaactatgttgacttgaggttcccttgactatttcctccctttggaatggcacctgcagttgtcaatcctgaatggggcagtgaggaggagcaggcccagttgggtcgcatgcccggctgtggctctggaggcagaacgtgcagctgtctttacctctgtctgcataagcgtctctctcctgctcgtcccaggccttgcctccagccagcgtatagggcatgtactgagtgaagagggagactacatggcagccagggggagccagggtggggtccagcgaggaagggatgcagagctcaatcacaggcctgtgcgggcagggaggagacggcaggtctaaagagcagcagtgcggagggtagggcatccgagatgacttgggacacagtggaggccctgagatgacaccaattctgggcgattgtcgctctacagccacagtggttgtccacctgcacgggcttagcggctgctagcgtggtccagagcacctgtgaggagctcgcctgaccccagacccccgaatgcatggcctgtccttgcctgccttcatcacacgctgtgctctaaccacagctcccaaacgcaaatgtctcgaaggtccacacagacagtgggagtgtggaaaggggccaggcctaagacagcaggcgcccaagcagccagatttcagccaggctttagtggcctgactgtcttttccagagcagaccaatggaagacagagctgctagggctgccccgagccccagcagagctgtgacctgcttcccaccccaccacctttgcctgccacaccttttctacctggagcatgttctccctctgatctccaaatatgagtctccttcaaggccacgggaaatgccccttctccctgcgtccctcagctgcaatgttctcgctgaactcggatgtccaccagggatctcaaacatcccctgttcaaaccccaatgcctgattagcctctaaaatctgctccacccccaccgcctcttcctcttttcagtaaatggaggcatcatttcacagtcgctcctttttttgacccacatcccactccctatccaacagaaagtcctgttggcttcaccttcaaaacatacccagtcttccaacacttctcatcacttcccctgcccccacccttgtccaagccactgtcctctctcccttggattctgcaacagtaacccattgcaacagatgccttaactttttctgcatacagtgtccaggttggtctttttaaagcataaggcaggctctgcacaaactttcctggagtaagagccagggcacttgacaagacccagcaccatccgagacccttcattcccaggtgctctctctccagccactctggcctcgtccctgtgcctcctatacagcagcacactcctgccccagggcctttgcacctgaccttccctctgtctggacgttttttccccagatacccataagatctgtattctcacttccttccggtctccgctcaagtgccacgttattagagaagcctttcctccccttccctgcctatttttctccacagtgctcatcatcagtgcttacttgttgattgtcttcctctcatggatagagagtcaacgacctgagactttcttggctttgcttgctgatctgtgcccactcactgaaccaagcctggcacagaatagagaccccagaatatttataaatggatgaatgaactttgccctatacccttctttccaggcgcacatcttctttaccacatgctataaatatttgtgtacctgtcctatcataagctttgtgtcagtttcatgcccctgccccgctaattctcccagcccatacccagtacagagtccagcactgagtaggttttcaacagtgtgtgctggacagcggacaggatggaaaggcacttgctcctatagcgcccctgcctgttccagaagaatggaaatacagctgcagtgggaggtgggaaatgcttttagaagttttgcaagaaggcagattatcagaaaaagaaaggctacggagcaggggactcggtgagtgcgtgctctctgacgggctctgaatgagagaacttcctttgctctcccagaacacattttctcctcttcttccccagccccagcactttcctgggcagtgctctgcccctctgccccttctgctaacctgagccgctcttcaccccttacctgccctcatcctcagatttttcacctgggatgcacttcctgtccttaggagtatggattttggcagatcctaagtcactgtgaaggttgaacaccaggcctgatccctgctgtgggtggcatggacagccccgcctcccaggcccatgtggaagaacatcagggaacataaagtccagggcccctacctgtgggaaggcaggccatccatggcatcttcaaaggcctgatgaaggaggagggtgtcttcacagttcaggtggatggagcattggtgatggggcagcggctggcccctgggagcattgggggccgccaggaagctgggcagcctgtctacggccactgagggaccaaagaggagggtcaggtcttagccccacaaggtcctccctctacagccagcaccctgctaccctcagtggcggacgggagtaggaaagtatgagcaagtgtttcaccttctgaccaggctgcagggggacacaggctggaggtccgggaatggagatgatgactgagttcagctgcccccagcctggaggtttctcactcagatgggtcaaaggagacagtgctgcaatgtggtgtgcctcttaccattgatcttggtgacaggcgaccgggtgtccagctgagagattctctccaggaactcctcaggaagccactcctggaaggagaaggctccatgaaaggcctcagatgtccaaggccccaaggaagctgccttctttctttgctcaggaagatccctcagtcgctccctccggaaatcctcttcatccttcaaagctcagccaaaaccacctcccctgtgaagccttcctagatcccctcccactcagctctaaccacttcctcctccgcgcttggccagcagttctgactgtgaaatagtccgcacctctccctgcttgcaaaggggtcagtggtttgcaggcctcttttcactactggtctgtaagctcttggaagcctcgacgatctcagaattgccttaacaagtttctttttactgatgtttgttgaattttagtaatggaatcactcagaaaaagtagtgctttgcccctaagaattgcccccaagaatggctaggagcttcatgtgcgtatacatgttatcatatcttttgagcacagggtaagtcaattgcaaaaactgcccccaaagctcacccctccctgtttgcacacccacttccgtgtaaccttgcagtgctctcacactctgactctaggcttggccatgagacttggtctggccaatgctagcaaacaggatgcaaagagatcaaaccatgtgatgcttgcatgcatgcttgagcttgcctgcttttgccctttgccagaccttgagaacatgcctggactaccgtgctggaggaggacagacacatggagcatagccgagtcccccacccggtcatcccagcagaaacggtcctggaccagccaccaccagccagctcccaggcacatgaaggagtcccgccaagatcagcagccggcaagctgacccacagccaactgcagacgcatgagcaagccttaagcagctgaaatccaccaagatcaactgaagtctccagttctgggtgccagtatttcttgttgtatgcccagaagtattgtggctctttgttaattgattaattaataatcatggataatataacagatcattgacaaagacaatggaattagagcggtgagaggggagaaatcaggaaagtaggaaagttgtggaaataactctagattgaaagtcagacctgggttctagctctggctctgccaatggccggaatcttggtcacttcacctctctggccccttctccccacctgtgaggcttcttccccgtttgctacctgcccttacccccctgtttcccaaatgcagagacttggcttttgcatctcacaccctgatgcaatcctggctccctcaatccccacgatttctaacccctgttttggcagacatctaagctccaccctcctgcccacagcctcacctgtggcgtcagcttcaggaaggtgatctgcggtgatgtgttggacagcaccattttgcttctcacctctgtgccatcttccagcacaactccttgaacacagccttcactgttcacctgcaccttcgccactgtctagagcccaccagaacaaggccccagaaaccgcaggaagggaaatccatgttagatcttccgggatttccatggtctgtgctgctcctaggcattcacaacttcttcatcccaaacccatcccaccaagttctgcagcttctccatgaagcctcagcttctccatgaaacactcagtctcagttcagtgaccagggaattccaagggggtggttagccactaacagactgcatgaccttaatctcttgattctgcaacccatcccctcatggcccctctgttcattggtaaaacaagggaccttccaaatctgagactttgttctgtcctgggatccttactaataattggggtggggtagaggggccgttcaccttttcagtgaagatgcttgctccatgtgtggtggctgagcttgcgatcgcatcagagagggcacccatgcccccctggacgtagccccaggccccctgcattccctccaggccccccatcacatggtgcagcagcacatacctgtggacagaccatccgactcagatcctggaggtgggatctcatctccccagagttccaggtgcaactattcctttccatcttgatcttcagcccttccctgccaccatccagccctctcccagcagccttcaatgagctcaagttcttgtaagagccctttgccttctctacaccctctccctaacaagtgtgtctatgtgcatagcttattaccacaaagaaggcaacgatgcccaaacctgcagctccagccctctcctgagctccagctccggtgtccagctacccacagatatctccctttggaccctttcttggcagcatcttaaacccaccaccttttccccattctccagctgcttccccttcaatctttcccatcccagtgaacggcacctttcaacaggaggttctgtttccgacagaaatccaggtgtcagccttgaccgctaccatccttccccatctacatccacaaagcaacaccaactcagcctccaaagggctttcaaggtcatcccacctctcagcctctcttctcttccttatgctgctgcagtagtgcccctcattggaccccctctcccacactttctctcctgcaggtcttgtccacatatatcctggagccctatcttaaagcccagctctgctcctgccactcacttatcaccattccaagcctccccggcttggcactgctcttaggataatggccagtcttctagcaggcactccagcctcatccctcatcctgtccccctatccatatcccatcctcctaactaacagaacctctcgatttcctgggtggatcacacgttctctcaaccccagcatttcccctgctgttctgtcggcctgaagcccctccctccctcatcttatgttttgttaactcctctttgtcctttgggtctcagatcaaacacctcttccatgtagaggcttctctgaccctagaccaggctgtgtcccggctgctcctcctagcatcacactcacgccacttcatcatcatcactcgctctgtgtctctcacccatcaggacatctgctccgctcactaccgtatccccagcacctagcacaggcaagcgctcatccatatttgttggaagaattaatgatggaacagattacttaaagatcacaaacggagcactggttaagcctcccagggatccgaagagaaaagggcaggaggccccagctggaagatccagattggctggtagatcacagcttggccaatgtgtggcaactgctgccaagcccccatctccatcgccctgggggaatttggggccggcttaatatgtgttgaaaaaccacttccgagggtgtgctcatcccttgagagaaaagccacgtcgacgccttctagcttctagcttctagctgtatcttctggtgcactggaaacggcccaacccttggctgcattctccatcccaacacacacacacacacacacacacacacacacacacagccttccattcctgcttctgcgggggctcattaagtcagaccacactgcaggctttgctgtgtctgactgccacctctcggattgggctgtcagcacaaaccctcactcataaagaaaaaggcagcttcctgtccatcctgaggtgtctgtgtgagtgtgtaccagagcccaggggaaggaacagtgagagagaagggagaatgggcgtttgcgggagtggagaggtagaagagggaagggaagaggagagaaaagaagatattaattttgagctatcaagcgggaggtgggagagaggcttttcttagtgaagcagtagggcacagtcactaaaaaggaagattttggggagtcagacacctcaagctggaaatcagccttgccacttaccagctgagtggctttgggcaagacactcccttctctgaaccgcagttctcagatgttgctctgagggttaagtggatcgtgtgtgatgtgcctggctcggttcctggctcactgggtgagctctgttaagtggcagctgttgttgctgccactgccactgttgtcctcactcctgttggggaacatgccccactcctgtgtcccacctcacccccctcactcacccactccccggagtgtggggacttgtcatggctccaatcactgcatctgtggctagagtggcttttaaaggctcagactcgaaccactgatccagcacctggacagcacaacagcagagagaagggcttaggagcctggatgggaggagggccctctcactgcctggtcgggcctgaggctggggaaccactcaccttggtaatgggagctgtgaggacctcataatatcggggaagctgggctcccaggatgcggcctacaagagaagatccacaaaacagaagttgaaacaggtgacagggaaaccctccgacctggcctgggggataaaagcatggaggatgctgagacttcctgccaggaggtggtatagcacagccaatgcagggacagatccagcttgagtcctggccacacctctcactagctgcagtgcctgggacacatttttaacatctctgaacctgcttctttacctgtaaaatgggaatcctattttacaccccaagggctacggtgaggattaaatgagctaggtaaagcatttgcaagttcatgggtacttaatacatttaagcagttagcattatttttggaaaattttaaacttgtaccttattcccttatttcgaactctggaaggcccatatcctgggagaaggctggcatggctgatccattcctatgaccctgattcagaccatttcagaaagaaactaggctttaaggccttcagggtagaaatcatggtctctagccttacagcccctgggcctagcttagtgtctgacacatagtagttgctcaataaatgttttttgcctgtttttcacacagagctccttggactggttatctgagagagaggcagtgtctactttttgcatttgtaatagattccactggctccatactctttgcaatgtataagtctgcagtgcctctcaacccaccacaacttggttaacctgcctggctccttggctctgggctcatccatgtgatttggtcagccagtggaatgtttgccgatgtgacacaaacccagaactgaaacaggcctgtacattggggcatgccctctgtgcttgtgccactgatgtgaaaagtccacacccaggtcagcatgtgcttctacaaggaggacgagaggtacctggagcagagctgcctccactgagctgctgcagacacaaacacatgcctgagaccaaaccagatcagctgagccagctggaatcagctgaaccacgaagacatgtgggaaacaaatgattttttttctaggatatagaggttaaactggtctgtataccctcaaggagggtagaaaataatagcacacttaatgagccttccattcgcatactcatggcagacattactaattgatcacagaacttctccttgctgagcccaaatctagcattcttcctgtatgggggcagctcttcaaatctcttggcccctatatcttattctagccacagccatgatgctgagctccaagcaggctttgatcagcttcacacaggcaactccacagcaactcacttcagtcctgaaaagtgagcctctctacttcttccctagggcttctctggcaccagggcagggcactcatgggaacctacttggcacccacagatgcacagcccagaagtgtgggagtcaatgccctgtgaggcaacccttggccaatgggagatagaacccaatggataaatatttccctttccatctcccgagaaggttcctcaaatgcttttcataaggcttcccagagggcccacacaggtccagcatcttgtcacccacagtgctggctagtgcgatcacacactctggtattgactctttctctgtccactttcaccccaactttctgctatttttgtgtcttggggtcacccttccaaatgaactacccacgcataagccttggtctcaggctctattttaaaggcatatcagcctaagatgctctcaacaaagtgctccaggctgcccctaattgatcgcagcatgttaactgatcccagctggcaggctgccatggaggttcaggcttgtgtctaggcatcgagacaatgggctcacctccttgaaggtcactcatcatgccctggtgcctgcacttggacttacctgccttcagcaggggcttgagggtggagagcgacctcatcctttgcagcaaggagccatgctggaaggccgccatgtccacgggggccgcatccagcagagggtcaatggctaatgccaagcgatgcatgaactcctcatatttgggaaagacctggaacagagctctgcattaaggccccactgtccacatccctgccctccatgctgtccccagatggcctgtcacccccccacagcttgacggttcctcaggcctcattccccgctgtggcccagcttggctctgttgagctcccccagttccaggtctctgggttaacatcaacaccaggaagagtgcatggggtggggtggtggtggtcaggagaccctgggcaataggagaatcactgggagtggtgacagggacaaggagctaatgctggctaacacgaagtgtcacccacagaaaactggcaacaatcctagggtgtggtctctgcgataaatcatgaaaccacttagaagtttcttccttctgtcctttcttctttttttttttttttttttttttgagatggagtcttgctctgtgacccaggctggagggcagtggtgcgatgtcggctcactgcaacctctgcctcccaggttcaagtgattctcctgcctcagcctcctgagtagctgggattataggcacctgccaccacgcccggctaatttttgtatttttagtagagacggagtttcaccatgttggccaggctggtcaagaacttctgacctcaagtgatccgcctgcctcggcctctcaaagtgctgggattacaggcgtgagccgccacgctggcctgtccttctgtcctttcctatattattggtagaagttagacctctttgcctgtattcttttccggtctgtaggtcgtctcccatgccgtctcatcacctgcagtcacagaagcctgcctcctctcaccccacaagctcccatgtcagaatccactttcgaaagcctggtttctgacacccaccctcctttccctggagggcacaggagcagtgatagaagcctgtgctactggaggccctacctgactcttcttagccctggactttgaattttggtccatctctacccatggatatacccatggcattttaataagtgttacataaagaaaagttccatgttaaaatacattcgagaagtcttattaaaaatgaagttaaacagctttctctaagcaggcctttaatatgacagcatggaaagacaaaaccagaaatcaagctcctcactttccacgatgggaaatgggcacttgcctccagcgtgtgtggtcgctggcatgtagggccacagctagtgtcctgcaggcccggggacctggccttgtgcagaatcccctcaagtgcctctgagatgggtaggatttggacgagaggatgcaggtggtggtctccaatctgctgcacaaaagaaccaccaaagaagcacttttaaaaaagctaagctcctcaggccgggtgtggtggttcatgcctgtaatcctagcaccttgggaggtggaggtgggaggattgcttgagctcaagagttccagaccagcctgggcaacatagtgagacttttgtctctacaaaaaaattaaaaataacatagccgggcatggtggtgaatgcctgtaatcccagctactcaggtggctgaggcaggaggattgcttgaacccgggaggcagaggttacagtgagccaagatcgcaccactgcactctagcctgggcaacagagtgagaccctgtctcaaaaacaaataaaataaaataacaaaataaaaggctaagctcctcaggtgattctgatcatcagccaggtttgaaaactgctggtggaagagacatgtaggctgtgtgtctgtggttctctaagttttacccagcaatagattaacacaacaaaagcaatgtacatgggttctattaacctaggttcttcttataaaaatgtctccactgagatatgatttaatgctacatctcagctaatatccaggcttggtacaaaatggccattcaaataatctttctatatccacagaaccaactgtggcagggcccttacggaactcagtggctcatctagacaaggccacccagcaggttcctagaatgcagttccaagggaaaaaagtgcattctccatccgacatgtgttcatcctgtcaccagacctgcacaccatcatggacactttgttgccttgggcagccaggagggagccttgggatgccacactgaataaatatttagaactctcctgtcctaagttcctgattcagtttatttatccttaattttctctgatcttccctcatcctcctttttggctttcatgtgctttaatgtggacaaacacctggaactctgcctgaaagctggaggggcatgaagcacacgccagtgtaagaacgtgccagtgcatttcctcttgaactcagcaggcacagcccctctgacagtggccccatactgaacacacgcaggtgagcaggcctcccagtccactggtcttaatcagcatcctccacccgcttctcttcgcagtgcctgagatcaagagctgccaccaactggagccctcctaggaacgtggggtggcctggcgcagtgtccatggcctttgaacaattgttctaggacaatccaaccaggcccatctctaggctgctgagggagcaggagctcagtcactggtcgccttccctacctgggcatccttctgggagaactgggcgatctgcttctggttttctgccatgtctgtgcccagcagaaggcacctgggcaccttgctgcctgcaccctcttccagcatgggggtgaaggagtaggggtttcgaagatgaagcctcagcccatgtttctgcaaaacacaaatagcatgggccacatattaatggctctgtggtctctgcccatcatctttctccgattgtgtttgtgtgaccatttaggtacctgtgtgtaggttcccaagtgtatggtcctggtgtctgttttttaaatataagtttataaaaagccctcttgcccaagtaccctatggtagacgatactgtatcacatcgcagtacactataccattctacaccataccatacataccacacataccatgccatacaccacgccatgccatgccacatcataccataccacactacatcacatcacaccacacacaccatgtcataccacaccctaccacaccatgtgataccataccatgccatatcacaccacactatgccatgccatgtcataccacatcacagcatgacacactcattccatgccagggactgtactagggtttacaatggttacctcacaataactttgtaagtacagtcttgcatcacttaacgatggggatatgttctgagaaatgcattgctagacaatttcatcacagtttgagcatcacagagtgtacctacacaaaactagatctgatagcctaccacacataggctgtggggtgtagcctgttgctgcaaacctgcacagaatgttactgcactgaatactggaggcaactgtaatccaatggtatttgggtatctaaacatgtctaggctgggcacagtggctcgtgactgtaatcccagcactttgggagtccaaggcgggcagatcagcgaggtcaggagttcgagaccagcctggccaatatggtgaaaccccgtctctagtaagaatacaaaaattagccgggcatggtggcacgcacctgtagtcccaactactcggaaggctgaggcaggagaattgctcgaacctggaaggcagaggttgcagtgaggcaagattgccgccactgcactccagcctgggtgacaaagcaagactctgtctcaaaaaaaaaaaaacaaaaaaaaacaaacatagaaaaggtacattaagaatatggcataaaaggtaagaaaaatgatactgtatagagccctcatgatgaatggagcctacaggactggaagttgctctgggcgagtgagtggtgagtgactgaaggcccagcacattgctgtacactactgcacactttataaatatagtacacgtaggctacactacatttattaaaaaattttcttcagtaggttagcttactgcaaacttttaaactttataaacattttaatttttaaaacctttttgattctcttaaaaagacacttggcttaaaacacaaacattgtacagctatataaaatattttctttatatcctcattctataagcttttttctgtttttaaaattttttatttttattttttactttataaccttttttcgctaaaaagtaaaatgcaaacacacacatcagcctaggcctacacggggtcaggatcatcaatgtcactgacttccacctctacatcctgccccactgcagggtcttcagggacagtaacacgtggcactgtcatctcctagagagcaatgccttttgctggatacctcctgacagacctgcctgaggctgtttgacagtgaattttttaaataaggaaaaggaatactctctaaaataataataaaagtatagtataataaatacattagccagtgacaaagtcatttactatcaagtattatgtactgtatataattatatgtactagactttttgacaactggccacacagtaggcttatcaccacaaacacatgaataatatgttgcagtgcaactatggcatcgctaggggacgggaattttttcagctccattgtaagcttatgggaccaccactgtatatagtctatcgttgaccaacatggtggcacatggctgtcttattatcctcattgtacaaaagcaacacgagaggctcataggagttaaataatttgtcccaggtcactttaggaggtaggtctgggtttcaaaaccacagctctgtaactgcaaagccccagctctcagcaccggtctgtaactgccccacttcagaaataaataattaaatttagaaagacacaatcaagcaatggttatgtgaaaatctatacttacaaggtagataaattattcacatcagaacattttatttactttgcagactcatttactccagggtcactttaaatggaagtttctttgatgcatttaaaatatgatttgatttacaaatatttgattagcacacagaattttccaagagcacatccacttcttcaaagcaggcacagataaaacaaaaggggcctgtgccgcctccagtttctgctgtcgagaggcttccttctccagatccgtggcctgcaacctcacgactcgaggtcttggctggaatgccaccttatcagccaggcctcccccgcactccctgccccctcaccctgcaatatttttctccaaagcacttgtcagcacatggctaatcacatatttagtgttttcattgtctccccaagtagaatgtaagccctgtgaagtcaggggcattgtctgttttgttcaccgctgtaccctccgcgtgtagacacagtgtagttaataagcattccgtcgactctgaataaatgaatgctaggttgcagacaaggtatggccccagaggagagaaatgagatcggagagtagacgttttagaaaagcacgaggaaaccaaaaacaggcttttccaacaattaccgctggagttgctccacactggagatgctccaggcgggcaggctcgccgcagctctggacactctgtggaggagatttccgatgctggcgggggccggggccaggagacggctggggtccctcctatccctaagatggagacattctttattctaagctagagaaacttccagcttcgttcttcttaatgtagtaaactcactcatacccaggaggcatccttagtctctctcctggtcatccttgacatcccatccgctgcctccagaatctgtgcgcgtctctccaagccgccattttgggaaccgctgcagcggcggcctagtgctccacatgcgaccccctcctgtttcctccgagtcctcaccagccagcaggtgggctgacctttgtaaagtcacaaatcctagcagtgaacttcctgatcacacacctcactggcttctcgctgcacttggataaaatgcagtcctgcccctcccacccccatctggtgctctctgcctgtctgctctgtccacactgacctgccctctgctcacgcctgcctgggtgggtccttctcttcttccctctgactggagactgcttagatgtccacatggctgctgctggtgacctcttggtacctgaataccagctcaaatgtcacctccttgaggaagatgtccttcctggtcaccatctaggctggaatctccactctctttctctaatgctgccttcttttcttttcttcttggcactctccctgaagttctctgcctaagagcagtgtccttgccttcctagttcactgccgtacacccaagggcttctctcagtgcctggcacatagcaggtgctcagaaacatggactgaatgaacgaataaaccctccaaatcagggacctaagaggaatccaaaagttattttaagtataactaattgactatgaatcacttttcatttgattcataatgaaacctaaatggaggctcttctaaatggaggctctgtcattcttaatggtgttaaatcaaatttagcttaaagctgcctccttaaatactttaagctcaacctaaaggtttctctgttcctagtgaactataacctagaaggaggcgtaaacagactgtaacctacttctgtgtcaatcgccgagttttggccaatcaaaggggaccaactgtttaaactgcgttcaaataaggcaaacactgagctgtaaccaatccagctgtttctgtacctcaattccattttctgtacatcacttttcactttctgtctataaatcttcttctaccatggagctgtgctggagactgtgagcatactccagctcgggagcctgattcatttatgaatcattctttgcccaattaaactctattaaatttaatttagtgaaggtttttcttttaacaataggtttaattatgtggagtctgaatgagaaggggaatgttaaataaccatcagattatatccacaagatttgttcggattatgaagcttttttcttaaaaaacagaaaaaaaacccaaaaaaacaaaatgaaagcaaacccttcttttatttaccccatgagagttctcagcatgcacagtcatcctgggtggaaattgttggaaagggtgtgtgtgtgtgaagggtgtatctgtgtgtgtgtctaaaggaccagagatacaagagatttaaagggtgtggttctcaaagttatgttctgggggcctcctctttcagaatgacctgagaatgccataaaaacgaccgtttctgggccccaccactgccacagaatcagactcgtgagcaagaacccctggggtttccccagcagtttccccagcagtttcccaggtcatactttgtggccctgcaaattagagccctaccttagagagatttccaggagaaaagcaagagcaaaatgaataaggctgagtgagacccagaaggtcagtgagggaggggagggaggatgggattgcctctggcagtgaggtcaaggctggcccagggggagatggggaaggtggcttatggctgaaggggatgaaaagcccccctccacacccccttctccaccagtgcaaaggctctgcccttccagcctggattccatcatccagcgcagggccgctgcaaaagcaaactcatttactaggtggatggaaccgggaggtgatccaagtcagtgctcgcattgacagctgtggaaactaacacccaggaaggggaggcaggccctggtggggaccacagcgggtcagtggagggtgctttggctcaaggaggggaggaggggcagtggtgccaaagccaagcctctcactttagttgagggctcactctaattggatacagccttataagtggcagggtgggtgagtagtctccagccatgggtctttctggagcctcagttttctcaagtgccaaatgggggtaataataatagcgacaagtactgagccctctgtgcaccaggcactgtgctgatgtggccttaggaggcagctgctgttactattccctcttacagatgaggaaaagaaggcaccacgtggtgaaatcacgcagctggtgagctgtggagcagggaggcagacgcagccggccggtttccagcagctccagtctcagcctctgtgcacactgcgctggagctgccaggggcactctatcaccacgttcaccgcaaagtaccaagagccagagacgtgtgagtctgggcggtattggtaccaagaggcctgagcgcatcatagctcaagaacaaggagtaggagacagtcaggccttggcttgaattctccatcactttctagctgtgtgaatttaacccctgaactttagttccctgattataacatggctcttgacttacaggtaaggatcaattgagatagaacattaaggtcatagcccaagatgtgatgctggtaaaataaacgctctccattatagttttggaaagacaatattcctggaaggagtttagttgtcctcctgtcaatgccctccaggctgtcaatgtcctgttaaaacaaggtgctccagatggggtgagtcctgcgtatcacacaacaggactgctttctccctgctctgagctccatactcctattactgcagcccaaggcagaggttaaagcatctactcagttcacttgggagcttctagttcaaggaacactatgacaaataccatttcaaataagtaacgttttttaaagaaagagaataatcaagtgaaaatgtccattctgtgattcttagtctcttaaatcaggtttgccaaaaggagggtccctgctccccaacatctgccactatgaataagtggtgcatttataaactgcctgctgctatggtctgctctggactggagaccagcgacccatccccaggcctggctagatttcatccagtcctggtaccaggatgcacatactctgtttcagtggcttgaagaactctctacatgaaccagttagagcagccaaagagctgtgaacaacagctggacatcttactagtttaaaattttgaatttagagcaaagatggcaccaacgtggccgggtgcggtggctcacgcctgttaatcccagcactttgagaggctgaggcaggtggatcacgagatcaggagatcaagaccatcccggctaacacggtgaaagcccttctctactaaaaacacaaaaaatttgcctggcgtggtggtagcgcctatagtcccagctactcaggaggctgaggcaggagaatggcatgaacccgggaggaggagcttgcagtgagctgagatcgcgccaccgtactccagcctgggcgacagagccagactccgtcccaaaaaaaaaaaaaaaaaaaaagatggcaccaacgtgagtggcagctgcagatagcaccaagaacccttttctctgagtggtgagtgacagtggcactaagcaggtagaagccaatcagcctcaagaatgtggtgacgcggtttataagacagtgggggtgaaggaaggtgaaagggtggggggcagggttgggccaggttgtggacaaaggtcagcagactaagagaggcaaacagcgccagatgagactcccaggaaccttccaaaaagcccgggagccagaaaagtccccaggccccacttcctgctccagctgccaagagagggaagcagctctcaagttcaatgagggcagaaatcgggctcatgtcccaaggcagctgtaagctcaggcgcccaaggcttcagataggtgtcccacgtgggcctgagggtgaaaaagctcattcttcaaaagaagtctgatttttggatgaaatttcccacttttcaagacactacatggacgagacaaaacccatctgtgggaatgcagcagggagaccacgtgggatacacaagacttgggtggaagagggagccctcaggggcgggcatcacctcgggcacagaacagggaccccccacacaggttgggaagatggaactgcctcctccctccgtgcaatcgggccggcgggggggccctaccttcagctccagatcagtgtaaatctgcggcctcagcaggctgagcaggtaggacgcgcgggagaacttaaaccctgaaaccgaatccgatgaagactgtcaccaggggtcaccagggatgaggaccgtcaccaggggtcagcagggatggagaccgtcaccaggggtcagcagggatggagaccgtcacccggggtcagcagggatggagaccgtcacccggggtcagcagggatggagaccgtcacccggggtcagcagggatggagactgtcaccctgagtcactgccctccactcccccatgccacatcagagctcacctgggatgatctcctcagtgacagctgcacccccgatcacatggcgcctctcgaagacggcggtgttcacccccagtctctgcaggtacgctgcctgggaagtggggcagcacacagggccctccctttatccctctgaaatgtcagggctccctcgggctgacccgcagactaaggtcctcactataggccagtatgggccacaccccatggcctccctgccccgctcatgctgttcctgcctctgggaatgcccttccctgtgcttccctttccaccctcgccttttctagatgtcctctaagatccgacaggcctgctcccgcccctccacttcccagctgaaagtggtcttccctccttagaggcctggtgcctcggggactcacgctgcttcctgccaccctgccctgggatgtcgctctcctccaggcagggagccagcctcatttctcctacaagcgcagcacagtgaggtggaacttgtgaatgctgacccttccacccaggttcagtccctcgttctctctctgctgctgcagcctcagtacctgatccgtctggcctcagtttgttcacatgcaaaagtggggctgatgaaagtagtcccggctttacccacttcataaggctgctgtgaagattaactgagctggttcctagacagggtttaagtggtccctggcacagagaatgtactcagtaaatgaagcggttcatagcagagctttattttgggagaacaaatgatgcaaggatttctattaatttttttctagcacttagtggaaaaatcaataaatatttgttgaaccaaactggtcatgaatctaccgatctaaaatgctggccctgtgaccacaggaatggtgccatgcaaaagtcggacttttcaaaaagctcacttggcagctattatgtgccagaagcagtgagtacattgtcttgtttaatttttcccaccagccaagaggtaggtactatgattctcccattttacagatgagaagactgaggcccaatgaggttaacagcttgcctcaggctcacagagctgatgagtagaggtgttgggaattgaaaccagacagcgtgaaaccagcatctatcctcctaacataacctcctatcataacctactgagaaagaaacagcagctgtcactcagtggctgaggcctggcacgcaaggtgagctgcgtcattctcctattacacaggaacgatctcacagattgacaacctcaaataaggtttctatgagactatgataaaatgaggcaagcacaaacaaaagcaatgtctctgtgccatccagaaaataccgaacacccctcttggctgaaatgagtgactgctacttctttatcaattactgctctctgcacactcgtctctcctccctacagatcagatttcttgagctgcccagttgcagggctgtccctccttcctgacagtatctaatctgtggcaacccctattttcgtaggccttccctcaaatcaccaaagctcaaatcctgtgctaggttctttctaacaccttcctactgaggcaacccgaggttcccctgatgtgagttccctcgctgcaaagagcaagaaaccaaactagactaactacaagtgtgttcctggtgggctttgggtgaagggctgtggatgccagccttccttggcctggaaacttccagtaataacagccaccatttgggcaaggctgcatgtgccaggtcctagcagcaaatgatctattaccttcacagcagctctgtgagggcaggtgccattgttccattttaccgtgactcggagaggctaagtgacaccttaaccttcacaaagtggcagagctgggagatgaatctttgtttatattaatataaaatcaggccgggcgtggtggttcacgcctgtaatctcagcactttcagaggctgaggcaggcgggtcacctgagatcaggagttcgagatcagcctggccaacatggcgaaaccccgtctctactaaaaatacaaaagttagccaggcatgatggcggctgcctgcaatcccagctactcaggagattgaggcaggagaattgcttgaacccgggaagtagaggttgcagcgagccgagatcatgccattgcactccagcctgggtgacaagagcaaaactccgtctcaaaaaaaattaaaataaaataaaataaaataaatgttttaaattactgatccattgagttacaaaatgccgcacgtaaaatgttcaagtaaaacttagacatcaggcaaagtattaaggtttaacatcagtccgttagcacagccacagtttccccctatattgatgttctagagctgctgctgcttcaagaagatgttccacatttgttttgtggccttgaatgccttctgtggcctcctggaggtatctggactcaggttacagaagcataagctaaggatagctctgggatatccagctcagtttgggatcttgaagtcagttgtgttggggacagggcacaggcccttctgctagactgagctcctcaatgtctccagggcacactttggccacatagcagctatgtactccaaggtggtacctggcctggacctggctgggaacacagggctctagacacaagggctgcctatgatctggagtcaagggcccccaccccgccccaggtgcccaatcccctggttcccacctgctctcatgctgtgttggttacatgcttccccaccttgtcagcttgtttctggaagctccctgactccctcacaggccatggggaaaccacctttccccattaggggaaggggaggaaaggagcctgtgatgtccacagctggctgcagatgagcattcgacccagcccccagtcagcactggagagcagagagcatcgactaggctgccttttccttctctctcaaggcccttatcccacctgcttcttcacactccttcccaggctgctgagagccacacgcccagggccagtgaagtgggatcaagtggggaggtactcacagccaccagtccgttgtgtcctgcaacaaaacgggacagggaaggaaaacatcactggtcagcgggcgggcagacagacagtccttgaggaatgtgctccccgctgcccgtccccatgccatgaagatccttggtgaccctcccctccccttcccgcactcagatgttggaacagcatctagttcaactccatgaaacaccagatcttcaaggagtcagaaaaccctggttcttgccttggctggaaaagtcctgctcccctggcttggtcaggggctctgctggagtgaggggctcatgagagcatcgccagggcttccattgcttgggaggcgcaagtgatggtgtctgagggagcagcacggttgagttggcaagcaggagaagcaatgggtggctggcatgctgctgcgccaacgtcccgtctcgcatggcagcatcagcatccaggggagtgctggtcatgtaggtagttgctatcaagcgcggcttgttttgtccacgtgtggttcacaatcggcacagtggtgccctagaaggctttattcacatgggttttttttttttttgccaatccccagtgttccaaaaataaaacatgaacagttcaacatgaagtaaacatgcacagcttcaacatgtgctggagtgactagctgtgcttcagggtgccttgagctgagaggcctgaatttggctttggcatctcacgttccacaccaagcccctgggtagcaagtgcctctccagctctgataagctcagaatcacctggaaggttgtataaatgtcgactcccacagacccccttcccaggagtctgttcagcaggtgtttcacagaaccaaaagtttcatgagctaaaattaactcttaccatatgagaagcatgtgagaagctagttggttacagttcatcttaaaaagtgctggttgacatactctttatttgtatgggcttttgaaaatgttcataagaaagtttaaacaatccgccagtgggactcatgaacagatggaatctgtctctcaaagacatgcagcaaactaaaggcagacagtcctgggctcagcccagcctctgctatttgccagggcatgacctcagagagtcatcagctgccctgagccttgagtttcttcacatggggaacagagggtgccagggaccctgcagtgtggcaaggatgagataaatgggagctatttgtcttttaattggtgctgatgatcgatcttggaaaactcatagtcttccaggcaactgggtccagttcaatcatggcagacctcaaatgagtaaggtcaaggatccaaagcacaagaccccctcccagtgaccaccctcaagtcctggctgagccctccttggcttctggtgacacctctgttcccttgaagaggacttcagctgcgggctctgctaatccccagacctgcctcaggggccccatagcaggcgcctgggcccttgaggagctgctctgggcgtgggctctgcagctgcctgcatcaggcagtgttggttgggtggatgtgctgacctctgggagacacctcccgccctcagaatgctcgtcaccaggtatggggccaggaatctccattttaacaagccccctcagtcactctcaggcacatttagtcaaatgactaaatgagattcatcttcaaggtggcggccaggtgccagtgtgccttcagggactcagaggtaacccttgtctcagaagatgccgttctgttcctcactgaggcccaagatgcctttaaaccaggctttatggtatgtttagcaactaaagaaatcatgtcaaggaaaagctcacacactgagactcactcgcacttgtaggcaagtcaccaaggcagctggtgacctaaagtcaaccttccccattaggagacagcagggtgagctgtggctgagcacggaaggaggcagggggcttctctgaggctaagtgaggtgctggagatggctcccaccagcccggggagtttgtgagccggctgtcaaacagccattgatataaactaaattatataagcttacaattaaataaattaaaaacaaaggtaataaatactcaaaacacactacctcctatttgttttactacatttgactgttgcccatgccctggcagtcactggcctctatgtacatatctgcatggtggacacactatacaatgatgtgctactgggtatctctcctaaatcacattgagcaacctcatcttggtaacagaaaaggctatggtgggagtatttacaccactgtcatcagcaaatattacacagaagggctgaatttattttttgtggtcaggcttaagaaagtgatgggaaaatgctaataatgcagattaaacctaacagtgttagctgttatagcatgaataaatagcacaaaaattgaaggaaatattctagtattagaacaatattatcttatttgagtaacatcattcctgtcatttaaagaaggaggccgggcgcagtggctcacacctgtaatcccagccctttgggaggctgaggcaggtggatcacaaggccaggagtttgagatcagcctcgccaacatggtgaaaccccgtctctactaaaaatacaaaaattagccgggcgtggtggtgggcgcctgtagtcccagctactcgggaggctgaggcaagagaatcgcttgaacccaggaggcggaggttgcagtgagccgagattgcgccgctgcactccagcctgggcaacagagcaagactccatctcaataaatgaataaataaataaaataaaaataaattttaaaaaataaaggagtaaggttgggacataaatctttgttgtttcatttgtttcacgatcatcctactctttacagaaaatatggagcaccgttctctttggagctaccctcatttgtcatttgcaactataggttggctactgagtttggcaaaaatcaaagaaagcctttggtaagaatcactcgggtagactgcatttaaattgagagtattgtatctttatttgtaaaattgtgtgcagtgtatcttttatttcaatatttaaaataagcatgtgtatatgtgtatatatatgtacgtaacacatatacatatatatacacatatatgtgtgtatatatacatatatatacatgtacacacacacatacatcacacatttttccctggagaggtgagtgttgagtatctaccagctcgcaactgctctagtacatatgaaaatgaaggcatgccctcaaagctgcatgttgagtgccgtctgctttcggtcccgtcattatctctgtatagacccagttggcaatcatgcatttggggccctctgcaagtgtgaaaggaaggcactaaggaaagaccacctggtcctgggcctgcctcttcccctagcacccagtagactgtgatactctgagcccaggggttggcaaagtgtggcagatcactgcagatccccaaatgtcccagagctgcaaggcaatggggtccatctccctctgcagacacgcagtaggaactctgggactcagttctgttttatcctaactggcctttatgaaatgactgcagtttcttgtgacgaggggtggcctcagtggtaaggtagtggtgaccagaactcagggcactgagggggcggggtgctggatttcacttgtctgttggcccagggctctttccaacccttacaaaccataggctgagaatgtggtggaaactaggtcactttgcaagagatatagggaaacccctgagctcacctagtcttcctgtcattctccatgggaagatccaagcccagagaaggcaagcatttgccccaggccacacagcagagccagcaccggaatcccaggtgcctgcctgccagatggaagggctttccattgcagcccctgctagcgtataaacttctggctgggttatgccagaggagagagcagtggggcttggctccccctccccctccccaccaagctctgagcagggctgtcttcccgcccctcagctctggcccggcctgctttaccactttacctgctcctatcaccaccgcatcatactcaggcttcagacctcccctggcttccgtgttatctcgtctccacgccgggaagggagaggcggccacagccttgcagagacctcggccacttgcagccatttctgccccaggctgggccttgctaggcagggagtttgctagcgattggcttttgtgctgccctaggcacggggtggagcagggaggaagcaggaagaggaggagctgcagtccccctccaggccccctccaccatgcattcttggccacaggccagcctcctgctgccctggggctgtgctgggccgtcgggagtgttgcctattaaccaggcggtgtcacctccaggatgcaggggataatggcaaaactgacaatccactggggttcctatgtcaggctggcattgtgctgaaccctgtaggcaaaactccccattttacagatgagggcgctgaggctgcggggttagggaatgagtggtggaggcagagtggagctcgaaagggccctctcctcccctgtgcatctaccttctcagtcagaactgaaacgcctgggatggcaagtgctcgtgtcagactctgctccaactccatgctgagtctgccagtgcagagtggtgatgcctctacgcccacaggaggcgcccagggcggccatctagcgtcaccacgaccagggccttcagacaccgcagaggcagctgtgtctgtcgctgaggagcactggagtcctctcctaaatgctcaaacacaaacccacaacgagggcttaggggcaagttcgctgtctgtaattctctggtgttttagttttgaaggcctggccagttctcctcttttggcaccttgcccattttccaagaatccccaaggattcgaggtcacatctgtaaatacctccagctaaagttctttctgaccctcccttaggcctgccttgaattaggagcccctttgttctctgcccattacttagcagagtgttcccctaggaggaaaaaaccccttggagcggagagttcctgcactgctctgatatcgcagtgtgacggaaacctgctattggtaacgaatctcagaactgggagagtatgtggagatgatcctaagagggggttccgaggacccctccacacaccatggacagttaccccgcatgtgagcatctctgctaagatctgattcaggatgttcactcctgtgttatttattatatagaaagatcaaggggactggttaaactagacatatcacatccagccgctgctaaaaactaaagggaaatagtaggtgacaaaagcaggggtcctgaacagtggtgggctcaggggattggagttttttcctttatgtttttctgtattttccacaatccacgcttttcattgccattccatcagatgatgttaaggaggaacacagatccagtcacctgaggggatacttcctcactgccaccttctcagggtttagaccaacatgtgggttctagttcccccagccccaaagctgttccctgcaaggaagagatcagtctttgagcaaattttggctcaagactaaagacacagaaggcgaggctcctgcatgcacagcacacggccatctgatcctgtgctgcagtggacgctgactttcgccacgccgtcctctctggcccagcaccggcctcctggcctcagaggagcagacactcccagtcccagggctctcagggtctcttgtccctgggtccattctgggacaggaacttctcggttggaagagaggggctgtacccctcgggtggtggttctcaatccagggcgcaccacagaagctttgaaagacatcaaaggctgggctccacggccgccaagggaatccaaatctctgggccagggccaggggcttgagaaccccagccctagggcagacgccagccaagcatgaaggggctgggacttagcaagggcttatcagcactgacagaagggtctagaagcactagcatgttgggcttcagtgataacaatgaccaacatttattgagcacctaccacactgggtaatcctcacaccaccctgggacggaggtgccatcgctttaaacgtggggaatagaagaaacttgccaggaggtgcagagaggaagtggcagcgctggaattcaaacccaggcaaaggagcaccttttacctggggtaggagagagcttgctgggtgggcttcctccacgcagggaacagcagagatggggcttcctccccatctcccaggataaaggcagaggcagctctggaagaggagctgttgccaccgttgttttacaaacaggacccctgggcttccctcttcctccagagagaaggatctggggccttgctcagtacctgacatggagggtggtctaggtggggttttagaagccctggggccaccctgggcactctgccctatcctcaggatggccactgcagacaggaggctctcgtcatggggaacagtggcaagcaagggtggctggaggacaggatgcaaaggcagactgcggccaccttggcctagagcagggggatacgggaggcctcccagaggcgccgggccagctggccggcctgctgcaccagcaggtcagtggggatgacagacaggtgcagggccagcagctcgtagcacctgacagcctcggttgggcggttcttgctgtagtagcgcaggagcttcctggggaggaaggggaggatgggattcaggagtgaggctgtggcactcctccagcgccagaggcctctctgggccctcgcaagcaaatgcccatgccctcggtcatctcactaggcccctgcatgtgggccttgacaaccgctccggttcctcactgacctaacagtggcatcctggctacgaggtagcagtggggatgttctgggccgggcacagacgttccccgtgctgccaagaccatgccagcaggaaggtggtaggaacacagatgtaccctccacacccgtcctccctcgctgcacacagggccagccgggaaggtgttcccagcgtggatttctgggtctgaggtagggcactgctgaagcagaagctgctcccggcagaggcgagcacttatcacccaaatgggggcatctgtccccagtggctcccaacgcagcgtcacctgtagtagtctcctcccagcatgccgataggcactgagtcgtcggagaggacgggcacctcgatcatctggagtttgtacccctgaggagggaggacagggaggcagtgggtgtgggggtagtgcaagggcctgagtcagacgcaccgggcttgcggcctggcttggctctgtcatgtgcgctgggtgcttgggaaaatgcctggaccttgttttttcatctttgaagtcagaatgacaacagtcaccttatgaacattagagaaaaagtatacaaagcttcaagggccggcagggtagctctcattaccgtcaatacctggacctgtacaggccacaaacacacgctcaggagggcaccctgcagggctgtcatacaggtcttgaagagcagagcattcacaaaaggcccaagcctctgctctgaaagaattgggaattcccagggtgggataaggtggggaagggaattaagatctgctggacgtgccgtgtgtgccaggcatgaacatggcacttagctgatgcttgcctgggcaccgtggcctgccctgcagggggagtggactccctagtgtgcagggctgcccccacggcaccggctgggctgtgtggctggcattcaaacctggcctctccagcccacagctctgcctcactttatcaccccacggggccacccaagcacacagactcctgtccctccctagaagtgaaggtaaaggtcacaggaattttctagcacttctgttgtacacacgtcctgggcacttctgagggcacggaggaaagctgggagcctgcaggccgggggagcagagcttgggctccggcttcctcacttacagcctcggtggccctggccatggcgtctgatctccggatcattgtgtctccatccgtacaacggggtcaggaatccctgccccagccactttacagggctgtgagggggtaactgagagaacagtggtggagagccccagtaaccgccctgccctatggaaagggatggctgtcaccctcagtgaacaaagagtgcagggtgggggcaggggaaggcacaggagtgcagggacccagagaccaagggctgcgagggaggaggaacactcctgagagctggaacaaccactcctgagagctggaacaaccacttatggtgacaagcgagatgcaaataaaagagaaacaggaggaaagcgaagaaagggaaaagacagagaggagggagagacaggaggagaggagtcccagccactgcacccctcacagccctgtgcagtggctggggcagggatccctgaccccgttgtatggatggagacacaatgatagtaagctccccccactggaccctactctgcagtaacagtgaggcccagaagaagcagtgcagggcctggaggccagggccccgagccacaccaccagtgtctcctcaggcagcctggctcactgcttcaagcaggggcctatgctcttgagttcaggggcctatgccacagggatgaccatgtgccacacttggcatgtgacgctggcgacatggaagcactagcgacaaagtgtgtggtctgagtcgcatttctcacagtggggcatgtgcctttctgctcacatgtgtgcctggatgccacgtggacaatggcaagagtttgccagacagctgggcagagggatcacaaagcagttaaacgcccatgtgaaaatgtgacctctgaactctggctcccaacctgctgggcttaccagcaacaagaagagaagatgagacagacagacaacaattcagaagaaaggaatccaagagttacagagcgggaagtgtgtgtggcccgtcctggcccagggactcagcctcacctaccatgtcattctcgaaccacaggaagtaggagcagtagaaatccccctcctggaacagcagcgtggtgtagcccttctgcaggtatctgcgcgccagctggatcagagaccagacctggggaaaagacagcaagcatcaccactctcccagccttggtctgcctgggcagctctcacctccgaaggaaggaaagggcacagccgagaagctccgtgagtgccaggggcctctcctagtacccgggcactgccttggctcagagcaggaggctcaacaataaatcattattggatggatggactaccctccagttagcgtgggggcaaaatatatgtaaaaaagctttgtgtaactttactatacacatatgccataaattagtgaactgggctagtgtggtggcttacgcctgtaatcctagcactttgggaggctgaggtaggtggattgcttgagctcaggagttcgagaccatcctgggcaacatagcaaaaccctgtctctacaaaatatacaaaataattagccgggtgtggtagcacacacctgtagtcccagctatttggggggctgagatgagaggatcgcttgagcccaggaggtcgaggctgcagtgagctgtgcttgtgccgctgcactctagcctgggtgacaaagtgagaccctgtctcaaaaaataataatattaaaaaaaaaataaattagtgaaatgatcattcaggccagagaatagccagggacatcattaatgaacacaggagaacaaggtgtggtctcctgaatcccctcctctgcctggggtcgcccactcacctagtgcccttcaggctgggaactgatggcacaggtgagtgaccctgtaggatgtgctgagccaggggggaagtccaaatcagagttcaccaaggggtcagatggaaacacagggcctgagaaaccacgtgccttagctcccctgggaatgtcctcctgcctgacgcagggactgtcaccagtgctgccggtgaagtgccccagggaaggcagcagggacagtgggctctctgccacctctcagggctgggaagagactcgaggagccctctcctctacccttaacgggagggacaggcgatctgctccaaactgcatcgccgtgtgattactcattaaatctgccatggattgactgtacttttcaggaaagtaatttgacaacatccatcaataatcttaaaaacattcctcccatctgacttaataattccatttctaggaatccatattggggacataatcagagatggggacccagatgtatgcaaggtgtatactgcagaattatttataacagcaaaagcctagaaataatctgtatgtctaaacatcagggaaatggttcaataaattatgttacattcacatgatggactattatggagctgctaaaaatcatgtctataaagagttaatggcatgagggaaagcatctgatataatgtgaaatgaaaacatggtagcaaagttgcacatacagagtgatctcaactacaacaaactgcacagaaaaccaacagaaagaaacgtaccaagataaccccaactgtctccagaatgaggggcaaggatgaagatggtgatgatgatgccaccagtaagtactgaatgaactgtatctgtattttgtgctacgtgctatgctaaatatttgatacgtatcctctcatgtactcttcataactctgtgatgtaaatagcactattatttccttctacagatgaggaaactgacccttgggctaagtactgcccaaagccacataactggtgggagacggggctgggcttccaacacatgcctccaccacccatcttcccatcttgttttaaacattagaatacactttacttgcctcccccaccaaaacaaagaaagaaaagaacacacacacacagacacacacacacacacacacacacacacacacacacgtatagtttttttggagagtggcaggggtcctccccctatcaaaaatacaactttgtcatgaaaaacagtcagttaaataaggagaataaaagaatttccagggaatgcttccttaacagaaatcaccttgttttaaattctgatgcccaactgatggaccttgccgttctctccattctagctcattcaacaaatacttgtcgagcatttatttatgccggcactggccactgcctccttgggcctgctgcccagcgcactctgctagccccaggcatgtggatcacaccaggaagggctacccaatattggctgaggcccacccatccccgccctgggtccaaatggttaccttagttttgacaaaggcagccagcggccccttgcccaactccgacgaggtcttttgactgcagttgagggaaggcgccaccatctgcccagtggtgcggtccacatagatgaagtgcaccaagcctgggaagtcttctaggtaggtgaaggtctgagttaaggtgcttacaagccaggagctagggacggcctgcctctgtcctgggcttctagctgtgcccagtcatggtggcaggagggccaggactgcctctttccagcagcttccatttcagctaagccccctgtatccttgcttcctcagatcccccactacctccaagctccccaggccttgaaaagctgtaagatcctcaacacttgcacatttgacacgggcagttctggccctacaggaacatggtatgcatcattttcatgagggatgaatttaagtcagacacacgtgaggctggagtgtgagcacagccacttggttcatgagtgagcctagctgactgcccagcctatgcacctcactgtgatcttgctaaacccttacacttcatcatgagagtttggaaggctcccatttgggaggggaagagacatccatagaagggcagcagctggtggctaaagaggccctctggcatcctttcacctgcccactgaggacctgcctcaggagactgggggctggacatttcagagatgatatgggaaaagctgctttacatgaattttcatggaaaatcagtattcgataaaattagtgttccataataaaagggtcaaatagtcttaggaatggcttctgaaacagggataaacatttgccgtaggccttctagagcttttacatgccactgtgcactgtcatgatctaagaaggacaacggccctttcaaccaaactagaccacaggaaccccccccccggtccccacccctcgtggaatacctactaccattttgccagctgggcaacactgacataaagggtctttatggcttttgtgaattaactttgggacaggaggaattcctgaaatttcagcttgaagtattcctatagacaaggcacatgggccactatgtcccattattttccttcagagaggtggtgagcagctgatggggtggaacatatatcccccttccctggggcccatagtccctccagggagcaggtgtagaggcagcagatccaagaggcttgttgggctggctggggccccggcgtcaggatatgacaccatggtgatgttcctcctgctcttcaccagcaagaagtccttccagtccgtcagcttctccctgccgagggaagctcgggctgcgtgaaggaagtacgggccccagaccctgccctggccacccagggggccgcactgcacttaccgcatgagcctctgcacttggtcctgcaggtgctggggcaggtgtgggcctcccctgctgggggctgtggtcagaaagttcagccggtagatggcgcagagctgccgcttcagcttcccacatgcctggagcagcctgagcacgagagaggagggcattacagcagaagggacctaggggagcccctcgccctgtgtggaccaccttgttcctgcacccaggacagacagacctggggagcccttcccccttgtggaccaccccactcttgtacccaggacagaccaacctggggagcccctcactcccaggtggaccaccctgctcctgcacccaggacagacagatggaaagacctaagggggcagccacagctgatcaggcaatgggaaggagcttcccagcttctccacgcggtgctccacgtatgtgggaagaaatctcctttcttgaaattattttgctgataaatgaagggcagtggtggaggagatgtggcctcccagggaacagtcccctgggcacacgacccaccccttgtcctgaggcccaccactcactcccaggaggatccgggctcacttttggagaaagccttggccttaaactccagccaggtgctctggaaggaagacagggggcaggtttgcatcccgaccatatttccagtgaggtccaggccaaagtccttctcagatcaggctctgagagggcacagggcccccagacaaatctgcccttctggccaatgcaggctaccctggcaggccccaccagccccctgcagacttcagtgtgccatgttctagtcactcagcagcgtttatttaaagggcagtttccaggggctcgctgtctgacgggcacaggcacacatagtagcaccgtcacagcaaccaggccagcccctcggggtggggggcacacacagggcagcggctggggtgtgcggaggaggtgctgctgcagaagctgggagggtatggggtgggcatggggtagccatgcagggggcggcctcacgggatctctataaagcagaagaacttggtgttctagtgaaagtgctccttaggacaccctgaggcactgcgggatgtggcactgcctcctccagccaatcctgcagccttcagactgacaggcactccagccacaatgggtcccagctcctcaaacaccaggcgcctccactgcttaaatccagagtcaagccccaccagccccactgccgtccaggccctgatctgggctttgtcagagcacggggtgatggactgtttctactgcctgcacattctcacctgtctcctggtctcagctccccacctgggccctaagctcactgggggtggggtggagccgtgacctgcacatccctgtgttgccctgtgagcccggggacacagccccgctgcagagaggaagcccg

SEQ ID NO: 1226 - DNA, 142752 bp, Homo sapiens
gtgtctatatctcatatatgatatataggtgtctatatctcatatgtatgatatataagtgtctatatctcatatatatgatatataggtgtctatatctcatatacgatatataggtgtacatatctcatatatatgatatataggtgtacatatctcatatatatgatatataggcgtatatatctcatatatatgatatataggtgtacatatctcatatatatgatatataggtgtacatatctcatatatatgatatataagtgtatatatctcatatatatgatatataagtgtatatatctcatatatgatatataggtgtatatatctcatatatatgatatataagtgtatgcatcatatatatgatatataagtgtatgcatcatatatatgatatataagtgtatgcatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatgtatatgatatataagtgtatgtatcatctagatgatatatatataagaatatatataagtatatatatatcatctagatgatatataagtatatatatatcatcgatgatatataagtatatatatatcatcgatgatatataagtatatatatatcattgatgatatataagtatatatatatcatcgatgatatataagtataagtatatatatatcatcgatgatatataagtatatatatatcatcgatgatatataagtatatatatatcatcgatgatatataagtatatatatatcatcgatgatatataagtatatatatatcatcgatgatatataagtatatatatatcatcgatgatatataagtatatatatatcatcgatgatatataagtatatatatatcatcgatgatatataagtaaatatatcatcgatgatatataagtatatatatcatagatgatatataagtgtatatataatcatctagatgatatgtaagtgtatatatcatctagacgatatataagtgtgtatatatcatctagacgatatataagtgtgtatatatcacctatacgatatataagtgtatatatcatttatacgatatataagtgtatatatcatctatataagtatatatatcatctatataagtatatataatatatatgatacatatgatatagatgatatataagtatatatgatatatatgatatataagtatatatgatatatatgatatataagtatatatgatatatatgatatataagtatatatgatacataagcttatccatatacatatgatatatatacatatatatcatatatacatatatatcatatatacatatatatcatatatatcatatatatgagatacgtatatatgatatatgtatcatatatatcaataacaggatcgaggctggcccatggctggtctacacttcccagtcttccttgcagctcgatatgacatataagtatatatatcgtatatatgacatataaatatatatatcgtatatatgacatataagtatatatatcgtatatatgacatataagtatatatatcgtatatatgacatatgagtatatatatgatatatagacatatctatatatgatatatatgtatatatgatatatagacatatatatgatatgcatatggatatatatatatgagataaagtgtctcttcaggtctttttttcagcttttattgggctgttcatcttttgattattgatttgttagagttgtttatgtactctggatacttccttggtcagtaatattttctccctgtccatgacttgcctttcatttactaacagtgtcttttattagaagaagttttaaatttagatgaagtctaatttatcagtcttttcttttatggttattgctttctgtaacctgtccaagaaaaactttgtctcctctcaaattgcacagatattgtcctatgttttctcctaggagcatggtaactttagtttttaacatttgtgtctaagaaataatgtaatccctaccaaaattctaaagtcattcttgatagaaatggaaaaaatttctaaaattcatatggagccagaaaatacaccaaatcttgagctaaaagaacagaacaaggctggaggcatcaccatctggtttcaaaatatattacaaagctatagtaatcagaacagcatggtactgccaaaaaaacacatcgaccaatggaacagtacagataatgcagaaataaaaccatgcatttatggtcaattgattctgaacaaaagtgacttgatttgttttcattatggataaccatgtcgtttcagccacacttgttggaaaggcttttgtttcccatgaatctcttttcaaaacattccctcaccttccatactgccattccccttccctttccaagcctgctgctcactgacatcctccctctggtcccacaggaccttcctcaaagtggagactctgtagatagaacctcatttctggcaaagctgcatcactgatgtgaagaaataaagcactcagagttaaactgaagtttcaactctttattcttacttccccaaaattaaaccattttggcatgacaggtgtgagtctgtgcatggtggctgagacctgtatggtgtgtgtggtgtctatgaacttccccaaagacagactggaactcgccacactaggcatcttgtatagcaccaggcatatggtagtgtggagatggtagaggaatacatggatacataaatcatgagaggccttatccagcaccttattggagctcatacccaaagtgatgccagcactcttgatctcacacaccaaagataaatgtgcttagcctcaaggacttgttcttagcttgaaagctccttggggaaagcattcttatttattatttgtgcctccaaaacacaccttaggacttggtcctggaaaatcctagtgccaactgaaatgggttgaatggcctgtgttcacctggtgatggctcatggttcttcatcttctcagtgggctccttttgagttttatgttaactctaccaatatggagttggatcttcaggccagctttgaaaattatgacagaattcgctcatttgtagttttccaatcctccctccttcctccaagtctcatgggatgtcaacagtggtattgatcatttcttctgcaggctccaggtgtcctgtgggtttatcttccatttgcaccagtactcacatctccctgaaagtacaatctgatggtgggatcctctctctttttctggagttaattactatccccttggggaatatggaaatgcaaccagcacacaggaagctgctttctctccaggtttgttaaacatgtcctgttgctgtgtaaatagttttctttttttctcccaagatggtatagaaaatacattgtaataatgaagtagggaagtgcttgcaatgaattaagtgaaagaaaaacccaaccaattatgaaggggaatatatggcatgattcccatttgttaagaacaaaaaataagaccaaagaaatatactttggtaaacatggaaaaaaagactgaaatgctattgctcagcatagggtattagtgagttttattttattccttcttctttttatttttacatactatttagaattaacatgcttcattttaaaagtcagaaaaatatttatttttaaaagtattaactttttagtatatggccctgataagtgatggtaagtgctctgaagagatcatagtggagaccgacagcctaccaaaatgcattctctctaataacaggatcgaggctggcccatggctggtctacacttcccagtcttccttgcagctcgatatggccatgtggttacaatagcatgtgagccaaagcgatgtagaccactcagaggctgggcctttatgggcagaggtatgtcttgtcttgtccactccctttccttttttacaggctggatgcagacgacaaggctatatgggacaatggagcaatattcctaaattgctatatgggggagaaccacctgccaacttgaacaactggtgtagactgctctgcagcaaggaagtaaactccatagcagctctgctctgttcatcattgtttcttcagggcctacctgggacctggcacagaggagatgctctgtgtgtgtttgttgattggaactaaacttttacttttctgacatctttgtcacaaagccatgaagaaattacatatccttatgacaatttacttagagtaaataaaatactatttttgtgtaaaatgtgagattgcaacaatatgcttccattgatttctcagtctttggtgctgtagttgtgaaatacattctatccacgtatgctatcaactccaaagtacagcactgcaattttcactttaagcagtcatagtcttttaaagaagttaaaataatgaaaagtacatggtttgtttttatttactcacacatttgctattaatagtgcttttctttttttcctatagatccaagtttccatctggcatcttttcccttcagcttcaaaaactgcctttagaatttcttatattgcaaggatgctggagatgaatgatctcagcttttattcacctgaaatgaatgtattttattctcatttttacagagacattcattggctattgaattattggttaacaatttttgttgttttcctttagcatattaaagatgtctttctattctcttatggcattcactgcttctgataaaacatcagccttaaatagtatttttgtttctctttgggtaatatttttttctttctgactgctttcttgctctctgactgttttaagataatacatttgtttctgatgtttgactatgatgtgctaagtgtgttttttctttgcacttggtgatgcttgagttttactaaatttatcatgtctgcaatttgccgtttttcaataaacctgggaaatttcaaacatcatttctgcaaatgtgcttttctgccctcctctctctctgagaccccatttacacatatattataccatttcatattgtcccaagagcagctgagtttgttttttttcatcaatattttccccctctgtccttcaaattgtataatttttattaataagtctttaagttcattaaccctttttttcctgtggccaccaatttgctgttggtctatcagtaaaatttttacttcagatatacttttcagttctagaatttacatttgaatcttcttgtattttcgattttttttttttttgctgaaatttgcctgctttttttttaagttcctgaatatatttctgatagctgctttaaagttcctgtgaaataattccaacatctggttcatcttggggtctatttctattgacagttttttatttcttgttatgggttacattcttttgctttttcagatttctactaattttaactctatgctagatagcatggatgttaaattgaaaggaggctgcattaagttttcttcctttaaagcatcttgagttttgttctggttggcagttaaattccttggctgcagtggctcacacctgtaatctcagcactttgggaggctgaggtgatgggatcgcttgagctcattagtttgagaccagcctggccaacacggtgaaacagtgtctctattaaaagcacaaaaaatcagctgggcatggtggcacgtgtttataatcccagctacttgggaggctgaggcatgagaattgcttgaagccaggaggtggaggttgcagtgagccgagatcaccccactgccctccagcctggaggacagagccagaccgtctcaaaaaaaattactggaatatccttttaattctgtcagtcttgcttcttttattctttgtttggttgtattagggtcctccagagagacagaaccaattggatatacatatatatatatatatatatatatgtatatgtgtgtatatatctatatatatacatgcctgctcttgtttgtttatttctttatgtattacaaggaattggctcatatgattatagaggatgagaagtcttaagatcttcagtcaacaaactggagacccagaagagccaatggtgtaaggtccagtctgagttcaaaggcctgagaatcagaagagccagtgttgtaagtgttccagtccaagggcaggagatgactgatgttccatctcaaggagtcaagcagccaaagtgtcctcttactcagccttctgttctattcaggtcttcaaccgattggaaaccacccatgcatattagggagaacagtctgcttgactcagcctactgattcgaatgttcatctcatccaaaaataccctcacagacatgcccagaataatgtctcgccaaatgtttgggcacctcatggcccagtcaagttaactcataaaagtaacttatcacatggagctattttatttcaattttgaacttgttccaactttatggcttttattctaggctgtggttcttacttcttcagtgtggagtctgagcttcagagttttatggttttaaatttcctctcatcattaccttcatgtttagcctgcaggaggactcctctgattggtgtttcaagtttggtctgcggattggggaggaaggaatacaagagggcagctctgagcttggtggggtgagggctctgaggtgtaaagtgaagtcccacaatgctcagcaaggtctctccacactccatgggatgcgactgcaacattccaagcactgcacattctctgttacctccttcagtgctcggccttgggtcagttgacctctgctgggtctcttggagtctcaccctgtgcacacataggaatccttggccaagggcacacacaatgagttcccacaaggcacactctcctcaggaacctgccctgaacataccagagccttcagcagctttgaactctgacttaaaccttttcagttcagggagactactgtctctggggccccacctgcctgcatcatagcagaaaaagcatcactagaaaaaactccagggcaattgtggggctcaccttgtgtgttttccttatctcaaggatcacagtcttgctattcaatgcctgaaaacaattatcttgtgtatttgaactattctatagttgctttcaatgggagggtatgtcctataccagttacaccaccataactgggtgcagaagtaaaactgccattttggggcaattgtttaaaaatcagagaatcttacattgccctttaacaaaaatacacatttacattagcagttcatagttgccctggctgcttcagtgtcttagctttggcaactctctcactaataatagcttgcatttgcacagcccttttcagtatttaaaaactctcttggccgggtgcgctggcttacgcctgtaatcccagcactctgggaggccgagatgggcggatcacgaggtcgggagatcgagaccatcctgtctaacacggtgaaaccccgtctctactaaaaatacaaaaaattagccaggcgaggtggtgggcgcctgtagtcccagctactcaggaggctgaggcaggagaatggcgtgaaccccggggggcggagcctgcagtgagccgagatcgcgtcactgcactccagcctgggcgacagcgagactccgtctcaaaaaaaaaaaacctctcttgcaaatattatttgatttgttccttctaacaaggcattcattcattctgcaaataagatgtcaattatctcagttaagatagtgagaatttcaaccttgagtttctagctctgaatttagtgctctttacctgcctgctgctggctacccggcaaggtgctggggtgggtagaaggtaggagacctgggtgcaggtgggccctccagcagactttgcgagatcccactatgacagactctccgcgcttcctctgggcattcacaggcatggggtcctggcctgtcccatgctggccacccttcctgcctctgtggaagttcctctgtctaatccgctcttaccataggcctctgatttcaggcaatatcttcttgtagattttatttatgatttcattggtgacaatgacgaggggttttcatcatatacaacaaacacttcactgcaaattctctaaggttttctctttcccttggctggcactgcatgtatcctttcaatttctcttttcttttcttttttttcttttttttttttttgagacggagcttcgctcttgctgtccagactggagtgcagctggatagatctcctattttggctgctgtctactgacaagtttgcactggtggaggttgaggttttgtgacaaatgttattttcctctttaaaccaatcttggagctttactccatgtcataacaagtgatgttgttgctgcctctcagtcagtcatgcatggtccactggttttgtgagctagagacaagcgatgagctgcactgaggatcaaggatcaggcattagcgctaacaagtgcccttgctctttggcaaaattctccttttacagagcacaagcaggattgtgtgtgaatggacatgcttgtttgtactgtggagatgacgttatggataggtgacatggataattcagcctagtttatatactcagaggaatgagaatttggagtctgagtttcagagacttccattctatggttttagatgtcctctcatccttgcctcagtgttggccgcaggaggactcccctcattggtggttcaagttctatctgaggatgggggaggaagaaatccaagtgggcaactctgagcttggtggggtgagggctgcccaacccatgccatgtccaggggtgcacttaaacacacctctgattagattcacctaacaccatcattgttctcattttgccagaggcccagagaggagaggtgtgcaccagtggtcacacggctagtgaagaggggacacagaatccagacctactcttctagggctgggctgtactttccattttgtccttggccccaaccagcaccgcttgaccacggaggctgcacagccagccccaaggggccttgctgcagaacccaagtcacccgccagaactccagcagctccgtggtcggctggagagtgggcagagtcaggcatctgccggctctccacttctgctttctccaggaaatgagcagagacccagctccagtgattcagagtgaaacggcgctgaggactgacgatgtggggccgggtcctcttcccccgagcctgaggggctgcagctggggatagggggcccatgccttctgatgtctacaggcgctgacggccacccctccaggtaggccaccttgctcttggcccagccaggccagcctagaggtgggcatatgggcgccgcctgtcagcgtggggcctactggctgcctcctgggaggctgactatggggcacatgtgacccagtgcctggtttgggtttgtgaatgtgggagaggaggtgagctggggagcaggaagtgtgtgtggcgtggggggcccatgtggtcagggccactccagggcctgggtctgcctgagtgtgtgtcactgctgaagtttgggagtcaggctgggctccagcagcactcctcgacctctgacggtaggtcaagtcctttctcggggtcctgctatgaagggaaccctgggaagggctgacacgggctttcctggttgtcgagggggcggagagagcaggccgacaggacagtgaggctcgccctccaagctccctcataggcctctgaggagtgcagagttggagggccatttccaacgggcctcagagggagctggtctatcccggccctgtcattactccactgggttctggtaagtaggtgcctccctgggctcacttccctcatctgaattattacagcaaaccattgaaacgcctgcattttctgcctaagcagggccacctgctcagtaaggactgattcttcttttcccctgaaatgaaacttctagaacactaaaccgatcctttgtcccaactcatctaaagtgtgggggggctggtttgataactaagggctctatgcattaccctttccatggagcacactaattttaatatgagtttatgtatagtcattcatttagttatttaacaaataggtattgagaaaccacgccctgccaggctctggtcaaagcggacaggggtctacggtgctcagcaggtgggagaatagcaggtagggtgggggtcttgggagggtggggatggctctagtcttctgagaggggacctgtgagggaggccgagtcctgtgggtttctgagaagtgttcttgataagggtctggaggaggagacctcgtggaggttggtgtggcagagccgggtaaggggcatgcctggggttctggccagagaggtagggaacagggtcaggtcagggaggcccttcctgtctgtccatcctgagcacatgggctattctttcatgaacttggaaagattttctgtgttgaaagaaaagaaaatttcggccaggcgcagtggttcacgcctgtaatctcagcactttgggaggctgagaggggcagatcacctgaggtcaggagttcaagaccagtctggacaacacgatgaaactccatctccaaaaaaaaaaaaaaaaaagaaggaaagaaaagaaaatttagaaagaccataataagatagaagtaataaaaacagcataaaccctgtgtgctgacaccttagatttttttaaagatcagcatcatctctgaggtcctcttcatgcccatctttcaccttccctcttcagaagcagcaacagtccagaattttgggtttattgttcccttgcttctttttctaattttacatcccatatttaaatcgctatatatgtatgattgcaagttgttgaactctgtaaacatggaattaaatattcttttaaaatttgcctaattggttcaaaagtttgtttctgaaatttcttcatattgttgcatgtacctgtagataattaaagttttctgcagtacagtattctattagatgagtgtacctcaatatatttatctgagatgctgttgatggcattttaggtatttcaagagtttatttttttttctattataagcagtgccgctagaactatttttgtacatgcatcttggggcatgtgtgcaagaatttatcttgggtatatactctagaaatagaattggtgggtcataggttgtacatatcgtcagccttactggatgtcaccacgttgttttccaaagtttttgcctcattttacccacccctcagcaatgcaccaaagtttctgttgctccacttcttcatcagcatttgatattgtctggtactgtatttctgccaatctggtagaaatgaaaagctatcttagcatgtttttaatttgcattgaccaaattactaaggttggacatctttttcatatgtttattggccatttggggtcccttttcctgttcacattttttggccatttctcatcgggttacctgtcttttatcctattgatttgccataattcaatacatattctgggtactactttttgtcatttatatatataacaaatatttttcatttgttggtgccttgtctccttatattcctgtggtttttattaatgactgaatttcttagtttcaaataagtttatccacctgtcgctttatgatttatacttgttatgtgttatctaagaaattctccactataaggttgtaaaattattctcatattattttcaaaaaatgttataatattactttttacactgaagtctctagtctgcctggaaatggcttttgtgtatggcgtgaggtgggaagaaactttattttattctgcttttcccatatggataaccaagagtcttggcaccatttatttaataggccattctttttttttttttttttttttgagatggagtcttgctctgtcacccaggctggagtgcaatggcatgatcttggctcactgcaacctccacctcccaggttcaagcaattatcctgcctcagcctccctagtagctgagattacaggtacatgccaccacacctggctaattttttttttttttttttgagacagattcttgttctgtcacccaggctggagtgcggtggtgcgatctcagctcactgcaacctccacctcccaggttcaagcgattcctctgcctcagcctctccagtagctgggactactggcgtgcgccaccacatctgtctaatttttgggttttttagtagggatggggtttcactgtgttggtcaggctggtcttgaactcctgacctcaggtgatccacccacctcggcctcccaaagtgctgggattacaggcatgagccaccacacccggcctaataggccattctttagtcactgatccatgatagctctgttgtgagttgagttgtcatgtgcatgggggtctttcctggttctctattctgtcaatttgtctaaccctttgacaatgctagacaacattgttaaccacaggtttataataaatttcggtatctggaaagagcctccccattcttttcttcttccatcctgtcttgagaattcttggtattttactcattcatataaatttcagaattggctttcaacagaaaaaaaaactatgttcagatttgactggaaatataatttggaaagaagtgatatctttatgaaaatgacttttccaattcataaacgtggtctgtctctccacttatttaggtcttctctaaagtatttaaatacaatgttactattttctttatagcagtagtgcatattttgactagacatatccctaagtggtttatatttttatattgtgtcaattgtcattaaaatacatttttggactgttgctatttggactgattcttgttcaaaatgcaagcattttaaacaagaatcattttaggtgtcatgtgaagattgtaggagaccaaaggaagaagcaagactatcagttcagaggcttttgcaataacccaggctagaggtggtggtggcttgccccaaagtgataatagttgagataatgacaggtggtcagagtggtcagattctagatacttttttgagggtaggatttgatgacattttaggtatagagcatgggagaaagagagaagctaaagatgactccagagtaacaggaagaatgagattatcacctactgagctggcttgagggcagtagaagcagatttggaaggtggaagtagaagcagaaatatgagtttggtcatacaaagatggagatgcttgttagacaatatgtgaagaaatgaaggcttggccccctccacccccaccccagtgaacttcatggtagacaagcaaggcagcttggccaactggcagaaagaaggaatatatcttgtgtaggagggtaaggaaaatgaacttctcagagttcctaaagccacaccttagagctgctacccgttttatttacaattaggggcttgcatttgtaatctccctccaagtgctataaaccatcaaaatgcagatagatgatatctcctaaacccttggctgccagtcccctttgaggtatctgcactccttaaaaacttaaatatcaaagtctagacctttgttatccaatacagaagccactagccatacttgaaatgtagccgatgtgaattgagatgcactgtaagtgtgaaatacacaccagattttaaagatgttacaaactaacaacaaaaaattataaaatacctcagtacctgaaaatattgattacatagtgaaaatattttggatatattgggttaagtgaaatatactttaaacattaatttaacctatttatttttatttttaaaatgtgtctaccagaaaatttgaaattacacatgtggctggaagttgtgcctggctttctatttctaatatttctattggacagcagcctttagaggaatgatacttcttgttttatggccagaggctttcatgggaatagagtttgagatggatgagaggtaggagaagtgaaaagccacttgaaccaaataattccaaggagaaagaaaatatacaagctaataataatgggtttagtacctaaataaaccagggacttgtacttgcaagctcacttaatcctcaagatgagataagtttcattattcccattttacagatgagaaaatggagactcagagatgtaaggttctttgcccttgaagagtgagtgactgagctgggatttgatcctagttccacctgattttaaagcctgtgcacttgcattagaccacactaccactaaagggctgaagaagctacacttctagaaaggaatagtgaatatttggcaggagtatgacagtggttcttcccttttggctgaatgattaattcttcttttgagaattcataggaaacaaaatcattgcagcagggatccttcccctcagcattgcccatgacagcagtggagacaatctgagcatccagttattacagagtgagagtcaattatgggtgatccatcaggaggatgctccatggtcactaggtctgatactttaaggaaaagggcaatgtagaacatgtttatgatatgatggatgattaatgcaatcaaatcattttcacattaattacaagcaaaatatacttgtgatatgggatgtttggggtgttgctttttctggccagaaacctctgtggccagtggcacctttgcctgagttcttgtcctgcatccagtaagaatgagggatgcagtcatgtggagggtgagcaagatgaagaggagctttattaagtgttagaacagctaaaaggagacctagtgggtagcttctctctataggcaggttgtcctgatgagcactcagctctcagcagaggggatatgtcctctctgcagctggttgtccctacgtctgcagctctcagcagagaggaggccctggagaaggtagctcttctctgcagctggtcctcctataatcttcccagctctcagcagagagtaactcctccctgcagctggtcatccagtcgtctctccatcctctgctctgttctggctgaacccagggtttttatggacctcagaggggaggaaatgagagccaactgggccataggtggccatgagcagcctgaaaaagacaacacaagtccccactctggtttgtgggtctggtagcccagcccccagccttcaggccctccttggcttgaaggtgggaccttaccggggccctcccccactccacccaggagcctatctgccccctgctgccttccatggtgccctggctgttcatgccaagggatacctgaaggccagtgcaagtggccttcaaccccttcccctcatcacagcctgaggcaggggctcctgatcctcactgggtccaggccagaatttgggacaggggcaacatcaacaggagctccccctgttgccaaggctgtcaggacccactggggcagagctaatcaagggtccgggctggatgtgggaagtggcaggctcggtggtcaccctgacttagggtggcagactgagacattgccctgggtgtcctgtgcagagcctcctcccaaggcgcaggagcccagcacccttggtgtgggctggctgggtccccgaagtgggcaccactcccactttccacccgggcccctaagcctgaccctagctccacactggcacccctctctgcctgaccatgctgctctcctgtcacgctgctcccctgctggccggctggcaacccggcctggctccatcatggcagcccccagcgtagcgggctgctggagttggggggctgtctgcctcctccccttgccctccctgcagtggctggcatgatggcagtggccgtaccagacttcctgctgctgccatcacttggatgtgaaaattagtaggcataaagagaaatatttgttgatttttgtgttttccatgtaataataagaaaatttctcagtagcgctctaatatcgacttttaaaaggataagcacaaactagaaagggaaatgtagtcaaagataaaggtatgtacacataaagaaattgtgtggaggatggccaaaacatgtgagcaattagtaacgttaaaacacgctgtcaggaacccactgatcaactgtggacagaatccagggagagtggccctgtgtgcagaaggctgcagggtggcagatgctataacagaggcagggtcgagcacccctgcagctgtttgttcccagagtctctgccctgagaatgcctgttctttaggagaaggaggagggtagcaattaaaagggtgatgaagcccaggatggggggtgtgagcctcagggcacaggctcctaagccaaccaggaaccaagcctgcatgtccaatgtatgcatagcagctccacgtggtctcagccttcgagtggtgtgtagggtgattgaatggccaggcagatcagggtggcaaatgcccagatattcaaaaggggaaaagcccagggcactgccctgctgtcagatcacagattcttgtatttccttttagcctcacacacctgtgggcctgtgggccaggacacctttaccctatccgagtgacaggaacagaagggcgggacagtgcccctaggtgagtctacacctctgccagtgggcgggatcctcacaatcaccaccctggaagactgcctttgttccacaaaacacttccttcctcacacaattgcaagtgtctgaatcatctcatttttgaagtgtgtatttaatgtgatgattttccctcccaaagtgctttaattaaatgactgtagcattttataatcgatagagactttgaattgaggaaatacaagagtgagaaagagagcgtattcatgaataacaatgacattaaggaggaacgggatgggagccgcagttgttataggcagtaggcactgaggaaaatgattgatttgggaattaatgcaggccaacccttgtgtggcctgcctgactgtgccagccaagggctttcactgcctaacttctcttttctcctgtacatgggacaatcaaagccctgctgcccgctgtctgcctcactgttccattgtaattactgagatcgtatcttgatgcagccttgaaaactggaaggggctgtcgcctgctggtgatggctgccttctaatggcaggatggcccaatagtgggagcagtttgaaagtggagaggagcagggttgcttcttgtgttgaggggggcagccatgagctgtgtctggaaggtggcatgtttggaccgtggtgctgaagggggagatttccaggcagaggaggtggcctgactgaaggcagaggggttatggtgtgagtgatcagtggattcagcttaaccccactgagggtgcagggaggaattaggcaaggagggggttgagtcctatcatcagggccacaagcttgggaagtttcccagagaacatgggagctgcggaggacgtttgctcaggggagggacatgctggagttgtgctgtaaagtctgacagtgtggggtggatgggaggtggaggggagcctggaggcagagacttgctatggtgcagccaggggacagatgagcaagcagaggtgttggtgccgggcccactctggcctaccagcctcatacagggcaggcccagaggacctgtgtcacccaagcaagtggcattctcaggccccttgacccctttctgttctattcagatgccatcctcccacctccttcggcacgttgaataattaagaaaattattcctggtacattaagaggtctgccagcttgtgggagactcattctggttaaacaaatattcagctctcagaggagaaatctgaagcttgtgaacctgggcaaatttgaacagccgaacttcactggcagacacctctttaaggagcatctattctaaacgcttcatgttacaggtgggaaactgagtcacagaaaagcaaagagactcagcttggaggctgaagcccccacttctagtggctagcagtatatttccttgctcttctcttaggtgaaaagcatcaggagccaagctgtatctgaaagtgtctctttttctctttaacctaaaagcagagttttctgggtccaggttggcctggcacaggagaggacagggaactcaagaaaatgagtcactctatctgtgacgtaggtggtttgtgccctcacttttttgtgctttgatgaatccggagaactaagagatctttaattcctgaggagccaggcatgcatacttccagatatgtttcaaagtttcacttgtgatttttgtgtctttattctgatcaaattattcttgaaatttaatcagctaaatgggatgattgtgtgaccaaaccaagccatctggaaatgtgtcaaaatctttcttaccttagcacgtgagatataaaggatcctgcaaagttcccctgtcattttccttctctgggagtttggagggtgaggaatcagatgggggctgctcagagtctggagacattcctaatagagtccctggctaagctttctgccctgttcctgctcatatccctcctagttggacaaagccaggtctagttaagcccagcctctcctgtggctttatttctttctcctcttttctctaacctgcccactgggtagcttatttctacttccctcctactccctctccaaagcccctgcttctgtgacacctcttccaccaccccctagcctcctccacccccatgtattagagcatccctttacccgtctcctctcccaggaggctgtgagctcctggtggcagaattaccagtgacaggcagctgccagctgctcctgtcactctctgctgagagccccacagtgattcccaggaccgctccgtgagacaagcaccatgtccatgtccatcggcttgccactccggactctctgcagggccctctcaccatgcactcactcaacccctgagcccctgtccctgctttttcttggacacctgtgccatttgccagacactcactcacgctgcccggggtgcctgtccacttactgccagggtccatccttactcttcagtgtccaccactggcaccatatgtcctaagaagacctcccagacttctccaccctccccagtctgggccataagcctcctcttgccccacagccaccaccaccctgcccaatgactgtcccactgcatctgcttccttgctggccccctgctccccctgagctttgaagtccagggtgtggacagagggtgatcctgctccttgcatgtttaataatccagagacccactacacggaacatgccaagtagagcagtagccccagtggctttgcctggaggacaaatgactgacactgagtgtgctggtatctgtggagggaatgctggccaaggagtgtccacgttgtccaaggctaatgaacccttatccttgaggctcccagggatctgcttttctctggggcaacagtgcaaccacagagtcttgttttgggcctcccagcttgttgtgtgagctgcgggcagacagcaggtctggcttggatctcctatggctgagggtcagcaacaactatgcaagtccagccagggactccctgcaacactgcaggcttcagctagtaccatggcatattccaccaccactgaccactgcctgaagccaaccttgagtgctggaagagggaacctgggtttgaccttgattctgatgcttgtcagctgtttgatttcagatacattacttgttttctgagtctcgctttacccatctgtacagtgggaatagtaatgcctaccttacaggttttctaagagtagagaacattgatgtctctgttagtagatggtcacttttccatggcctttcttacctaagggaacactttcttacatttcagtggagaccgagccctgatcggctcccagtttggagaggctcaccacctttccacagggactggggcttcttgtaacctgtgctgtctccaactcaggtctttgtccccatcatgatagctcaaccatagccaaactgtaggggtccagccaggggaactgctccctggccatttttggcaatgtggaagtaggtacacataccgagatacagaaccagccccttccacaggacactgtgagttcctgtattccgttgctgttgcaaaaaccatagaggtgtgtgctgaccaggagcccagtgaggactggaatcagaaagaggaagttttgagagccatggaaggtttgctgacctgcctagttccttccaatgggagtctccatcttagtcttcaggggatcccctgaacttctggaaaacacctgcattgcctcagtctcctcgtgagtcctttgaagcaggtgtagggccctgggccctgccattctctgccagcaggcacactcagcccttggcccaggtaagaagtggggacactcgctgactggtgatgtctagggccgcaccgaggtgattgctggagttatcgtgagtccagcagctgcgcctgctcctggcactcccttgaggaggtgctggccatgcagggcccacagggaacctcctgagtggcccactccttgctctcccacctgctgtctgcaaggctgcccctgactccacctggccctgatgtggcattcccccaacacaggcttggtcttggaggcagccctcctgctcgtgtctccacattgtgtcctcgccagggccaaatcctcacatgcagcactgtctggccatgctcaggcccacatctctacggccctgtcctgacatccaacaaaccagctccttgtgaggagacccgagattggacagactcagcggccagcccagggggaggtgatgaaggcaaaaggaagggtctaggctgggactagggcagctgactcagaccttggggctgaaccccaaagatggatggaggccccagagcacacttacaaaggccatgtgggctgaagctcccaagggaagtgcagattttaagagcttcgaggcagcaaggtgcagaatgcagaagaggccatgcagtgcgcactctgtgggcatctagcatgtactggacaccctctcacatatgttggcttgcttaattctttctgcaatgttgcaaggacgatattgttcccattttacagctggagacattgaggttgagggagcctgagtcgctaaggttacaggttaggaagagatggagctgggatttgaatctgatctatgtgatgctgctctgggttggcctggccttggagctcaggaggggtcaggctggccagagggactaggttcagggtggtggtggtgcttaccagcgagtcaaggccagaggttgtcacacagcccaggctaacaggcccactcctagatacatggagctacttgaggtgggcctggaacactcaggtctcacccagctcacaggtaacttaggagctaatgtcagggctctggacaacaggccctgccatgaagcagtagagacctagcaggggctcccagctcccttcccgacctgctttgtgatgttctatgagccacccacatctctgggcatcacagagctctgggggtcttagcctcccgtgtcttcctggcccctggcctcacctggggacgtgttgcaatcaccttagaccttgtagccaacacttacacatggcgccactcagaagtaagtcacaatgttggggaacccggcctccaaggtgatctggtgagtggcctgggtgggcgatggctgctctgtttccaagctcaccaggcatctgatgtgcaggtgtgcatctaacaaagatgcacgtgtgactttttggagtcagatgcacatctcgttgggttatctccagggtcccgccttctttctgtttctaaggcaatccctctaaccagagtgatcatggccccatacctcctggctgttctttcttcttctctttcctgttccaggcttggtttactgccagccaggacaacctttctagaatggtgtttcctgggccattttcctgcttagtacttccagggtctccccattacccagaatgccaggtctaaccatgctggcctcccttttctggtcccacatgactttaggtggcatcttgtcccacggcccccatgtcaccttggcctgtttgctgcatgtctgcctccagcttgcttcctgcctggccttctctgagtagcccttccatccccacgggtgcgcctgtcctccatggccccatgcacatttgttctcctacggtcctgtgccccagctcttgagatggcctccgaggaggggatgcgttgtccattacagagcctctcctgtgacctgcttctcgacaggccatctcttggtgtctcccagcagcacattttttcagacgaggattggcactgtggagagtcacttctgagattccacagctcatggcatgaggagcaggagccggaatgcaggacttgatgccaggttccaattttgcctgcccacgatgtctgtcttctagcgtgggagattacaccaatctcctgcacatttgaagcactctgatgtcactctcctgttcccaagcgtgccagggcttgaagcttgtggctgtggcagtgacaaggcccctgtgacagtcctgttccagctttctagtgggtgggccttgcctgtgcagatcagaccaagatttccatgaaatgctctttctgagcagcagtggcctcccggaggaacagtgaggggcaagaggccttcaccccacttctggcatgacactgaagacctctttctcttgggggccctctgtcgaccgtatcatgctcagtctttgctcaatttattctcagtgggggagacggattgaaggtgtggggtttatccacaaccccaaatatggctcctgctttgcctcatgcttctaagaaggcaaagtttaacgctgtgcatgccaagttgtactggttcaataaacgctgatgggaaatgtggacaggtctggcgggtgaagggctttatccaggacagccatgctgtatccgccgaggctctccagagaaacagaacaataggatgtgtgcatgtgtgtaggcagagagacatttattttaaggtactggttcacagaattgtggcggctggcaagtttgaaatcttcagagtggactggagactcagggaagggttgccgtgagtccgaaatcagtccgctggcaactctggaggagatcagaggtctctcatgaaatgcactatagacctagccggcccgtgcagccccagaaagcacatgctacagggctcacagcccctgccacgtctccatttcctcctccacagacagccacgctcacctggtttttgccccagggggaggtgaggtctgggaggtgaggagagggaagtgggaggtggagggagcagaatgtctatggacagggctctcagggtgaccatggagaagagggtggggcctggccatagccactctgagacagcaggcagagaaggagatcacacactcagtgttcagagctttcagtgttggggcttgcagcatggggacttcggagccagcaggggcagaggcacagggacctattgtaacatccagtgtccctcctgtccccttcacaccccacacgcatacacaccagagctcctgctgtcagttaatacatcaccgatgtgggcaaggactttccccacagtggagagtggggagaggaggggctcctgttttggaggagctagacaacctcagagggagagtggtggagaggttttggaggcagacagatctggacctcagtgagttgcaggctcctgctcccagcctcagtttcctcatctgaaaatggtatccctaatgtccacgtcttggagtcatcatgcaggctgaaaatgcaaaagtgcagctggcctgccacacactaagctcccaacaaggctaaactccagctttgcctgagacactttagcctctcacactgtgctttttgtttttgtcctcttggtctactctctgggctgagaggtgagggtgaggggtgatcagggcttgcagtaatgctaggtaaaatctagatgataggattcttctgcttccaaagtccctctccaaggcttctcctcaggtggtggtcctccaggtgtggtccctgaaccagctgcctcctcacctcctgagaactcttcagaggtataaattcctgagacccaccccagacttactgacttgtaaactctggggctggggttcagaaatctggttttaacaatctgttcaggtgatgctgatgcatgctgaagttttagaaccactgcttttcagaacagtttctccaggagggcaggttttaggctgaaggttcacctcccagcaccaccccaaggctggccatcagcaggcgaatcatctcaaagggagtctcagagcactggtccttcaatcagctctttccccaagggcccacaggaaagcctggaggctgtcattccactgacatgagtcccctcacctacacttccctcctttgctttgtacgttatgtagactgtgctttgggggccctttaccacatcctgcaggagctccaatgctcttgcccagtttctgcaaattctcagggtcttatgtcctccaagctacttctatctcctgatttctctgatcttgtcactgggtctcatctgtgtcccctttgtttacaatagtgttcctcccttcccggaactaacccaggtgtggaacacagagcttctgtaattggcgtcccataatccctccaatacaatgccatcatgtggcaaatgtttactgaagccttggcccagaagggaattctcactcctgagaacaccagctgcgtgagcacgcccagggatgctgcgcaaacgcaccatgcctccatctcatctccacctgggggtgggagtgtgtggggtcatgacagttcctgtgccatgggcttttgggagaattaaatcacgttaggtgggcacagcctttggcagggggcctagtgcggagctagcactcaatagatgctattatcgttatgattttatcgtggtcattaaactggatgaattattttctcttcctttatcttttatctatttattgattttatttatgaatttataattgtagtacataccacaatctataagtaacataacataagattcaccatcgtaaccatttttaaatgtatagttcagtggcattgagtatattcacgttgttgtacaaccatcagcactatccagctccattaccttttcatcttgcaaaactgaaactctgtgcccattaaacgctacctccccatgcacccctctccccagtctctgggaaccaccattcacctttctggctctatgaatttgactgctccagggacctcatatcagtggatcacacagcattcgtccttttgtgactggttagttcactttgtataattctctcagggttcatccatgtcgtagcatgtgccagaattgtcttccttttaaaggttgaataatattccatttcattgattacacattcatctatcattggacactggcttgtctccaccctctggccattgagaataatgctattaggaacatgggtgtacacgtgtctgcttgtgtccccactttcaattcttttgggtatacttttactttttgtaattgacctaccttgtctattagttcaaccagtttgatgtaacaatcaataataaacatagtatttttaattggatgcaaaagtggatgagaacttaaaggacagtctccccacttgaccaacgtggaggctgaggccaaggaagggccctgagtgagttcttatctgagggtggtttctgtggacaggagccttgacctgtccccagctggtggcatcttgaggaaagaggaagtgtggttaaggtggagcgtgtggactttggagtccgatgcacagaacttggctggtggccccgtgggaagctatggaaccactctgaggctctttccagcacctgtgaaatactactgtttaccacctcgtggggtgttgctgtggagataaagatagatgatacagagataaaaatgcagagctactataaagtgagctctcagggagggaagtcactgctttgattaaatagagatttccatccccactgtacaggataaaagctgaagccaagggactaaaatccccacctctggcttttccattaattctctttccacctctgtacatgttttcttaaagtcaggtttactgaaatacaatttacataaaaataattttctttttttagtgcacactttggacaaatgtagactgtcatgtgaccaccaccaagtaactcctcctcctgaaagcttacttcatagtggctctgcattttcatctctgtatcatctctctttatcttcacagcaacacaccatgaggcagcaaatactagcagtatttgatggctgctgaaaagagcctcagagcagctccatagctcagaactgctactaaatagcaagttctgtgcagctgactccaaagcccacacactcctccttgaccactttcaagaaacaggacatttctatcccccgcaaaattccatcctgccttcgtagtcatccccttatcccccgtccctggcaaccactgatcttattttctctccttaacaattttgccttttccaaaatgtcctctaagtggaatatgacagtgggtagcctcttggggttggcttctgtcagctgacagaaggcctttgagatgcagccagggtgctgtgggtgttagccgtgtgttcctttgtactgtagagagggattctgctgtatggatggatgatggacctgagttcatttattcattcattctgtgaggggcatttatgttttttccaggttttggcagtgatgaacagagcttctagaaacattcatgtataggtttttgtaggagcataagttttcatttctctaggatgaatagctaggggtggaattcctgggggtatgtttaactttccccgaaactgccaaacttccttccaaagtggcagtgccacgtttgcattcccaccagcaagggtgagagtggtggttgctctgcacccttgccatcatcaagttttgattgcttgttgaagacatactaattggtgtgtcctggcatcttgttttaatcatcattttcctaatgatgatgctgttgtccgtactcagtatttctgacagtgtcagctgtgcaggtagatgtgaacgctgttcatagtacatcacctctgtctctctcctctttttaatttggttttagattgtaaggtctccttgttgatgtgaaaccatggggaagagggaagcaagcactagccccaccctgaacatgttttaggaacaagaatggctttgctatttatttatttatttattttggagcgctctagattgaggccaagactctgctgaaaacaggggcgagagtgtttggatcggctgacaagcagtgaggcactggcttttgcatggagaggaaaacagatcatttacggccatgcatgcgaagccactattctattttgtatcatctggtttagaggcttccccagctccaaggcctgagggccatggcccattatggagatggcaaacaggcagtttctgcacctggagtttataatctggaaatgagaatagttgcagaggctgacaagaaatggggaaagaattttaatctttaattttttcaaagcaactctttgtctgcaggccccagcttttctgcagaaggcactgagtcccaagctaaccctttgggtcattccacatgtcttcttgctctggggcagcttttcctgggaacagcttcttggcatcttagctccaagggcgctgctagatcacatctcacattctgagactcccaactctgcaaatcactcaatagaaagtcagggatgaaaacagtcatcaaaatgtttacttagcagcccaaatatcagcaacccagcagttgcttcatgctccagatgttacccttcattggggccgctgtgcgcagaatgcctggtgtgggttgttacaatgcagagcgagctctgatgatgctatgtatccctgcagggtgggtggggtgcagggtgagggtggatagtgacaccaagagacctgggggcatgcatggccactcccagcactggtgctgctgaggtcacagggaatccctccctcttgggtccctgcaggctcgccatctggttccctgcacatggcacagaggaaggggagaccccatcacatacacacaacccacagactctgggctcctgtgggggtccctgcagcccttcagcttctcactatgctggacctcttcccattgttcatgcaggaagggcagagagggactgggatcaccgggaccatgtggatgaggagaagccgagtctcagagaggggaagtgactcagttaagacaccacaggggccaagtttgacctggacccctgcctgtgactcccatcctggccccactgccccctctgcctcgtggctgtgtgagaaggcaagtttctgcctcaggagagcagagcttccaacctggctggtcagggatgtggagggccagaatgccatgtgccctgaacccatccaagctgggacacagcacggccggcagggaggagtggtcttgtcttttcctggaggctctgggactccctgcagcctcctggcctcttgctctgccaaggccatatttccctgaacccttcccctaaaagcccacctgtccaagaacctttccagggtagcaagtcttccccagcctgtgtgaccgggtatagtagtttgccaagcccctctccccatcctcagccccaagcagccacagtgtgagcccagctgcctgtgtgcactgctgggggtgtgctgggcagcaaagcctgggctgtccacagacctgggggcttctgctctggtcaccgactggcgaagggaccctggccaagtcacctctctgctcccacctcagtaccagctgtggacgaaggctgctagctttgctgtcactggatatcagaaggattacatgaagagatgcatgtaaatgcctgcactaagtaggtgccagtaaatatgcattcccttaatcctaatagtgacctgtgccaagctgactaatgctagaggggccctggtgagagaacctgttgtcatccccactttacaaatgaggaccatgaggcagggatgggtcttgccacttggtctaaacccactgtgttcaaaccccagcagtctggccccagagtctgtgctgggagccaaacatgtctgagagtagaatccccaggagccaaggtccagacgtggtgtctgtttaacaggttgatttttatgaaaaatgccctgagctcaagttcccacagtggagagtgaagttgggggatggttgggaagcacaggtttggatcctgtttttatttaaaattttgttcatcatggatttcttgacattaactttgatctctaaaactgttgcataaaattatcatttttggcacctccttaaatcttgtgaggaggtgagtgcctccttcattgccctaccctcaccctggcctcgcctgggactcccacagtgaccctaagccccgatgggtcccttttcaccctggataagaagaggctgctggcttgtaggtggggcacttcttgagaatgagacggatgagagtgtttttttcttgctgttcttcacatggcctgcaagcctactccctgtttccttctcttttcaaataaaactggagcaggtgtggcacgatcagcagatgagcaggaggtggggcagctgcagcttggcatttgagtcagatgctgctgccacgcaatttcaggggtccgcattagttagaaatccttgtttatcaaaaatctttgccgattcaagtgaaggtgagtcaagtgtttcacttcagcaaacgtggcttctgcacttcagaggagagctgggcggtttctgatcctttctctggatctccagctaagtccccacccatcgcagttccatattctgcctgatgctcacttgacttgccacttgctggtcctgaagatggggcatgttagcatgtcctcagacatggtttactgatagagccagttagtaaagcctgcaggtgtggccacagaatgaactttatatggtagagacaacactaagcttgctgttaccatggcttggggctggctctattggtgctagggatggcagtttggttggacacagtggctttcagagtcctggggaaatcctagtagaaatcttggagtgggaaaaatgaacttgttccaaagaggggtctaggcgagagagagagagattgagatttgggtgccatcagcacgtaggttaattcgttcacggattcatttatactttcattcgtttatgcaataacattttattgagaatctactctgtgccagcccctgctatggacataacatccttgccttcacagagctaatgtttagtggatatgtggctctcagtggtaattagagccatgagaatagctgagacctccttacaaagaacccatgaaatgagaactcactggagtctgactccagaacaccagctgcagggagctctgcaggagaccgagcctcagatggaaacatacttagctcctcactctgcagcaaatgcgcagtgagaaacaacagagatgcacttgcttttgattttattctacctgtcaaattatcagggttaaaaaaaagggtaataaaaaaagattacacatagggaagctcgagctcttgtacacttatgtagaaggaatgtctgtcccttgataggattggtgtttcaggagcagccgtttggaaatatggatcaagaggctggaaaatttatctatctttagatccaactatttccttttagaaattcaggaatggattaggatttgttattttatcatgaatatataaaaaagacttagacatgaggattgtcattacagtatttttttatagtactgaataattggatatcacttaagtgcctaagtgtaagggcttattaaataaacaagcaacattactctatggccaccatgcagccattaagaataaaggcattgaggatcttaagtgatgtggaaaatattcatgatgtgctgttttgactacaaagaaagttatggactaatttattaaaaaatggattgagagaagatatctgtaattttcaaaactaacaaaggaccagcttctagagtatactctcatgaagcagcaagagaaagacaagcaaggaaaaaataagcaaaggttatgagtagtgaattcacagaggagaaatgccaaaaggctaacaggcatgtaaagggatgctcatactcattagtaacttagagaaatgcaaattaaaatgacaatgcaaggtctctttccttcaatcagattgcaaacactggaaagctgggtgatgccaagcagggtggtaatgaggtcactgaagagccttcagatgctgtgggggagatggcctgatgcccgctttctggaggcatcttagtttgtggaacttagttgaactgagcagtcatactcccttgattcagttctgctgcccctgccttcatacccagagtcagtcatgaaagcccagtgaagggacccacgcagcaatgtccaccccagccctgtgtgctggactgaatgttgtggctaatccagccatctatcagagaaagccaacaagtaaaataggcatgtgatgcccactttggaacacaaggtagcagttagaggaaatgaacttgacaaacacagagacacgtggtggagtctgaagacataatgctgggtgaaagagtaagagcagaaaagatgcagaagagcatttgctaacttaagtgtatgtggatggaaatcaggtgctgtgtgtcatactctgtaagttccatgctggtggaatcatactcaccaagtgagagtgtgggtggggtggggacacagggaatgcgaatggagaatggaggtcctggtgataaagaaataaatgaacacagccagacaggagcccacccagatcagggaaaaggctaagggatgtgagcaactccacacactgcctgccccttagagttagccccccaaaagaaacaacttaatcccccacaaaaccccatcccagtgcccaacagaagcaaaagtataaataaagtttgcttcaacaatattatgatcgtgttcttactaaactatatattcatagatagaagctggaatgtcagcagtcatgttttctgggtatgggcaagcattatgttcttcctgattttttgtttcctcccagtttttgacaatgaactgacatggcttttgtaataagaaaattattcctgaaaataaagtcagagagtaagcagtctgtgtgctcgaagaggagctgggggaaggctgggttctgcacataaagagtgagaatgtttcagagagggctggttatccttgccggtgtcacgtggctaaaccccattctagccttcaaggaatgtgtgtttgggctaaaaataaagcatgatgtaacccaaccactgctgtagccaagaggaaaacactgggagcccacttctctatgtccctctggtcactactttgtgattgttgaatgcctgctgggcacccggatggcttcctacgtggtaatgttgagtttggtgagggcttttattcagggatcctgaacattttggtcccttctgagagtttactgaactgcagacaaacaaacaataaactatcctatgttatggtgtaagtcataattgactgacaacttttgaaggtgtgtacctttgggaggtcacttattggtgaattggcccttggctgttttcatcgcataagtttttgttcttgtgcctactggcttgaggttcccaacttgcaaacactgctcctgtgtgcacttagagatgagctcttgtaagcttggggacttaaagggtcattttgagaataaaatactctaaaaatatcaagtataaaccaaataatgcttagaatgaggaatctatccttacagacccatcatagaaggaagttctagatatagaattatgtgcctctacaaataccagtgaactatttacatctcttttatgtatgcagccttttaaaagagaagcagcaacaagtgaaaaaaaaacaaacaaacaacaccccccccccccaaacaggctttagtgtgaaagtttgcatttcaacttgacgtctagctgcctgtatgcctttggcccagtttccttacttacctagagagaataagagcacacatctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaagagcacacatctgtctgtgtggctgtaggagagtctgtctgagtcttgtgtataagaccccacagtgctgggcacacactagattgtgaacttgtattaatcacatctaaatctgaatcccctttttaaaaaggcttccttattttagtctgtttcagattcttaggggaaccattttcaatagaaactgggctgagtgagtacagtaccttatccacagccagaatcatcaggaagtgatgtgacaggaatgttcacttctatttgttctgaattcagatctgctttgccacggcatggaggcagaagatctttcaaaggctgaagacagaaatgaagacccaggttccaaaaatgaagggcagcttgctgctgtgcagcctgatgtcccacatggagggcagtcctccagccccacagctctctgggacatgctggaaaggaagtttctggaataccagcagttgactcacaagagccccattgagcgtcagaagagcctgttgagtcttctccccctattcctaaaggttagtgttcttatttttgaaactgtaaggtgataggcgctctgggacacttctgggatgattgcatagtgaagttgatggttttaatgtcatcccaagtggactctgattggttgctcaggggagtgttgtcttagtctgctagggccactataacaaaatgccataaactgggtagcttagatgcaacagacttatttctcatagtttggagcctgggaagtccaacattaaggcacattaagtgtctggtaagagcttactttctggctcatagaaggtgccttcttgccatggccttatgtagtggaaggggtgaggggcctctctcaggcttcttttataagggcactaatcccattcataatggtagagccaaattgttttccaaaggccctacctcctgacaccattaccttagagattaaaatgtcactatatgaattttggggagaccctagcgagagtgtcatgccaaagatgacaagcaaggctcatttctagggtagggagggacttagaaaggacagacagttagcttctgagtaatactgtctctttagttaaaaaatattacattgttccatcacaaacccagtttgggagctagaaataagaccagcttctttgggagggaggagaagatggtatgtcctgacacaagagtcacacaggtggctggcaacctcacaccccagggatgccaacaccaaggcctggaaaagccagaatatcttgcatcaaattgtgacaataatgcaaagtgaggtaaaatcagtggaaagcaccagagcttcactcacatcccggtcacagctccacgaaggaaaccagcgcatctactgggtctgcactctagctagtggcagctggtgacagcttggctgcaagggatttcctttgttatctgggagcaatactcctgccagtgaggtctgccttatagttgaagtctagttgtagcattgaaagcactttttataaggacttagtgtttacttgactatggatttggggttatttttgaaaagcgtatacctacaaaatattcaaagcagagagaacaagagctacttttcacgtttgaaagtagactatggcagatggaggctttggcatgttttcactgctaaatgcctttgtgaatatatttcctctaacttattcatcagaaatatttaagggtttccaaagattacttagaatcttgttgggaacacgtttataggatgcattccatacttagcattaaacagttgccaagtaactcactgtccattaattcatcattttcctccatgttttggacttgtagtcccattcatctcatttcacagactgcataactagggctagattagtaaagatagctaaagattctcagccctagccctgcctgccctgacagccccagattctgggaggtgcgacagtcttaccccagttcccagatcaactttgccttatggaagggacaatgtgagcagtccccagcccccagtgcaagtcactggcaatggggatgagttcagccattactgagctgctagttctcggtgacacttttcccacctgcatgggcagcccgggctctgatgaaaggactgcacccaagagccaggacttgattcttcttcacctccctgatgtttatttgagagttcatttgtttgttgcaccaatatttattaagctcctatactctgctctaaggcctgaaatataggagtaaagaagacagaggtgacacaccaccctcatggtgagtgtggcccagagcagacggcatcgaatagcacactgtgtatttcatttggcctgcaggggttcagaatgaactagtggccattttttttcaaaatggaaagttttcatatgaaaatcagatttctaatttatcttgaaaattttggtagatctaatactgacggttgtatgggaggggttatggggttccccagctaacctcggagctcactccaacatctttcacccaacccatattactaatgaatgttatgtcaccgtacaggcatgtgagcttgtgactccatatttaagtgttactattataagtgaaccttgatactggtctttgttttccacaccctgtccctataattggaggcataatgaccctgttgttgaacatgtgggctttctagtcaaacagatcaaggctcaagtcctggctgcatcacttatttattagttgtgtgctgttgagcaagttaccaactattgctgaacctcagttatccataaagtagaattaatagcatttcaatgagaaaccatgagggtaagacaagacaatgattataaagtccacagctcatggaaagtagacattattcccattacttttccaccagcctccagtgtacttactgcacatggactgaagcctttgagattcctgtcgccaggattccctaaactgctgacacaatctgctactctggatccctggaacccacctctggcaaaccctgcagaggcagaatattataggcttctcataattttcttaatatctgtattattttattaagtcctacatgcctatgaaacatggtttctattacattctgacggactaataaaaccctgccagagccagagtgctcagccttcttaattaatagttggtggtggaaagaaaggtggggaagatgggagatttttctcaggtgtagtgcagatcaaatctaacctgagatgaagcatgagaacatttactggaatataggcccttgtgtaagaagataagcttgtaaccactctgttctgaattttataaccacaaagcagtgttctttaaggttttccatgaagttcccccttggaaataacagaacctaaaatgttatgccacttctcccggaatgtggctgttaacatcaaagccttatacatgtattggttgtcatggaaatcatactctgcctgggctctgagactcctgagtacaaacaaagagtcctgaactcccatgtgtgatggagctcaactctatacctgactcttcattttggcccaaagaaaattaattaagattatttggaatattctttgttccaaagcaatgcacacaagggattttgaattgtcacttctgctcggaaaggccatgtccctagggtgtggggtcttgtctgactgacccccagcctctttgtcggtcagactctgcatggaagcggtgatctatgttgtagttggggctgggtgaatcaggttgacagctgtgtgtgcctctcctaagttgctgtcacctggtagcttcaaacttgtgagtcttgagatttgacaatgggcattgtcttgtgcatcagactccctcagagctacttctttggcatcttcttcccagaaaagaacttcccgttagcctgtttggttttcttccatatctgactccttcaaacacgagcactgaactttcctctatccctgtctttgtttatacttgaatctgcagtaactgctaggcaagtacaaaggtgggcttggtttgtggtacagtgaatcccagccccactgcctcttgagttgaagagtggctgcaggggtgctaacccagtcaacattttggctattgtctaggtaataaggaagagcctaatgggatctcaacaaactggaacccaaaaagggagcttccctgaggggaggagtgagaaatgggattctcatccagaacagcaggctccctcctcacctagggttcctcactcctcttgttaggtcaaagagttcttagccagggcaaggtgaaggatgtttcagtcctgatctagggtcagatccttccaacctagcctctaccccttttcttttatttctttttaatatcaccctattctttctttgacctgtgctaagcaacctgtatattagaaatgagactaagagatgaaatgatgccctaggttccaatactagcaaggggcagagccaagacttaaactcaggcaccctgatgcccaggtgagcagttgctttcactgatgatagctaggtaatatcctacaggttctaactagctagccagacattctgttcagtgtttacatgtcctcacaataacgctgtgatgtaggtagtatttttatcccagctttataaatgaggaaagagaggcttagggatgttgcataacttggccaaagtcacccaattgtcagctggtagcagaatgtcaccagggcagtctgctgtaggtctgcattattaaccactggatgtccttgctcagtgctggggtttctaggataaagcaggtctggtttgtctttccttatttcatgactcactggacaatggctttgcctggctaagaccttgccttttccttgggctcaaaaagaatgtctcccccacacataggatgtttagattgctgactgtaggatgttgcagataaggaggaagttttatttcatcacatggaagcaacacagagccaatgacttctgtggtgtgcagagtagtgtttttaagaaagactcaataggctgttgttcttttcctgccaagagccttggggtttggtcttttcagaacctttcccatcgtatggtctcacaccaagggaagaaggtgttcttctagcaatcatgggaaggtgctggttttgggggaagaaaatcacttgaggtcctcattttgcacagagatatcctgtaataatagaaatggggaaatctagagctacagaagtagccaatgaggtttattcatagaatgtggactttgagagaaagcagaaagtaaaatagagaatcctcagcaattaatgcaaaatctatcagtgtctgagatagacaacttgggaggtgggaccacattggagaaaagggaaatatgtggatgtggtagattagaggtgctgtgaatgggctcacactcctcccttcaagaggtgggatctttatcccttccccttgaatctagatggatttgtatcaactgggctaatgggacaaggcagaagagacatttccaagcataggcctcaagaggctcacagcttcttctgcctctcacttggcatactcactcctagagtctagctgccatgttgtaaggaagcccaagtagttctgagtgaacacctgtgtggagaggatccaaggccctgaccttgaggctgcacttgctgctgactgccagcaccatcttgtcagccctgtgagcacacccacaatcttggaagtggatctcttagctcccattagctgccctagcagaatggagcacagaaaaggtgtccctgctgagccctgcccacattgcagatccatgagcaaaataaatgattgctattattttaagccactgaatttaggggtgttttgtcatgcacaacaggtaactggaaaagtgggtaacataagaaggaatacatccatttcctagtatgaagggattgaaatgaacactaacttagttgtatttagaggtgagtgtattttggtgtttgtgtgtgtgcatatgtgcacattcctaggctgactactaagccaatggtgcagagtttgtgatgttgagtatgattgatcattcttgtaaaaaccaagtgtggatctaactgatagttgaagaaagataaacaccattaaatacaatagcaaagatgaccaagaattatttttttattttttttattttttgagagggagtctcactctgtctcccaggtggagtgcagtggcccgatctcggctcactgcaagctccgcctcccagattcatgccattctcctgcctcagcctcctgagtagctgggactacaggcgccggccaccactcctggctaatttttcttttcttttcttttttttttttttgtatttttagtagagacggggtttcaccatgttagccaggatggtctcagtctcctgaccttgtgatccacctgcctcggcctcccaaagtgctgggtttacaggtgtgagccaccgcgcccggccaccaacaattatttttagatgtggtgtcctgaggggacagtaagggtaagccctcctctttgtccactcctgactctaccccatcttggagtgggacctgcaacatggtttattcccatcttcgggaaataacactttttagcaaagttttgatgcgccatttttttttcaacagaggagagggtctactgcatcacactcgcagggaaacttcatgcaaagtctcagaaatgttttgagctcacttaaagacaaacctgccaaactctgcagtaatggagtaataatgacattttgttcgtgctggaataccaaccatgttctctttgtcattcaaaagctgggtttttcctctcatctcccctagagcttagccattctttattttcctttggagaccagagcatcattttctttctctttcttccatgtgaagggacagccatgaggcacgatggtgcagcttagataatgttagcaaataaaagttttttaaaatattgagcaatattctcccagcatgtaagtcccagtttgggaaaaaattagggccttttggaagctgccttaactctttggggtccccatggtaccatttagtaaatgattggctctgtgcatcaaacagcaccccggtggcctgaaagagttaacgcagcttccagaagtgcccatcgaggtcccaggaaggagtctgggccttgggagatctggctcagagtacaattactgttcagctcacagtggcccaatttgctttattgtggagtgcctcctggagtcccactgctccagagacgatatagatgcttctgagtcaaatgcctgcaaattggtctttgaggggtttgtcagtgcagggaggagttgcagggatttgttagaaatacatcgtagcagcgttctcatttctagggagggaaatcatctcgccacagaaattccaaggcaaaaggacagactttttctctccagggattaacatgtctgagtggcagttggcttgcaggtggcagctataagtttcgtagatgtgcgaatgctactttgggtatgtgcacgcatgtgtgaagtaattcaaaccttgactctgccacttaactgatttctcttaaactccggctaagcctcaatttctataaagtaggcatagtaatagtacaaacctcaaaggcttgtggtgaggattagtggagctaatgtatggaagtgtaatgcatagtgtaagtgtttggcatggcactgaggcccaaaacatttagtcattgttactgtgtatcgtgggtttcatattcgtttcattcacttatcaagtatgtgttggaggtctgctatgtccaacagtgtttaacagtaatccaacattttggttgttttagcaaagttctaacccgctactttaaaaaaatttacataagcaaatgccaaccaagtctatttatatagtagaaaaaattcagatccatacaaaattttgttcaaaacacatgagtactcacaaaccagtatataataaataaaacatttcaggtaaaccaagctccctgtgtacacattctatagctcattcccctcccttttcctccaatggggttctctctcttgaatttggggtgcctcattccctgggtggatgttcacttctattagctacatataaggccatcagtaacatgcaatctagtcttacaggtttttatagactcatactgtaatatacttttacaacttgctttttccagtcaacattctatttctgggattcatccatgttgatgcatctagctccatttgtttttcagtactatatagtatcctattatataaatataccacaaattattcattgtcttatcaaagcatattcagtaatttttccctcagtttttcacagccacaaatagtgccagacaaatatttcctgtccagtacatgtgccagcatttctttagggaatatacctagcaatgaaattgccaggtggtagagtgtgtgcccctgtaactttattggatcaggttaaacccttcttcaaagtgttcttccaaccgatactctgtcagtagcacatgggggttcctgtgattccccccattctcctacgtttggtattgtcaggtatttcatttttgccaacccaaaacatataaaatattgaggtttcaatgtgcactttatggatcattaataatttgttatttattttgtcttacataaatgatctttttttcagttgtctattttgttctttttctaaaaacaagttgtttgcttttttctcgtctatttttaggagtctggatactaatcctctgtcagtggcacgcattgtgaatattttctcccaatttgtggcttgccttttcactttgtttatagaatcttttaataaagggaagatttttgaaggcttttatgttttaacaagcataatgctacagcaagacacacattaaaaatgtttttcctcttggattttgaagcccttcttatctttcctagatggaagagctcagcttaaaaaagaactcattcaggtctttgagcaggagcttaagcgaaagtggacggtgggtggtgctaggtggaagcggggcagcaaaactgccttccgtggaggccacggatgcccggaatgtgcacagcagctgaccttcctggtgggaactaggcacagggaatctctcaagaactcaagtcctggacctagggcagtccctccactctggccattggtctggaatgagcccttctcatcgcacgactaggaaacttagtcagtcctacttagccagttctacaacacagtagaacaaagagaaaaggccatctgctcaaagacttggatgaaaagcggacttacgaacagggctgctacagaaatagggagggaattctgaaataagtctggcattccaaacagaattttaaaactcatgacttctactaaatagtatcctaaataataaggggaaaagtctgcagaaaaaggtgatcaggtgggatagaaatacagaaggggcagataagaaagaattttaaggaaactgaaaaagagattaaaaacaacaactcggactggagaagaattttttaagcctggaactaaagccagaaaatgtaagaatagattgagaaatttgatttcataggaatttcagatttctgtatagcaaaaccaaacaataacaaattaaaagacaaaatgacaaactcaaaataactgcagttatattatggcctatctaacattttttatatacaaagagctcttttaaataaataatagtaaaatccctaataaagtaatagggtaagaatagaaacaggcaatcaagaaacatgaaaagaggttatccaccctaggaatcaaaaggctgccattgagatgagatattttttcgcttctgaagtttttcattaaggatgagagagcacagcgatgctcagtgttgccgagggtgtagagaaacctgtctgctcacgggaggcctggagagtctaatctgctcaactttgtctggaagctgagttagtaatatgtactaaagtgctagaaaataaaagcacactctttcacttgcaatcccactttttggaatttatctaaaggaaataatcaaatgactaaaactgggatatctgtacaggatttgaaatggtaaatgaggagaaacaggaggggctgggtgagggctgaggaagggagaaacctggagaggcactcctggtgctcctatgggggcagcaggcacctggcagggccatccaccgacgccagatgcagcaggctgtggggaaggcggtggactgggctctgtgtgtttgacatcttaggggctcgtgttcaggtggatgtctgagcagttagagaatctggaggcgttggtatagggatgatggttgaggctgtgagggtgggtgacgtggtggccttttgcatgcacctgggaaaggaagtcgagctgtcagcttgggctggtgaagggtggcatggcaggcagtgctcatgccctgcttgtggcattgctatctctgaccaagtcccatctgttgcttcaggcctgggaacactccgtggggatcatctgctttcccagtctccaaaggctggctgaagacgtgtctgaccagcttgcccagcaactccagaaggcccttgtggggaagcctgcgggtaagagcatggaggtgctggcagaccctctacagagagcagtgcagccctgcatgccctcccaggcctctcaggcccccctctgctttcgcgtggagctacagtgttgcctgccaaagagaagtaggccccactctgccactgagtgccttagggaccaagggaaatgcaggaggagggaagaggggtcggggagccctgctgttcctgggacacagacatagacaaacacacacactgcacataatacattatacacggacacacatagacacactacacacagatgctatacacacacagacactacacacagacattatacacagatacacatagacacacagagatacagagacacatacacatacactacacacacagacatacacactacacacagacacatacagagactactcacagaaactacacacagacacacactctacacatgcagacacacccagaacacactacacacagatatacacataggcacacacacacagacacactgcaacacagacacacacacagaacacacgggaccacggtctctgggaggaagtgctaggattgaagatgcacctgtgtgttcagtggagctcttggtcctgaaaagacacagaggccaaagtgcatctcttgtggggcctcctgacttgcattcttcccctcatgtgcgctggtccctggaggcagggcagaatttcacagtggctgagggccgagggtcaggaggaaattctgaggggaagaaattgctcagcatggtgtagatttcaggaattcttgcagcataagagactgtgtgatccaggaagtagggggagattctggattgtggggagtctgatagccgattagcttgttcttactcattggcaatcaggaaccactgatggttgctaaacggggacggtggcacaaaaaacgctgtcttccaaggagattagtctggcagggtgtggagcgtttggtagagatgcaggtggccttggggatgtgtaggcaagatgccaaagtcctctacagatgctcaggcacatctcctgggaagagggggccctggatggaggggaagctgagtgggcaggtcgctgtatgccctgctggtgacactttcttccagagcaagctcggttggcagctggacagttgctgtggtggaagggggacgtggatcaggatggctacttgctcctgaagtcagtgtacgtgctcacggggacagactcggtaagtttcagaccatcagcctctgccctgggcactgctcatctaggtgcagagggaggtccagcacagggtggtggcatatcccaagagggtcattcgtttcataaaacaggtttattatttctcctccctcctccccttctggtgtagaacatggacttcagagtctgaaattcccaccttcccagttgacaagctgtgtgtaactgtggccagattgctttacctttctgccccttggttgcatttctaattttaggattggggataataatgcctctcttctggggttagtgtaggattgataacggctgatgtttattgactacttcctacctgtggggcaaggctgggtgtgtcccagacatcgtcagttaatcctcccaaggaccctatgagtcagatcttggtgatgccagtgagtgatgagaacgcaggcttacctacgctgtgcacctgcagtctatctgattctagaacccatgctctgagccactgttctttatttcttcctgttagagtcagcctgaacgacattccctgtaggtacctgtctcgccctcgcccagagatgagggctctcctctttcttcccttcccacccatacccaccgcatgccaggaacacagcagggaacctgggtggctgctgccctcagtgtaacttctccaaattcttccagcttctacctgctagccagttccaaagctgcttcactagatgaacccagacatgagatgggcatttgcagccgtgcttggaagggtgataggagcacatcacgcagcccttgtctggggccagggggtggtacatgacctgggaagttaactgaagggaggacctcctgacacttcttcaggtgaactgcctgcatcactgtcaggcacagcgacctgaagcacagcacgagggcgcatcacatgtgcccctgggggaaggactctctgcagtctaagtggtgacactttaacctaagggcttgtttttcactgcctgtgcatggtgcatcgggggtgaggtgggggaaggacagggagagctgccctgaggaggtcaaggttaacaaggagtcaaatacatagaagacagtacattgcactgtaaacctttctggccaaggctaggaccagcagcctgcatctagtcctgatcctggcccagactgtacattcgtccttctctttctctgacttccccaacatgtctgtcaggttaaccagtggaatgggaagttgcatggacagcattccataggttgaccccaaaggtgttcacatgtgtgcatgcacacacacacgtgcacacacacatgcacacatgcatcatgcacacacacacacgtgcgtgcgcacacacgcacacacagagggtgcaggtgcagtaatcctggtggagctgcaggcaaagccccaggaagaaagaccccaggaagctcctggcaggctggtctccatctctgcagagttcctgtcctcttggcctctgtctggcagccctgagctgtttagttgagttgctggctgtctgattgtcagtcatcacctattgcactctttggaccttgacgagatctgtctgggatctagatgagaggttggggaggggcctgatcaggtcctcaccattgttgctcacacacatattatcagcctcacctctggactgctttcccttcctaatcatgaggccctggaccacagtcacacagtatgatttgttaggaagcccttatgttctaatttctacagtccctccccttttccctcctttccaccctccctccctccctctctccctccctctctccctcccttccttccttccatctatgaatcttataaaggagctatagagcacatagtaagcactttatataaacttaatcttcacagccaccctaggtgcatcctctggttgtcagcatttcacacttgaggactggagcccagagggactgtcccatggcctcactgaaatggctgcaggggcctgatcctgggtctgggctgacctgcttctgctgccttgctgcctggggtcacgtgtgctcttctcttgcaggagacgctgggcagggttgctgagtctgggcttccagccctgctcctacagtgcctttacctcttctttgtctttcctctggacaaagatgagcttcttgagagtgatcttcaagttcaaaagatgttcgtgcaggtgagttcaaggagggcctccaattccctgggtcaaaacctcacttcggggacagactctccaatgcttcccgtagatgcttttgtctttctcagccctggttcctgaactcctctgttctcccagagggtctaacctccccctcccctccccaccactgcacagtctgccccactagcaaaatagtagccaaaattttctaaatataagctttgtacccacccctgtgccatggcctcacatgggtcacctccaggattgctgtctgccatcacaggatgtaaatagtgttgtcatcctgggtccatacaaactgaggcatggtgagtgagcatggggtctggggtcatagaagtcttgggtggggctgggattggcacccttgagtaaacttgagtttacatgttctcggtgcctcttccttcctctcagaagacatctcaggcctctaagcatcaaatgcaatttccttctgtcattccccatctttcctcttctctttgactgactaacttctcacctccttcccctgcccacttccgggcagtttctgctttctcaccttctgagactctgagctctctagataacccttcctgctccctgagcttgcaggggacggtatggaggatcgtgtggcccgggaggatacagaggactgtggggcccgtcgctgtgtgtccagtgtctgcagtgtctcacacagagcaggtgcctgtgactgttcagtgaattcccaaatgcagctgtccatggtacacacatgtccacattggcatccacattagacgaattcccaagcccattcctcatttccagagggtagtgcatgagttctggcaggttccattaacagtgggttaccctctgagctgcatttgtggaaatgtaggtgtcatctgcttgtatgtaaatcatattctaattggaggccaggacgctgcaccaggcactttcacaaatgtttactgtgtggcttttaggtgccctgaagggaagtagtgcagggtctgtcttcgaggtcttctgggtatgtggacagaatgtgtgccacagggaatagaccattcctgcattgctcaagggtttctgttacttcatttcacaaaaatatacagagcccctactgtgcgcagctctatggcagacagatggttgctgcagcaagcatagggcttcactttgagaggtgacagaaggatgaagaagtcaaacaaggggaaaacaatccaggaataagtgtgttgttagcaattaaaaaaatagagatggggcttttctctgttgcccaggctggagtgcagtagttagcaattttttaagtgctatgtaggtaaagccaaaggtatactgggcaatgatggtgacaggcttttatttgtatgagagaaatcagtggagtctattctgagggcatggcatttaaccagagagctgagggttgtcagggtctgaggaggtagtgtggccgggtggggtggaggaagtggagaggagcagagaaatggcaatgcaagcccagggacaggtgagaccttggtcacatggccacagctacctgcaagggaggcagggaaatgggacctacagctgtggtccatgaagcccagcttctctctgtatcagactagaaggggaaaatgtcttcccatggaagtagcttgtgatatttgtcacactggcagcaggtcctgttggacccccaagagcccaggggggagctgcagtggataaagtgagtgagaaggcagtgctagtccatgcaggatgctatgggccatgctacggtggtgggattttatcccaagtggagagggaggttttgcaagtccctctgttagccatcaggaaaggggattggcgggaacaaggaacccagttaggaggctttatgctgactcttgtggtctcatggagaagtagagtctgagtgtcaacaaggaattctgaaacacttccctttttaaatagcacaaggttctgttaattctataccttaattgtgggtgacattttctggtattcccattaaaaagacacaaattcaattacttctttattattctgatttggaagggataacaattacttgtatagggttaatgcggtcagaattgagccccaggccctgccaccctttcctagggggctctgttgaccctgctggtctgggacagagggtgaccccattcaatcctgtccttctcacagagacatgctcatcagtgctccagagaagtagggaacaaatccatctgaggaaggagacttcctaaccaggtctccttgactgtttatcttcttatttttcagatgttgctcaatatttgcagtgactctcagggcctggagggactcctctcaggaagtgagctgcagtctctgctgattgccacgacctgccttcgggagcacagctgctgcttctggaaggaacccaccttctgcgtgctaagggcaatctccaaggcccagaacctcagcatcatccagtacctgcagggtatggcccgggaaattagatgtgggctgtgggccatgcaagggcttcccttgaactcagagcaaaggctgagggcccactttctacaatgagacttgggatgctcttgcagcctcttatagaattttgggaccaaagaagagatgaatgagcagccatgtccggtagataattctacatggcttggctcccttcatgtaagtgcttttcttgttcattttgctgctccattggagaaagcagggaaagaggatctcactatgcacacactaccaatcagacactgtgctgggcccctttgtacattatcttgcttgtttctttgagatagctattaatgccattttagaatggggaaaataaacattaagactagtagaagaatttttcaaggctattcacctagttaggaagagaatgcactttcaaacttaaagatgcctgattccggcaccctcatttatacactgggaactatgtgtaggggttaaggccaaagactctggagccagacagccaggactggactccagctctgtcctcgtagctgagtgatctcaggcacttaaccattggggtgcctcagttctctcatccgtaaagtggggataataatgctgctgatcttattggattgttgtgattctttgcggctcttctgagtccttgcagctgagaggctgagcttgcattatctcaagctctcataggtactttctctgatccactggattggcttccccagcactcagaagaggcttctcttgatgagagatttctaaaaacagtgacccatccaaatgcaaatctgaggacctctctcttcagactcaaatcttcccctggctccgcaccactctggtggggtagccagtaagccccatggcctgtcccctaggaatgggccacaccctccttcctctctgtgggccacacttcagtgttccaatcccctggcttcttcagtatccaaagcaccccatctttttaccctctgcctcctcacatgttcatacatcctcccctgcatttttcatcaaggtaatttctgctcagctccagcattgcctccttaaggtctgagatgagctcaggtcttgcattttacatctcactacctaatggacctggactcccccttcttgctgagaattagggacagagggctgaggggctgccttcctctcctgtgtcacctgctgggcttgcagagtgcagctgtcaggatggcactttctctggggtggtcttcctgatccaagagccagcagaacatgttttggattaattcccattcatgtcttgacatgttgtttggagtaggggaggtaggtggaccatggcaggaaagctcttgcttccaagctcagcaggtctctcctgtgcttccctcctgcagccacagactgtgtcaggctctccctccagaacctctccaggctcacggacactctccctgcccctgaagtgagcgaggctgtaagcctgatcttgggattcgtgaaggactcctaccccgtctcctcggctctgttcctggagtttgagaattcagagggctatcctctgctgctcaaagtgttacttcggtaagtggctgtgtttggtacggggagagcacaggaccaccaaagccttagtcctcagaatcattggggtgctttgcagaaaaatagatatagctccatagaacatggccagagagacctcttatttgcaaaagtgattcattgtgcagacaggcatggggaccacttccttagagaatcagtagttttacaaagtgtacttgtaggcacctgtcacctgcatgcctgctggcctgattttccccggtcagaacccaaacagaagccctgtctgttggagggcttctggcactgctgtaagctgccctgcctgtgtgcttggagggctggaaaggtctggaaatgaaccaccttcaggagcagctgcccaccaatgactgaaggtgccaatgggtgcacatccagcacagctgcccttgggtgggcttgctctgcatggcctccagagctccccagaaggattagctccagtggccccatgaggcgcttgcttgctaatgctcttggactggtttccttcccttccctgtctcacgtggcctctcccctactggtgttttctgggatcaactcccaagtgaactacctctttctcaaatccttgaaacatgggaaacccaagctcagacaccgttcagcagggcctgggctggctccttgccttccactctgccttcctgtatcatcttcgagtggggcccagggattacagacagcaagggatggaaatcaaagaaatgccttgatggcccaagctcctctgctgatcttggggaagctgctatagggcaaggccacatactttcccttgggctttgctgggcgagaatgagacaccctcctcctctgaggggtatatctactaccgcacttcacacacttcactacagagccaggctttgagcctacatgcggtgacttggacaagggggccaaagtcctttggtccaccaagtgtccagaaggatgtgattaaatggcaataccctagtgccttcctccaaagggacgctaagtgtaaatgcccctctgggcacatcacattttgcattggtctgggctgtgaccagctgactatgatccccacggaggtctgtgtcatagcatttcctgaacaaatttttggttcattgggtgttgagttttccccagaattcttgtggaaggcaggagaggggacagaaacctattccagggagtgccaagaaggtcccacgtgggctcattggctttcctttttgccttaactgaagtcacgctgcaagaacttttcctctggaaatggcagggctggaataagacttgagatgcccttctccacaagaggagcaggacagcctacctgcccataattaaaatacaaaagccacactcaacctttaaataagcacaaggaagtccgactatttcccacaccattttgttgcaatgttgaactattatattacatctctcctttgggaggtgccctgatctgctgatgccctaaccacatgtcttttggaggttcagtcatggaaagtgacttcctgtgagcagatggcatagcttttcacaggttacaaatgcacttctttggatctaagactgacatctgcagagtggtgtttatccagggcgctcccttgcctctgaattgcctcaggtgcagacctgtggggtcttccccagcttgcagatccccattggctctgtctccttgagagcaccatgcacgcatgtggctgctccatctaggaagtacagggagctggcctcatctgttcccccaggtatgatgggctgacccagagcgaagtggacccgcatctggaggagctccttgggctggtggtgtggctgacaacctgtgggaggtcagagctgaaggtgtttgacagcatcacttaccctcagcttgaaggcttcaagttccatcatgaggcatctggtgagtctttcctgtgtctgggtgaccggaagagtcagtgctgagccctgagaaggctacagagggtcttctcctgattctttgtgtacctttcaatggtgcagtaggctctgattctgtcacaacctttggggaggttatgaatatctcccatgggacttagtggaaacattgcttaataaaggcaaagactctctcaaataacggaggcagcctctacttctctccctcacccctggggtgatttactctgcaacatttgcttatataatggggactgatggccctaaaacagccatccaggttcagagtcagtgacttctcagtactttgagacattgattgattgatgaactcaatcagcaggcatggatactttctgtgtggcaggcactctgccccatgctgggtgccagtgtgaacaggccagttgtctgctccctaaaattcctctgtagagactgtcacatgtccttgaaccctagtctgctggagaatcggctaagaaatgcatcaggcacagccatgacccagctcagtcaggaaacctcgaacagagggcctgccggagggagtttttaaggctaagtgtgggttgtctaggttgagatgaagggagaaagtttaaaggcagaaatgacagtctggggaataaatggtggcctggaaggctgggtgagtctgggaagtgagagcttctgcagaatagaggcagggaggctgcagtgctgcagagttcaggttaagaagggccattggatgggatgcagtaacacatggggcacagacatggtttaggggagtgcctgaatcagacaggagtttcacaaacatctctgttatctgaggcagagaaggctggaggcagggagctttctgacaaagtgtctcctgggggagagagaatgaggcttaaccttcaagctggaggaaaaggtaggggtgggtcaggaaagtgtaattatttatcagcttgtctagaaacaaaactgattttgctagtaatctccaacatcatttgattttaatccgctgaaaccaatcctcctagcccaatgctctccaatggaaatacaatgcaatgcacgttatatcattttaaatgtaaattttaactttaaataagaagaaacaagttaaattatttttgataatatattttatttaactcaatatatcccaaatattaccatctcaatgtatggccaatacaaataattgtcaacaagatattttgcatcatttcctttgtattatctttttgaaatctaatgtgtatttgatgttcatggcacatgtcagttcagagtggccacagtttgagtgcatcttggaccatgctgcactagccttcttcataccccaggtggctggcttttctggacttctgatggacatgtgcccataggagttagaacacagaaacttcaaatggcatgccctcttagtaatgaaaacatctatttgtagacacaggcaggagaaatgacttgtaagatcattcttgttttcctcctcaggggtgactgttaagaatcttcaggccttccaggtcctacagaatgttttccacaaagccagtgactctgtcctctgcatacaagtcttgtcagtcatcaggaccatgtgggcctggaatgctcgaaacttcttcctgctggagtggaccctgcagcccatctcgcagtttgtagagatcatgcccctgaagccggccccagtgcaggaacacttcttccagcttctagaggccctggtgttcgagctgcactacgtgcctcatgagatcctgcgaaaggtacagcatctgatcaaggagagccctgggccatcctgcaccctcatggccctgcagagcatcctcagcatcgctggtggggaccccctcttcaccgacatcttccgggactcagggctcctgggcctgctactggcacagcttcggaagcaagccaagatcatgaggaagtcaggtgccactgggtgcattgggagggatgggcaggggtcagtgtcagccaggcctgacctttgggccaatctggctgcccatcaaatgcaacagaaagtgagcatgcccatgtcactgggaaggtatgcttgggacacacagtttcacaaaagacaggcagccacccagtcttcccaatgaagaagtgaaagggatgggtgaacctggggctaactcaggccttgtgaattcccaggttttagatatctcttgtcctagacattgtgtgggtgtatagacagggagactgcaggggtctgacagctcctcaggaatgggagctcagagaggcctgaggtttgggggccctcctggggtctgctgggatatggcttcctagctcactctgttcactttgcactgttggctcagtggtctcccactgggagagagctccttggggtcttgcgggcccagcacgcccctccaagtcttggtgccctgctgggctgcatacctgtggctccttggcaacattcccttgcccctacttggcccctgcaccctggagtctcaatcccaatagcctctgctgtcccctgaggctttagggtctcatgagggtgcttggtggctcaggggttgggctcttgcactgcctcaccatgctccccagcacatatcctgctggagtcactctatgtggtggtctttaactaccatctccgttgactttctgataggaagcaaagtgtggaaactccttccccagctcctctggtctttccctcagtctgtctacacctgctgctctgggaaatcagcctggaagagggacaccaggacacaagaatctggatgcttactctgcccaccttccctcctttcattctccttctcccactgcactggctggaagggtcagggagctctctagcctttggctgcttctgtaattctgcttcagacttaagccaaggtcaccagtctgtctgtttcctgggcctctctgagggaaaggagctaagggctggaatcctggccatgctactgacaaactgagtgatcttgagaaagtgacttaacccgtacgagccgtgtcttcctcggtaaaacagggtaatgatgttgacatcattggaatgttgtgagattttaacgagggaatctctgaagaggacccactgctgtgcctggtacataacaggggctcaagaaacatcagtcgccttgtccctatagttccagtgctactgccatagactgagacagacacccagggaggagctcaggcgtcttatggaggccaggatggacccagctcctccctgggagtgtttgcaaataggatcaggactgcgaaggatgagcccaagggatggtttttgtgtctgggcctctgggccaagccctggacaatattttatgagttgctttctactgcttagtaacttctgtccttaaatcccatcttgaatgaaattaatgtattgcttcatccgctttccttggtgtttaaatgagaagtctttgcaccgtctctttgtttggtggttctgtcttatcttagctggtatttcttttcagcagcctaacattgaatttgcttttaaatgcaattccagacccatgaccactcctaggagaaattaaacttttttgtgagctcatgcatctagtcttacttcatactttctattgttaaatgtgtcttgttgtttcttagatactctgtctcctggtttataaactctattttcattcattcattcattcattcattccccaaataagtattgagcttccaatttgtgtcaggcactttgctggcatggggattcaaggtgaataaagagatctgattttgccctcatgggtctactgggatcacctatttactccaggttctcttgagcttccccatgactcaggaatgagcaggcagtcatccctcccaaggatgcatggcaaactgtaaaagtggccaaaggaaaattaagaaggcagggctctgtgtatcatctggggcaatgcttctcaaagagcagtccctggaccagccccatcagcattgcttgggaacttctcagaaatgcaaattatagaaccccatccaagaactactacctcagaaattctggggatgggacccagcatggggctccgggttttaacaaaataagccctgcagggaatgctgatgtgctcaaaatggagaacccctgctgtaggggtaacagccttctatcttactaattgggatacacactcccttatgatgaaagcattatattcacatctccttaagaggatagaaagctggagtcagagatttgcggtcataccacatgtacttaatttattttgttatttcttcttcaatatggcaggaaacaaagtgtccactcctggtgttcaggatccagaaagagaactcacctgtgtgatgctgaggattgtagtcacacttctgaaaggctcggtgaggaatgcaggtaaggatggtgccaagtttgcctcatcactgcttggtaaaacatgaactctttcctggttatttatggcagtgttcacaggttatactcaaggagtaaccaatacacagcgttagctgtggctaatgatcctctcttggccgatgttcagtgatcatcagtaaattcgtagatactatacctctgttgacacttttcacttctaaggttgctaaataaagttggtgacaaaaagactatgctcaatctagcattttctaaatttatgagaaaaatttattagtgtcctgctgcactgactgtagatgctttttaatttttttttagatccaaagagtaacatacgggcaaagaaatctagccattttaaagaaatgcaatttgttgtgctctcatcagacatgatgcacttagcaatgtaatccattcaaattttcttttagcgtcctaagatcatgtggcttctgggttttaaaaataatatgtgcatatatatatatatatatataatgacatagacacaccaacatcatatcagtgggtttggtgatttaggcatctttatctgaggccttcacagagtaactatacctaatgtaaaaaattatttcattatggcagagagagagtctttaacatttagtctgcaaaaggttccccggaggtgctggctaaatgcatattcctaggctcacagccagacctttaattaatggtcagtcaaggtggagctcaggaatctactttttttttttttttgaggcagagtctcactctgtcaccaggctggagtgcagtggcatgatcttggctcactgtaccctccaccctcagggttcaggcaatttacctgcctcaacctcccgagtagctgggactacaggcgcacgccgccatgcacggctaattttttttttttttttttttggtattttagtagagacggggctttaccatgttgaccaggctggtctcaaactcctgagctcaggcgatctgcctgcctcagtctcccaatgtgctaggattacaggcgtgagccaccacgcctggccaggaatctacttttaaacatgctttcaaggtgatttccatgtcagaggtacctagcccataattggaaaaatcctgtctgctcaaatctccatcaagccatttgaaggatccagttgcctcctagtttttattccacatggattactccaatatcaatcctggggaaaaaatgcttggaattacttttaaacaaaaatatatcacctgtcaggtttctttaattttctccccaaggaactatctagaaattaaatatattcttagcttaaattgtggtttgctttctatatgaattttgtcagagagaagacagaaaattgtcattggctctggggaagaaattatggggaaatcaagggagaggtagatctagttaaagcttttattacttaggtttctatttttttttctttttttaccccaggaattcatgacactattattaactttagtcaccatgttgtacaatagatctcttaaacttatttctcctttcttgaatgtatctcctatggggagatgttagtcattttttttttcaaaaataagattctcattggagaagaaagcagttttttaaaaaaatcatcagatccacagtttcttttttctgcttctcactttaacagtgggtatgggttaccaaaaaatctaccagtgagcaaaagagaaacaaaaaatagcaaaatgaagtttgaaaattataagacaaagcttttcttttgattgaaactgaagtggcaagcttcccccttgccctagccccattctgtctgtctgatccttagttgtcctgaaggaccacggcatggtgcccttcatcaagatcttcctggatgacgagtgctaccgggaggcctcgctcagcatcttggagcagctctcagccatcaacgccgaggagtacatgagcatcattgtgggtgctctatgctcatccactcaaggggagctgcagctgaaactggatctcctgaaggtgatttcaagtcctcctttgagattggcttccctgtggatatgcaccaagcgatccacatttgctcaggcatttgtattcatgtaattcagttagccactgtatgtggcaggcagtaccctgtattaggtagcgtcaggtgctgtaacaaataaatcccatatcctcagtagcctggtacatttgaaatttctttgcaacatacagtccagtcaatgattggtgactgtcattaaggaactaccatcacctgggcatctaacttggccagcagacaagggaagagagaccatggggaactgcataaggcattttcattcaggcctagaactggcacgggttattttctgtccaattttctttaggaagaactttgggcaggactcacctggatgcaagggatgctaggaaatgttttccctggctaggcagctacttcccacaacactgtaaactatggaagtgcagctcaaatcagcaatggccaagtagctgccttgttgatctgatgagcatttattgagcatctaacccattaccagggctgatgaagagtacctggggcttatagtcaattgtgatacaacccttgccctctgggagctcatagcctgtttctaataagtaagcaatagttacattgcagtgtggtgggtgcattggttagacactgagggcaggttgctatgggaacacagaagtaggagagaccaatgctgccttacctggttgaggaaggcccactggggagagaacctgtgagctgtgaaaaagaagcaaaaggcagtcagaggtgtggaaacacggggcacaaagggacaagtgaggcagggttatcatgtttgggcaacagagatataagtgtatgtgtttgtaatattgttaacattcatcaatttatcttaaaatagttaaatacatataacaaatatcattcttgccatctcttctgccttacaactttcacagttttgttgctgttccttttttacatagcttttgtctttgtgagtttatgacttttaaaaaggattgcttgagtgatcctcccacctcaggctcctaagtagctagaactatagacatgtgccaccacgcttggctaatttttgtattctttgcacacagggggtcttgttatgttatctagtctggtcttcaacttctgacctcaagcagttctcccacctcagcctcccaaagtgctaggatcataggtgtgggccaccgtgcctggccaacacgctcatgtttcattaacatgatatatttgattgttggtgaattaaaaaaaaaagtgaagttgctctgatttccaaaattaggtcaatcatcaacctaacttacttaagcctatctctatgcaaaacctttttaacatttagagaatggtgtttgtttcatcatacttactttatttctctgcacattcgatgtcagacattgatgtgagctgttccagttattatgtggcctaaaccagcagtgattggtgtggccaaagcattgcgtggtccatccaaaagtggcgtcatgaccataatcatcatgtttcacagatgacaagaacccagccagtgatttaattgcagggccatagaatcagtggaagtgatttgtacgaaacaaaaaaaggaaagttaaataccttttgaaagacacttgaatcccatgattacttgaggtaagggaagtgagagggatgggtgaagcagagagtagggtaagggagagatatatcaaaaataaagaaaataccagagctaggaattaccttagattcatgtggtccaatctcttaatgttaaaggcagagagacatccagagagcttcattgactaaattaatattgcataactgctaaatggtgaagttgagtttgaatctaaggtgagcaactgaaaactgagagttcactccacttcactgcgctgtttggtacattttccttcatatgtccatgttcagcgtgactggcatgttctggcaggataggaacagggaaggcatgtcctaaccagtcaggcttgtgattttctattgggtgaataattgttcctgacagtaccatatcaaaagccaaacagatccacagagaggaaagttttgcttttactttgcttgaagagtaaaagtatttttgtgtccaatgtagaaaagagtgatctgctttgctcatagaaagttccttttgtttactctgtagcccagaggcatcgtattggagtgtcagcccttgggcaataggactaaatgtctagaattagtaatgtaaagtcgttatggtgttttacagattcaatatcatttcagaatcacagttatcaagagagcacataagggaagaacactggtgagcttatttaatgaagtcatagcctgcactcaatgtgctatcttctccctgggtgccaagtcactgctgggcagttggagggcccaggagctggcattgttttccaagggctagggctgtcacactgctgctctagggggcacttgggaggaatggaacctcttccagactcgcccaccactgagtcacatgagcaagtggtgaaggtttgctggaatcagatgtgagatctacatttgtttctaagtcatcatgggaaccccctgaaactttggaacgaagatgctaagtgaattgcttctcactggatctctctctttagaaggtgagagccaactctgcccatagggactgtttctacaaagtgtgtctgagtgggatgagagggtgccccttcttataaaggtttcccatctccgaagggcattcacagcatgccatcactctgcatcccttccctgtggtctgtctgccagccactctggagaagcaacttagggcagttatttcaaacaccagtggcacttccataccaacactgaagaacatgtgacttcaccacctaattctggcaaatgataactgagttaaagaataatgtaagcaaatgaatttcctctccttggccggtgggactgtgattgggttatgcacaaattcagattgatttgctaatatacatttagctgttcaactctgagcttaattgcattacctcaccggtattccaccatgacacatggaaaattatgaggaataacaaataatagaatgtgaaataaatcctgttagtcctaacgtagttagcgctttacagcagacatccattttatagattcaagctggaggaatactaactcagagacgatgacttggtaactgagttaggatgagaaaatgtgcttaacgctgacctttcttgaaatgtgtcaaccccagcctgattactttgacttcagctgattaaatttactcccctccgcagactgaaaaccctatgtgatgcattatcatgcaaagttgaatgacagtaatggagaccctcctcctagactccccgttcctgacaaatcatttcccgaagtagagaagtatttattttcctttatgatagaaatgtttctctttagttgctatgaaattaagcctttgtaattggattttggactctttactttatgactctgcaaatatgaaattaaccccatcccaagaaataatagaggagtctaagttctaatgagattacccccattttagataatgactctgaatttaataaatcaaacaaagcaacaattaaggacagccattccttcctcctctccctcccaagaggaggaaaagaaaataaccatctaggaattataggtgacaaacccactgagagacacagatcataatgagggtgattattgggttgctttgctttttaaaatatctgcttcaacactctttgagtgatggagttcttttaagcaatattcagcatcaaattggacaactgaattgggagggggttccttgggggaagaggggtttatagtggtcacccagcactcaggcgattgtctgtaatctgatcagttttgttttttaatcattctcccttcctgatgtttgttttgtcgtgtgttatgtgactaacagaagcgcttattcattccatttgccttaaacaaagctcctagaggtcttagagccattgaaagcactcacataaatttagtctgtttaacattgtagagcttaagatttcctttgtgacggattgacttttcatggcatgtgtcacgtgaccaggcataggtcaggttcagacgcgtgccgtaccacatcgcagtgaacagcctttggtatggtttatcagttagaaaggagggaccaaaaccaccacacacacgtcaaggttggagtgagtttccaactcaaccataaaaataacatttttttggaagtgagttgctcacataaggcaggcacagatgcagcatagctgccttagcctttcctgaccctggggcctccaggatggggcagggacaggcagctgctgtgactctgtctacacagggaaaggccttgcccaacttaagccatgagctttcacttatgcacactgagtaccaccatcctggaggaacctactccaacaatccacatgctttgctttgagggtgtgtctacaaatgtccaactttcctgggttttcggccaaattcagaaagaattaggccacatcctcactcgggaggagaaagcagtatcattgcccccatctttcaggtggcctgggaagtcaatttccctgaagtctttcccacgattcacacttgactgccccctttagtgggtggccttgatgctgggtttctttcaaagagcaaaacgacaattcaattccctgcagtgtccctctgagaagtggtgaggtatcacagatctaaccactgtgagtagtgtgttttctttttctataactgggaaaagatcaattggcctgtattggtaaggatgaatctttctacctcactttatgttatttgtctattttgaatataattatggactttggtctttcatagattctcctagtaactgcaatctgttttgttttttaaatttctggaaatgtcatagatggggccctggaagccctttatgcatatccttggctgctgtttctcttcatctttgaaagaatcctcgcctgtgtgcactaagagagttcaggctcctcctgtgttctctgacctggaatgtgagactgactactcgcccagcagctcaggtttcctgtagtggaatataacattagagaataaaatcccagtggttggaacacacattctattgtttcaaataaacaccactgttaggttagggtgccagcatttaagagatggagctggatactcaggaagctgaggcaggagaatcacttgaactggggaggcagaggttacattgagccaagatctcgccactacactccagcctgggtgacagagcaagactccgtctcaaaaaaaaaaaaaaaaaaaaaaaaaaaatggagctcccaaagtgcatgacttcatgtttgacagtgacctgtaactttactaagtttctattaactaaaaagaatttaaatatctagacccttcccacatgtttttctgagctaccagttttctctttttcactaacttccacgtatcatactacagactgttgcttaggccatgcatttaagtcacagcatcacccctcccccagatagggagtgtctattttattttttctctgtgaaccttgtctcaggcctcctgaaactgactccacactgtgccttctcagacaatccccttccctgtcacactagagcattaaatacctgaaaagataaaacaattcacacctctctccgcagtctactaaggaacccacaaggttgtccactctctaggaaacacacatcaaatgcctgagttttagatggagtccaatgcaatttatctgatcaataaataagtactaaaaattacagacttttaatacttatttaaaatcgtccctgtgtttttcacatttcgatgaagcacagtatgagaactgcttaaatgtagccccccctccctctctctcttcctccctccttccttccaatagcatgtactgattacctagagtatataccatgcactgggcccaagtaagtaagtgctcaagaaaggtttgattttagaaggaaataaaagcttggctggccagtacagctctcagtgatctggagggtggtggattccacgatgtatcctatcagtggcctaattgctttctgcacacttggcctatgctatgtgttatacctatgcatttcattccattgcaggtttctcttctctttctgacacactcttttcacaccacattttaagttgattcattttactgtttcccctcatctaatataaccgatgaagccgtgcttgcacagagagggagataaggaataacaagctgcttctatgaggatttcactgtgtgtctcctgtacagtataagagatggttcatcccactcatttagcaaattgtcattaagtgtgtgctgtgttccacagtagtaaggaagccagatatggtttccatctcgtggagcttcagtctggtggagagctgagacggttttcaagtagctgcagtagagtatgacgagagttttgatcagggaatgagagggggatgtgtgagcactcgacctgggatgagtatgagctacaggacagaagctttctggaaggatatgcattcatgtcaaaaaacaggacagttaaatcaaccgtatagattagtgtagtaggcacacatggaaaacctaaaccgtaagaggaacaatatggagatcccaatgtttcagagtgatccttcctgtaacttgttggcctgaagtcgttgagggaagagctagtgggacgctctggcaggaatgtgtgtgggctcagggttaatctacctcctggagtgcactcattttgatttgcttggtgtttcagtctctgctccggatcctggtgacccccaagggtcgtgctgccttcagagtctccagcgggttcaacgggctgctgtctctgctctctgacctggaaggctccctccaggagcccccgctgcaggcatggggagcagtatcccccagacagaccctggagctggttttgtacactctctgtgctgtgtccgcagcgctgcactgggaccctgtcaatggctacttcttcaggaggaatgggctctttgagaagctggccgaggacctctgcctgctgggctgttttggagccctggaggaagagggcaacctgctgcgctcttgggtggacacaaaggccaggccatttgcagatttgctgggcactgccttttcctccagcggctcactcccaccccggatacagagctgcctccagatccttggctttctggacagcatggccagcggcaccctccacttgcgtggggacctgaaggagtccctgaggaccaagcaggggccggttgtggatgttcagaagggagaaactggcagtgacccccaacgcaacttcaagcagtggccagacctggaggagaggtagcttcttctgccagtgtgtcatcagtgcatctctgtctcccattctcactctaacgtcttgcgcatgtgtactcagtaggaaggctcagctacagaatgggtgtgcagaaatgtcatgtgacctcaacttcctcaaatcaagttagctctgactccacactcttctaccttgggagctgatggaaaattcaatctgagtcagtactgggttggaggatgctgtcgagtcacataagaaccagggagggcaggaccctgctgctacactcaccttctcctttgggatctttactgtcctagggagccctggtgcctgggcctggcatccctgggtgtgccaggcagcctcggtcttctcaggttttatctcctccccaggatgctgccaggggtggggtgagatcctttgatctgcaggacacaaaccacagtgtccaccccaattatggaactctttctgttctttcttgctgcttctacaccccctaacaaagacaattgctctccttacttccgcaggccaaacacctcaatgagttcagactttagtaaacaactttttcctctcatgtctgtaacaaagaattccactaaagcaagagagcacaaagaaccatccctaccccaacccacttggggtgggagggaaaatgaaagaacacaacagtaacagttggtgtctttttccattcctctaaagcataaatgacagaacacccattaatactgcagtaagttatccttctgaaagacactgcatttttatccagagtgccccgtttgccagacttcagtgttggggatggtagagagaaggatgcatgttaaatctccacacattgagataattatgatttttgggggttaatctggcaaattaattggtttcctaatcttgcattcctgcgcaaaccaactcattcataatctgtgtattgctgaatttgatgtactaatgtttaaaaaggatttttgcactgatattcaggaggttggcctttcatactcctttcctggctatttttcttgtcagatttatgctagcatcatagcatgagttggacagtgcttctcttctatgctactgaagagtttatgtagattgtttatttccgttccctagctaatgtgacagaacttgcctctaaatgcttgtgaacccgatgttttcttgtgagaaaatttattctcatgagaatgcacttctgtttgttcttgaattattcttggtttgttattttgcaagctgattttcccatttcatcgaagtttccatttgtgggcatccgactgctcacgatggctccctcacgctcttctgagcagaacttgtgagttctgtgactcatttctaacctgtttacctgtgtcttccttgctttttctgcttcagcactattcacaattgtttacttttcagtgtgccctatgaaccaactttgacttttcctgtttctcctactgtttttggttatcatttccttctacctttgggcttattctggtgttctttttcttaacttggatgtctgtttccatcttctttttacatgtaaatttctctgtaatttgtaagttttattttcagtatcatttagtatgaaatatttttctaatttcccttataaattatagttgactcttatgtgtttgaattttgaatttccattgttacagtgtttctagtcatctttgctatttacttctcactctatcaaggtgagagaaggtggatcgtctgggttcttatcctttgaaattggttgaggttgacttcatggccctcaatgtagtcccttctcataaatattccacatgtgcttggaaataatgcatgttctcagagtgttaggttcgatgttctatttatgtcccttggatcgaatttgtcaattgtttcattcaaatatcctttatcattaatttttaaagtcggcttgaaatatcagctttttgttttttatttttggaataaacaggccttattgggctcatgggtcttgagggcctctgtgtatttgtcagttttcttctccacgttctttttggcctgtttctgcagccttatgagctatttcttcttctggtagtgggtctcggccttctccttcctcttctcctccagggtggctgtcactgcctggtacttccagccagcctcttgagccaggcgccccacgtaggcaaactctcttgtgggcttcagatgcacagccttgcgggcagcagaaacacccatctagttttcctgctgtagggcggtgggattccatcgaacacctcggcgtccaaggcagcctggcctcgctgggccttgcggaccgcgggccctgcactgtcggctggaagacgctgctgggggccaggaaataacaggggcctcatcagggttggtgctcatccgcctgcggaagaaggccgggtacttcagcttatttctgtagaaattgtcagaaacgttgacactctcgcagcgcaccaccaccttccggcccagcagtacctgcttcaccacaacggccgccaggtggcccaggaggtagcctcggtctccagcactgggacctgcccctccgctacctgcggcagcggcctgggaaatggtgtatcagttattgagaacgatgcattcaaaatctctcatgataaagtggatgtgtcaatttctgatgaattttcccttacatatatttgaggttgtaagaatcatacatatttagaatttttatattcttatggagtctaaatttttatcattatatggtgaactttttatccctagttgtacattttgccttaataataataggactatatcaggtttcttttggttagttcgtgcctgggatttttcttcatcctttggttttaacctttctgtgtactgtccttacatttttaggtgtttttcttgtaaacaataaggaaccacttttgttggttttactttgtttttcaatctagtgtggtattatttctcatttaactggagaaagtcatttgtttacgctttcataattattaatatatttggaatgatttctacttagctttttacatttgttccactttaaaaaaaaacatttttggtcttatttttgaattgattttaaaaaattgtgtttcctacctactagtatgaaatttaaactctctatgattaattttatagtagttgccctagagtgaattaacaggcatactcatgtttttagttaaacagtatctttatccttccaattaagacaccaagaccttaaaactcaaatatttttgcccttttctaactcatacattactattagctaatattttaaacttatctcctgttagtaaatccatcagatatgacagttattgttgttgttttataaaatattctttggatttacctacatgctttcaatgtctgtgctcaccattcttttttgcatctctatccttccatctgggattattttttatctactctagtacatctgttaaactttcctgtagtgtgggtctatttgtggtaaactctcttggattttatttgtctgaaaactgtctttattttctccctaattgcagaaatatagttttgctgggtaaacatttattggttgacagttattttctcacagtaaatggaaggtctccccagctattgccttccattgttgccttttaaaatcgtttttatttctcttcctttgaaggtaatttgtcatttttctctggtcgcttttaagatcttcaccattcttgttctattgctttactgtcatatatctcaatgtacattattttaaacatttattttgcttcatattcattgggattcctgaatcccaactgatgtcttttataaaatatggatttttaaattatgacctcttctccatcccttttcctattatgcctttttggaactaacacaattagatgtatgttttactttttcattctatcctcccttaatctttcttttacatttttcatctctttgtctctctgtactctgttccacacagtttcttttggtctttcttaaacccactgaatctcctactagctgtgtctaatctgatatataatctagccatttaggttttctttttaaaatttcaatgacagtattttatatgtctagatatactgtttctttttcaaataaacttgatttgatagcccttttcctttctcatatctttcatttttatttcttcaaacacaagaatcataattatttcttcttgtgttttttgagagtatattgtttctgtgacaatcatggaaggtcccttgtatgatgtctgattttttattgtgaatcttgctccaagattttccttttcttggattccatagaaaccatcctcattcaggccattctgcccttctgtaggtatgggaatgcctccatggggtcttagctgccctttccaagccaggccttggccagattcccaggtcctgattttcttgcttgtcttgggaagaattccctctctgggttccctgttctctatatttcaggggcaatccctgaggaggccttttgcctgggcaccctgataacatacaggttaacttaggatcttggtgtggaaacttgtttgacttattctgccagctctcaggggcaggggagtatttgtcagtatgaaaagacatttagtaagtgatatcaggtgaagaaaagcaatagtaattagttgaatgtctatggaggctgagcactaaacatctatttatttttatttccctccaaaattttggaattttatcaataaggaaacaaaggctgagaaaggataaaaaacatggccaaaggtcacacatttagtaaataataaagctagaatttgaacccagggctacctccaaagcctgcatgcatttgtctgtgcgtgcgtgtatgtgcacacacgtgtgtgtgttcttcctgtttttttcctgatactcccacaataatagtgatagttttccaaatgtctgacacgacagcctgcagtttgaagattgggttctaaccaatggactgcgtcagtcctgatgttttagaggtgagtcctgtgtcaaatgtcatcctggttttgtaatgagtaatttttacatttataagacccatgtttcataaatagagcatttttttttctccctaaaagagatacatggcccttgaccttccttgatggttagagaataggaagtgaaactctaccccctccagggagtctgcagagtaaagggcatggcagtgggctgggaatgggagacagggtgctcgtctctgccgtaccacacttgtatgtccttgggcaagtggcttccctcagccctgccttctgcaaagtaggtcccaagtctccagggaggagggaaagaggccgtgggccttggagtcaggcctgcttgttctatgccttggtggctgtgttctttggtcctgctactttatttctctaatcttccatctcctgatttgaaggcagacataataatagtatctacattgagggaagatggtagttagagtgatcacagctgcttcctaagcatgtgtgcgccagacaccatgctcagctttttacaatggactattcttcaattcatttagtctttatggtaactataatttaaggaatatttttcataacacagaggtgacatgttatgtaattccaaaaatatatctatggtgtccaaaatacatcatatatctctatgaaacatgcaccataccaaataaacacccctacaccaaacacactatatacacatcacatgcacatatacatacaccacatgtacacaaaacacacacacaccacactaaacatacaccttacacatactggcataccacacacccacacactgcacttacacaccacacagcacctagcacatacacatgaatacacaccacacataccacctacatatgctacatacagacaccacacgacacacacaaataccacacatacacacatactacatatccacactacatacacacaccatagaatggagtgcttacccctcagcagcacatcatccacagtgcaggtctggaggtgaaagtggagcagaagcagggtcagactgtggtgggccttgcacaaaccctatgggagaccatttcacttttaccctataggcaatgtggagctagggtggtctctgtgcaggactgtggcatcatggggttatgggttatgaggactgctctacaactgggtctgtgtatagctctgagaaaagccccctccaaagcaaggcagccctgctccttcttgcttctgccttagcatatgccttctcccagcccctgccaggcctcgtgggctgacgtttattccttatgtcagccaaaggagcaaccccagtcacctttaccttgaacttaagttgtggctataacttatagccctaaggggacatcatttcaacaggaatgcggtgtgctccaggcaatagttaaggtttcatggggcactctgcaggccagagccctaaacacttactcctctggctctgctgctgggcatcctgcagcttcatcctaatctttcctgttgaaacaatgtcccctgtgggtatgagttatatctgtcacttaagtttgttagaggtaattgttgtgccagaccattgaggaagggtgggggacagtgtagttcctgaacagttcacatgaaggccacactggcctttggaaggcacagatgtgaccctgtcgttcccacttggaagcctccagtgctttcccatgattcccaggagggagtcaggcattgggagtgtggggcacacagttctgggggtcctgcctgcccatggcatgcagccatgcagccatgtttcagactcagatttcacatatgccctttactctacctgggatgcctttcctgtcttcactctgcctggacagttgcttcttatgcttttgtctaggtttagatgtcacttcttccaagaagcctcccctggcctgcccatccccatcccatgggccaaatcagatcccactgcctcacatttcctcagcaccctcagcactgatcacagtgcaaatcaatgattaattgtgtaatcttccttggtttcttatttctttggtttgtgtttgcacacttgagcatatctgaaaccaggatatgtattaaaatggatgccaaggacatcagccacttaagtcgtctcttccccatctgctaataaaggcactgtacatctatcaatttttggtttcttaccactgttgaaataagatggtgttcaaatctctttcttctgcttcagtggtgaggcccatgtgagcatggactgggtctgcagctacatcagggacccctgtgaatggtcactgagtagaatatgggcatgaatgaattgagaagatggacaggacaggaggaaaggcagggagggttggcaaggcagatagtcttggactctcgtgcctggtgtcctgaagacacctgatgtgcagttgtcctgcaactgcttcagatatggctgctcctgcctgctcctcttctgggctcccacctagtagagacatgaatggagcattatccttgtatggtggggaccctggcaagggcaggcccagaaattgagaggacgcagagaagtgcacctaatgaagtctggggaggaggtcagcgaggcgttcctggatgaggagaccactgagctaaacatttaaagatgagagttatctggtctgagatgggttgaggaggcataaaggtgagactcaaaatcaactatcttgagtaaggtttgttcctgccttctgtaggcattgctcggactttaagctgtagtagggctttaagctatagggatggatgggcagagatgatggctggaaaggagaggagcaaaggagctgtcagttgctccttccagggatggcagtagcttgaacaggagaacattttgagaactatttaggacgtaactttgcctggccttggtaaccaatttgatgagagtgtgagagagactggttggtgctagtccctgagagagaagccctagagttttggaagaggatggtggctgtctggagtaatcagcatggactgcacaaatgaggccgctttgcttttaattttctaatgcatccctcaagtatccacaggccttagtaacaggagatagttattaatcttgcctcctgaagtttgatagagtccacatagggggcagtctgtctgacttccatatctaagcaagacaagtaccaggattggagtagtcatcctctctgtcatgcagctgctgtgggtggcaggattttatagccaagctcaggggctgtgtgaaatgatgaggcttcactggttcacgtcctgcaaaggcccctaggcttcttcaaatgagatgcaaaatttggccaagcacgcctcacaccaccactggctcccaaagatacaggcactttgggatttgtacttttgattacaactttctgtcgtacccacaggtcccttgcgagatacaagccgtctgggaacaccaggtcaggtgggggatcagtgtctgccatccttgggatccagaaccttgtctccattcctgctctgtcaatccctaccttacagcaatgcttctcatagtgtggcctgtagaccacctgcatcagaatccattgtaaagttgcacaaaaatatagttgtgtaaactagatttcccgaatcacaaatccctggggttgaaatttagggttctgtttttaaaaaggtcctcttattatgtgtaagcacattaaagtttgagaactgctccaggtgctggacatcttttactttaaaaaaatcttagcttttttcactgaggtgagatttgcagaacataaaattaataatcttaaagcaaacaattccatagaatttaatgcattcacagtgttgtgcaaagaccacctctatctaattcaaaacacttttatcaccccaaaaggaaaacctatactcattctcattcttttccccagtccctgggctaccaccaatctgctttggggattaaactgttcaggataaatcatgtgtaaatggaatcatgtaataggtttcctttggcgtttgacttctttcaggtagcttaatatttttgagattcatttacattgtaacgtatatcagtacttctttcctttttacaataaaataatattccatcatatgggtacacaccacagtttgtttatccattcatttgttgatgaacatttgggttatttcctttggttcttgtaaatagtgctgctatgaacattcatgttcatgtatttatttgagtacttgttttgaattcttttgaatatatacctaggagtagaattgtagctcaattcaatagaattgtaggaactgtaaaactgcctattttcacagcagctgaaccaattttacacacccaacagcaatataaaaggttttcaatttctccacaggcttgccaatatttatttccctttaaaaaattttttagccattctaatgggcatggagtgttatctcattgtgattttgatttttgtttctctaatggctaataatgttgaatttttttatgtgctttttggccatttgtatatctttttgggggaaacgtctattcaagggcttggcccatattttaattgggttgtttctctttttgttgctaagttgtatgaattctttatatattgtgggtactagactctcaaaagaaatatgatttgcaaatattttctctcattctgtaggttctcctttcattttcttaataatgtcctttgatgcacaaaaattttcagttttgatgaagtccagtttatccattttttcttctgttacttgtgcttttggcattatatgtaaaaatccattgccaaatccaaggtcataaagatttaccactgtgttttctcctaaaaattttgttttggctcttattgtagataattaattcattttgagttaatttttgcatatggcaaggggtcagggttcaacttcattcttttgcttatagctattcaactgctctggtaccattagttgaagagtcccttcttaaattgtctttgtatccttgttgaaaatcaaggggccacagatacatgagtttatttgtggattctcaatcctatttcattgatctctatatttatccttatgtcagctccactgttttgattatgtagctttgtagtaggttttgaactctggaaatgtgagttgtccaactttatcttttaaaatattgctttggcttcttagggtttcctacaattccacatgaatttgagggtcagctgtcaccatttggcatgctgctagctgtgggcttttcataaatgccctttatcatgttgaggaagtttactatctatttctagtttttggagtgtttttatcatgaaagagtgtgagattttgtcaaatgctctttatgagtcaaatcagatgatcatctgttttttgcctttgtctattaatgtggtgtattttgttgattggttttgttatgttgaaccacccttgcatttctaatataaatcatacttggtcatgacatataatccttttaatatgctgttgaatttagtttgctagcattttgtttaggattttgcatgtatgttcataagggacattgatcccttggatattggtaggtttttttttttttttctgtattgtctttgtgtggcttcagtatcagagtaaaaatacaggcttccttgctgttcctggaatatgccagacatactcctacttcagggcttttgcaatggctcttctctttgcttgaaatgcttttcccatggatgtctgcatcccgtctttcagttttgcccttcttaaagaggccaaacctgccattcaaattaaagttgtaaattactctccttctgcatacaagcacttatcaatcaaaaatcaaatttttgtcaattctcctttcttggctctttttttctcaatagcacttatcatttcttattcattatgatattattatgttatatattaatatgttatattatacacaataattattaattttaatttacttatttattgtgtttatctttatgtctacacccttcccctcacacccaggtcatggattttagtttgtttagtttacagatgtatccagagtgcctgaatagtgcctggaaaataataaaaggtcaataagtatttgctcagttgatttgaataaattacgcccaagcacaagaaacactcctgagcaccttagctactctgaggactaaaaacaatctcactttgcatatgacagcagcaacatgggcagggtgttggaaaactgggtgttggtaatttgggattagcctgtagtttattattattatttcaattcacatgaagtaaaagtctctttttttggcctacagttctatgggttttaattcatgtgtagagtcacacgactaccaccacaatcaagaaacagaacagtctcatcacctcaaatagctcccagatattgccccacatagtaaaaccttttctccaccctatcctcgcaaccgtggatctttccttatagttttgtctttccagaataccatatacatggaagcatacatgtgtaatcttttgagcctggcttctttcgctcagcataaggcctttcagattcactcattttgtgtgtatcagtagttcatacatttctgttgctgagtagttttccattgtagggatgcaaatgtttcctcccagcctatagcttatctattcatctttaaatagggtcttccacagattgaaggttttaaattttgatgaagtccaaatcatcatttgtttttacttttatgtattgcacttttatgtcatatctaagatctctttgcctgacggccatgaagattttctcctatgttttcttctaaaagttttacaggtctgtaatctgttttgagctactttttgtaccatgtgtgaagtttagattgagattcattttttgtttgtttgtttttgcttatgaatgtccaattcttccaatgccattagttgaaaatattatctttttttccattgaattgtctttataactttgtaaaaactgcttagccatatttatatatgtctttggacactatttgatttcattgacttatgtgtctagcttttcaccaatattgtcttgattactgtggctttgtaagatatcaaatgcaagctctccaaagatattcttccttctcaaatttgctttggtgatttcagttcctttacctttggctgtcctgatggaacctcgttattttatatataggtaggtattgtttgctgattgttgaggatttttgcacctatgttcattagggatactgacatgcagtttttttatactgtgtttttctgttttcaatatcagggtaattctgactttgtaaaatgaattgggaagtgttcctttctgataccatataaatgttaatgatcagcttgcctatatctacaaaaattcctgctgggatttttattggaattgcattagatctatagatcaatttggagagaattgacaatttaactatagtaaatcttccaacccataaacatagtgtgcttttctgtttatttaggtctttgattctttcatcaaagtctgtcatattcagtgtagggcctgcacatgttttcttagatttataccagagtcttttgttgaacacacttccaaagggtatttaaaattttttggtttctaatttttcaattctagtatttaggaatatggttaacttttgtatgtcgactattattctgagactgctaaatttaattattagttctagaagtttttttttttatggattccttgggattttctatgaagacaatctcatcgtctgtgactagtgccagtttttggtcttcctttccaatccatatgttccagtattacatccaatagcaatggagagatccttgcttgttcttaatcttagggagaaagtcttcagtctttgccattgaatataacatcagctatgggaatttgtagatgcccattgttaggttataaacaattcctttgaatttactgagaatttctttttatcatgagcagatttttaatctttcaaatgctttttatgcattaaatgatattatcatgtgattttattaatatggatcatgttgactgatttttgaatattaaacttgccttgcatttacgggtagtccaattggccatagtaccctcgttattttatatgtagctaggtattatttgctgattgttgaggatttttgcacctatgttcattaggtatactgaaatgtagtttttttatactgtgtttttctgttttcaatatcagggtaattctggctttataaaatgaattgggaagtgttcccttctcttgtgtttttgaaagaagctgtgtagaactggtgttatttctcttttaaatgtatggtagaatttgctggtgaaaacactgagcctcaaggtttctttgtgggcaggtttttagctacatattcggtttttgtaatagctataaatgatttaggcaacttatttcttcttgttgagtttggtagtttgtggcttcgaagaaaaccgtttgaaggtagtttatgactttgaaggaacaattactgagaggagtgttgaactctctaactataattgtggatttggccatttgtcctttcagatctatgagtttttctttctgaattgtgatgctctgttgtaaagtgcaaacacgttttgaattgttatgtctcttttaatcatcatatcatataatctgtttattatgagtcattttccttgctctaaagtctgttttccctgatatgagtagaattacaccagctttcttttgattactgttaggatggtataaatttttctatcctgttacttttaacctatctatatcacaatatttaatgatggcatatagctttgtttttatttctttccattctgacaatagtgtctatcagtttttaatgtgtttgaattattgatgtgtttgaatttaggttcaggattttattgtttgttttctctttttttttactctttttttgttcctctacttctgtttgcctgcctttttgtggacaatttgaatatattttagtattcaatttgagtttatctactgaattttttgactctccttttttgtctctcctttttttttagtgctttcaatagggactgcagtatacttaattaacttttaacagtctacttagaattgacattttactatttcaaatggattatagaaagcttacctctacgccgttccctctatccttccctatttttgttgtggttgtcttatgtattacatctaatacaatgtcactttcaaccatcatacctaaatttaagaacttaagaagagaacaataatagtgtattatatttacccaaatatttaccatttctgttgctctttcttcatccctgaagtttcctttcattattttgttattattttcctaccatctgaagaaattttaaaagtattattcttagaacaagtctgatggcaagaatctgtcttccttcatctgggaacacatttattttgccttcattctggaagcatgtggatatggaattctgtgtgtatttttgtagcactttaaaaatgttgtttccatgacttctgctttcttatgagaaaatccaaggttattcaaattgtcgttcccttaaatgtaatgtgttgtttttctctggctgctttcaagatttttaaaattttctttagtgttcagcagtttgattgtgctgtgtctgggcataattttttttgtttattttatttgggttttgctaagcttcttgaatctttaaggttatgtatttcaccagctttgaagaaagaagtactaaaaacttctcaaacgttttttctttcataccatactctttctcgtctccttggaggattctaatgacagaaatgttagatcctttgttacacatgaccttgagtctgtctttatttttagtaatctttttcctttttgttgttcagattaggcaacttgtattgctccatcttcgtgttcatggactctcctctcatctcattctcctattgttctcatttagtgagtttaaacaaatttcagttgttgtgtttacttgattcttttttattgcttctatttatttactgaaactttctgtttttcatttatttgaaaaatgttcactcttacttcttggaattgggttaataactgctttaagggtttcgtctgatagttccaacatctgtgacatctcagcattggcatttgttggttgtctttttccacatgagatgttgagacttccctggttcattctatgttgagcaatttcaggttgtattctggacattttgaatcttatcttatgaactctggtctttgttgtcatcttatagagaatgttaatgaatatatatatatatatcttaaggtagggaactagcccacttaggttcaggttgcaagtttctgcccatcttccctggactctctggttccagtatcagttcagttttcaaagactgcagggagatttgatgtgcgctcacttgcttcatgcagtaactggttgtgtgtggtggtttacctcctagttagggtcagatgcacatacacagtcagaactcagcccagaggttaatatacaactttgtggttacattttcctcagcttcctcttcttcatcctttccttaacacttgctggctcccaaggggtcccttcctgctctgtctagaattggcgcttttgtttctctgttcttccctgtgtcactggtatctgtctctggggccatgcagtgaggggagaaaaggagaaaagagcaatgggaattttacctacactcttgggactacaggtcctctggtcagagagaaagtttctcttcactgagagttttagagtctgcctggctgctgctgctgttgctgatgctgagggaattgcctgaaagatgggttgggaaagaatggggaaaccaaacaaagaaaatcccaggggatttcctccatgctctgtgacctgtaaaacctcctttcctgctcctcagaccagaaacagaggacttctcttggagctctttccatcatgtctacaccttgtgcacagttgcgagttttaggctacctgtgagttcacaccaggggatgctgcagaggggaagcccagaaagctcactgccagttcatagtgcttgagtttggtttccttctcggctaccatttactttccagagtcctccaagagctgctccatgagttctaagtgttttagttgcattcggtattcagggggtgggacagagctgagtgtgcttacaccattttgaagggacccagaagcctgtgtgtgtgtgtgtgtgagtgagtgtgtgtgtgtgttcaatatgaaaccagagcttctcaatctccaacgtatctggagggaagggaagaaaaccagggaactaacttcactgagcatcaactatgggtcaggcactgtgccttggagcacaaaagcattcttctatgactgtagggggaaagtgtggtactgtcaatgccttttagagttggaggaaattaggctcgatggagtagttcaatgtcatctaggtaataagacaggatgtgtaccatgatctgtcttagaaagaaagatccaggaagctcagtgaaaatagaaagaaactggaaggtccgtgtctcatgtctggctctccctctctctgcaggatggatgagggagatgctgcaatcatgcatcccggggtcgtgtgcatcatggtgaggctgctgcctcggttgtaccatgaagatcacccacaggtacctggtgttgaatatgtgtgttttgtcatcttcacatgactgatctctcaaatgccttctgacccaagacagcttttttccttttgtccgtgtcttcagtgccctgcgttagcagagctccccatgggaaacacctatagtgggaaagtaccagggtgtcctggacacttgactgagttgtgcccacccttgcaaggccatccaaaacagatcacttctgttaacaaagctaccttctaagaacaacagccaaacaaaaaaacaactgaaaataattgaaccatagtaaggcaagtcccaggtgttaagctcagcacctggcgttggtgggaagtcctttgctccctggcatgttcatctctctcctggatgctggctgagatcctggccctgtgctctgtgcagctcatgcacagctagcaagatgagcatagacactgtccacagagcccgcctctatgatggggatgaggaggtagtgacagtgcagacagactaaataaatgagctcacaagtgaatatgaaattatgaattgtgacgagtgatattacagggaaaaatcagggtgctgaggtagaagaatgagaatggaggcaggaacagatctcattaaatctaatttagataaagggttggaggtcagggaagccgtctctagatggtgacatgtaagcagagacctgaagggtgagtagctagtgtgaactgggtgggaaggggcctgctgttggtggctaggggaggagcaaattggaagggccaggagcaagggctccctggtcaggcgatgatggggataatggggcatgcaggcttctgggagccttgccaatgtaaatgataacaagaagcctctctcacgtgagtggagggtgacatgatcagattttgcgtgaaaaacattacattggctgcttggtggagaatggacagggaatgagggttgagaggaagaggcaaggggcaagagttaggagtctctgcctgcggtccatgtgatgtgtggtgatagctggattagggtggtgtctgtgagaaggtgtgaagaaaggaattaagagacctgtccagaggcagaatcacaggctttcaggaagaggaggctacaggtaatggagagacaaagagccaaggcgactctcaagtgtctgtcccggcagaactaacagcctcattgtgggaaggaaaactggtatgggtgagggcatggagtaacagaacaagacgaagttggagtcagcagtctcaagataaagaacaaataccttagaagttccaagaaagagctgggcagagttgaggaaggcctgggaaatgcaccagtttaggtttatcagcagccaaggaaagaggattcattggcttgagcagctactctgtcccaggctgatgcttggccctttcttggcttatttattcctcttgcagttttgtcgagggcatcaatgccagtattttaaccaatggagaaatgtgagttcagacaatgcacatgactctcaaggatgcccagttgtgaacctggtattgaatgtggccttaccttggggcaggactcctggtcttccctatacatagaagtggcttccagaggatgaatagagggacctggcactcccaggaagcaatgaggagtccagctttgctttgtccaggagttcagacggaggcaacatgtttggggaagaaattgctactagttggcattattagtcacagcctaaaaatgacagtggcctcataaaaatattgcaagtcctctgagatcagtgagaaaagtggagtggcggagcagaagctctgggacagcaactgtttccaggaaaggaaatctgtagtgtttggcgcaggagttaagaaaaggcctgacccagtttcatgtctccatgtcccttctttggggaatggacttcttgttcctgctcctgttcccctgctggagagtgatgggaaagtgctgtgaagccaatggcagagatacacataacagtgagatttgggaaaggggtaggctggtataaactgggataggaagttaaaaacatccgtgtcatttctcatggttctgtgggtcagggattcagaagggcacaacaggcatggcctgtctgctccacatggtgctggtggggttgaacctcccaggatgacctctttagctgtggcacctcagcaaggctggctccctggcaaagggttcctaagctggcttagctgagtggcatacctggggccttggttgaagctgtcagtgggatcctggggtctcctctacatagccctctccatctggcctctgcctgtgtccctccaggcaggctctttagcagggcacacagtggctccgggcccccacaggcacaaaagcagaagctgccaggcctgccaaggacttaggcccaggaaaagccagctttggtcaaagttagtcaggggctcggcttagacttagtgggaggggacaaaagcctcctcttctgtgaggggtgacaggtgtgtgtaggtgagagatgcctatggggaaatatcttcaaagatcagcagctgtcattaccttactcatctaacaaatgggtaaaaacatttgacccctaaatcccatcttgtagcccgtgaattacttggagtctgggatcttacattctctggcttggtatttaagccaggacctacctgggacaacatggagactattacacattagacatcacctctgtgccaggaatgctatttctccaatcttcacagcaaccttttgaagtccatgagatgcttcccattctgcaggtatttggggctcaggaaagttgtttggctttctaagattgtggtgatggtgaggggaagatctgaaacacctctggcccaagcttaagatgtgttggatctttgcagctctcacagactgcagggtcatgcattctgggcatggcacacctttccaggtacaacagccttattgtgagggcatctggcttccttagctgtatttcatacaacgcattgtacttgcaattggaaagacacagccagtggtctgggtggtcttagcagtcaaacagttgctgatggatgtattctgcaaaaatccactgcggcctcttacaggcctggaaactccatggatgagcctcagttttagatgaattccctgagtcatcacatcaccatatggggaagaacctctgctctttgcttatcctatgacagtaattggacaaatgaagtatgcaactgataattccatttggagcgagttactttttctatattcaggtcacaataagtaatttaggaaaagtctaattctccctcgctgtctctcaaatatgcaaatgaaatgtagtgcattttctccagtattttctgcagatgccaaatcagcagctattaaagttggataattacagtaattaatttctgtaagggagtggggaaacctcacaacaacagatagaatagtgaatcaaatgagaaatgagaccacacaaggaaatgctgaaacaaaacggcaggcctccgcaggttttggtgtaggaaatggagcagagagtttcagtagatgtcagtgttactagcaagatggaaagtatgtttcctgtcatcttcctttaggtcagcttggtggttcctaatactccctacatctatacccgctttacactattcacttgctctctctcctctatggatgagaaactgatggctttccaaagtgcacatgtcatcttggaggccacaacttaaccttatgggtgttctcttctagtttatttccagtgatggccacgttacatttgttctgtggtcctttcgttccagaggttcttttcccctccaaaatgctagctctacgagctgcttttggaaacagatattccagctgtttttctgcttctggcatcatcatcaatattagaaattgggtagtgggatttttactatgcacagtgcaaaaatggagtccagctcagttcttttggagctgagttggccccagaaaaaagtaactaattgggaataaagatactttccctttctagcaggcttagcagccatgagtgtctgtcataagagatgtggccgtgggctagagctctgaccagtattggaaggactttccagtcccaaatgccattccacttccttgagggctacggcttctaatcaggtcttaactgagggtgtttgctgtgcaccaggcactcacaatgcagagagtggaaagccaggtctagtttagcagaggttggagccagactgtgtagctgcccatgtgatatgtttgcttttgtgaataattacagaccacctactatgtgcctttggggattcagagacaaacgtcacaggacctgtaatctgggtttgaggatgggaggcagggaagtgtagaagatagtaaaacaacatcctgatggctataaccgaggtttgcccacaaggccttgggacacaggagagggaaagactcagagaggtggaacaccagagctaggctttaaaggaaagggatgtttatgccagatcaggtagaagaggaaggaaagagaagctcagacacagaaagaagcataaagatgcctatttggggactctgaatagttaagctgggctagaatagaacacatggatgaaaaggctaaaatagaacacatgaatagaacatatggatgagtggggctagaaaggtctcttgaagccacattgtggaggacctcgaatgttgagctaagagaatttaactttattgggttgccattcattgacatcactgtcaatgtcatcattgtcattatcactgtgtttactgaacatttaccatagagggcagacttcaggctctgaaaacagcagattgtggtcaagtctcagctgggtcaccaagcagtcacagagccatgggaaaattatttaaactctttgattcttaacttcctttgtgtagtgtggggataatgtcatcttctttgaaatgttattgtgaggattacatggagcaatgcatggagcttagcatggtgagcagaacatgcacagggacacaggacacacttgctaaatggtgcagctactatcatcagttgctaaaagctttacaagcattttatcatttaatcattataacaaccgtgcatggtggatatcagtagacccattttgcagataaagaattgaaactcacaggaattaagcgacagaatcaatattgctgcactagtgagtgtacgtgcctgacctgaggactggacctcctgccccccaccaagttacctttctcatagggaagtgagaggttacagaaaggcaatggcacagtcaggccaggacattagagagactattgtcatcctcagtctgcatctcacgttatttttgggtgaattccagagatctaaaggctgcagtgaagacactgctgccatggaagcctccagaacagcctggcaagacacagagaagattgggttcagggctgcatgtatctatcaactcatttatgcctaaatttagaaagggtgccattttctggaattagtctgtatttcaaacactgaactaattgtatgagtttcaagtaactaaaatattgacagcactaatagccctggatagcattgcataagggcaggctatttgaaaagagccatttccaccaacaaggaaattggtaaagtaggactcttgctttgttaaattataacacattggacatcccaaatacattcaaaatctgtttcctatgctctttcccactgagccccttacacaaagtatttctgttattcctcagtggaaaatctcaggttctggtcaaaatccaggtgacttctcatggtagtctcttaaaaagagcaaatagggccagttatggtgactcatgcctgtaatttcagcactttgggagtccaaggcaggaggattgttagaagccagaagtttgaaaccagcttagacaacagcaaactccatctgtacaaaaaattttaaaaaatcagccaggcatggtggtgtgcacctgtagtcccagctacttggaagagtgaaacaggaggattgcttgagcccaggaggttgatgctgcagtgagtgagccatgattgtgccattgaactccagcctgggtgacagagtgagaccttgtctcaaaaaaaacctaaaaactaaaaactaaaaaagcaaacagacataatctcacatggagaagaagggataaaaagcaagcttccatggatgtggaatggtggtgtaagttaaagtcagatggattcagccctggcctaattatcagctgaccttggtaatgttccttttccatgacatacgtaggctaccttgtttctctgtatctcaatttcaactactcagatttggcctggatcacagagatcacagactcaacatctcgggtccagagaggtaatgaacatgcataagtgaagccaggtgaatacagtagtcagtggtggagcttgtggccaaaggagagcacttgctcttctaaaggtgtgtacatttaattaaggagacatgaaacagaagcagaagcccacccaaatgaagcccaccaaatgaaacacttctctaggccatcaatttatgacccatatgagatactaaattccagctttttataatcagtgcatgatgcagtatcaaaatcatgagccttggagtaaggcttgtgttggcatggcagagcggccacccattagctatgtggcctgatgagattgatggaacccttttaagtctcagtgttctcatctgcaaaatgggtgtgatgatattttcccattgagaaaagtagaagagagcatagttgtaaagtccttagtacagttcctgccctgtgtatgggtacatcagaggctggctccccacgcctgctcccttcccttctagctctgacagtctgtgttctgggtcgtggtatataaaattctgaaactattaagtagaaggtaatacattttaggtatatttccaactgacattacactattgataaattaataacaggaagttgatattgaactgtatgttaatatatctgcttatgagtcagaagactcagtactttctctggctggttctgcactttatcagtgatctaagagaagctgagtgtagctggcttaaggtagggaggggcagttagtcatcagatgttaaaatggggaggagaagggtccctgtcagcttgagcgagggatcagaatccatgggatcaaaattcagcagagacaatgaggcctgtgccatgtctgaatgcatgtctatgctaggtggggaaggacagaagagtgttaagtcctagcaggtttagggcaaggtcagtaatagtcccaagtgaagtgaggacatcatataatgaatttcaccttttgggggtgggtgagcttagcgtccagctgggtgggcaggctctgagctggggcacagacatgtccacttccaggacccccagaaagtcaggaccaagctgggaggtcccgggcaggcaggctctctacagatggggaccttctagagcaacaagccctactttcatgctggggaccacactggggactgttgtaccagggcctggaatgggtgttaggatactgatttggattagcctgggcctgggaccagagcttagaatggggacaacaaattggagggtagtcctgtcatctggagcatctggtggaggctgcttcagagacttgggggcttctcagatcagctgtaccagaagtgggtgaatctccaagcagttctcaagagcaaggtcagtgctcggtctccaggcttcccagccctccaggactggcaatctgaggagttcagggctctatgcacagtgtttgccttgcccatgcgctggcatggggcagggtatggccagcagcacagcgagcccctttgcagggcacccgagggcccgaatgttgcaactctgcctcatgaccccccaaccttttgaaaggctctgcttactctcacctgccccgccttcacatgtgctgtttcctttccccgaaagcccattttcctcacctgcctagctctctcttcattatccttcaacgcttcattggcacatcactctttctgactatctgtcagccctctgggttaggcgcgcctattgtgttttagagtagcctgtgcttactaggcggctattctgtctaatgtctaaggcagagatgggcactagggaaaccaaggtgaagagtcacgggtcgagcagccacccacggtgttgtgggggtgggagaggagaagagagagagagagagagagagagagagagagaaccagccatagtgtgaaatttaacatgattgaagtatggacagtgctggttgggaaagtcagaaaaagtttcttggatgaagggacacgtgacttgcctcttgagtaataagcaggagctcagcaaagggatgggattggaaaggacattcccagcttcaggcattactggaaaagggcatggtgtttagcagaagctgagactgtcactacggctgcagtacagaggggacaaaagtggaggataggaagaaaaatgggaaagagagaaatatgctgtagatgtgagatcctggacttctgtttacaggacgaattgcccaccatctgcatgtaatttggaaaggaaacagaaagtttggagcaggcacccacccatccccatggttacagatctgcctagttacgttgaggaagccaggccctttacatgtggattctgctggttccatgggggttggaatctcttacacctaaaccacgatcataaactcccaagcctaccaggccataagggcactgtgaagcagcatatcaggctgagggaccatggcaaaatggaaagttcatgctcatataaagagagacataattctaagtaggcagtggtaaaagccataacttgtcaagtaaagctcatccgtaggccccatttattgctggcatttcacttacagtcttttgataaagagcttaagtcacttaaagtctatcatctctcttcaaaatcatgaagaaaaggacattttgaccaaattggaacaaatcattaatccaagtttgagtagctcagtaaagcccctagtgctttcagagtgtctggggcagcaggcactgggcctctctggtggttttcatttctgtgtgagaatgacttggttcatatgcagaagacgcacatatcttggaatgctgaacccaacacccatgcctctttaggggacctattgctccaggacccagcgctcgctgggctttggggaccatattaatctggaccaagagagaaagtggggaacagagagagagcgatacataagaatgaacatccacagacagacagcgtggacttaaaggctaggtcgttaagtgaagaatgcagaaaattccttaaggctgccccgcaaatcactctgtgctaatttgccttgcgggcccagcccgctggccaacctggtgaccctgtgctcttaccactgagtcctaattgcacctccatcccgtctcctgcgttggaagtaatatgcgttaggaaaatcaatccatttgtaggaggagaaaccacactggtttcctgctactgctatcttcactaaaaccccattttactggaactaacgttgaaaaaaacagcgcattttattcaaaacaaggcaatattggtattgacagagctgcagtgataatgaggacgatcaattttctctcctccattacggggtattgagcaattttggagtaaacttgtggcatcattagacaagatcagcatttctcccttttgaaaactttcagtttttcttttttgcatatttagattttaagtattcctgctatgttggggggaaagaagcaaaaccaaaacaaaccagaacaaacccagaagtccccaaagcaataagtgaagtgctggtaataaaaactggaaatcatagacatttctttttaattcttttgaataatacattgtgatgttatttttgccttttggttcatacagactgcatcccaactctcaccctaaattgaaataatgcagttaccacataaaataatccaagttttgggagatgagatattcaaggcaagagggtggatgttacttttttgttttgagaagagaagcaggggctgggcttaggtggatgaaggaagagagagttggagcctcagaaaaaaggccttgggaagggagtcaaggacttcgggtggatttccatggggaagagtgaaagtgatggaatagttcagagcaaattaactttggcacttctgctttcagtttctgatccttgttgggctacacatgtccatctgccagttcaggctggctgtgcagatgccacattctggggaaggggaccctgtcttccaggcaagacctctcctccatatcagtgacatcatgtgctcaggaaaacagcaatgctggcaaatggtcacatttcagaatggcaaaatgcagcctgggaaggatgtccccctggaaagttaatctaatgtagttttatcccccttcccccagtgctcaccttttaaaccagaaaagttattgaagatgtcttagagatggggatttctctgaatgccatcagtgtgaggcaagagctacagggcccatgtgtttggaaggcaggcgggaggctgtgacaggggcctgggtgagccatccaatttttaaaacaatctagaaattgttgatgaacagtgtaaatatctttcttcatacattttaatccttgaaacatatgtgctacaaaactgtgttagctacatatggaagaacactatcttatttctgtcacttagtgctagcaacatactcgaccatttttaggagggaacccctcaaatgactgcccgcgtggagaggagatggtggaatgaggtgactctgagcaagagtcatgtgctcttggcaatttccatctctgggcttagcttccccatctgtaaaacgggtatgataattgtgcctccctcacaggcttctcacagtgattgcataatccatacatgtcaaaatgcttagaaaagggcctgctgcagcctaaatacccaggaaatattctcatcccaggataaaatttggccctcacagtagatgccaggccttgagtcccttctaacttcaagagccttgtgaaatgtgtgagaggctgcagggaccaccccatctgctgtgctcgatgttgtaaattctctgctggagcacgtttcaaactgtgctgggacaatgtgtctgcccacgtgtatcacctttaatctgtgaatcccttgaaagcagggacagtgtcttattcatctttaaacgcctagagctttacccagaagttgatgttgagagccacttcattcttgtttgagaaagaataggaagagaggaagcagggaggactccaagaaagctcttactgggtggtgtaacaggtggtctgtgatgtgaagagaccagaccctagtcctccttagaaagagattattcaggtagtgcattcacagcttctcctggcttcactttggtggtctagaactcatttacatggccattgatctcctttcttgaaactacaaactgcggcaaaggtataaaacatggaaagaatgctggtgcctcaggtcgggttccctgggagtggagcctgagacaggggtccaggtatgtgggatttgttgagggaaggactcgggagggaaggagagtgagggaagccgggcagggaaagagctgaaggaggatgcgctcacagcaaagtcttgtctcagccggagcccctgggattctgaggcatgaattgcacaacacagtcccgagggcactggcctcattggctccagcctggagtatgtgtgtgtgtgcacacaggcatgtatggtgtgtgtggatgtgtgtgtggacacatgtgcgtgtacctgtgtgtatggacgcgtgtgcgtgtgtatgtaagtagggggcatgtaagtgtgtgtgtatgtgtatttgggtgggtagggctccatggcccctgggcagggcagctcttacctagtggagggcagttcttttttttttttttttttgcattttctttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccttacccccaccccaccacagtccccagagtgtgctattccccttcctgtgtccatgtgatctcattgttcaattcccacctatgagtgagaatatgcggtgtttggttttttgttcttgcgatagtttactgagaatggtgatttccaatttcatccatgtccctacaaaggacatgaactcatcattttttatggctgcatagtattccatggtgtatatgtgccacattttcttaatccagtctatcattgttggacttttgggttggttccaagtctttgctattgtgaataatgccgcaataaacatacgtgtgcatgtgtctttatagcagcatgagaaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggagggcagttctgcagagaaggggaagccgtggcaggtatacctctcatctggagaaggagatctgcatggagcacagtagcatccactgggacaaggaaaattccattaagatctaacctgtatccctctcacttgatacgacatcttatccagcaacaaaagagaatgtggacagtcctaagagtttttgtaaaggaacatcccacccaatccaaaccctttatccagcctgggaaggataattccaaagatttatcttttacaatgaaagaatgattgtaaaagcaatgtgtggtattaggctcaaatatttactgagcccagtctatgcactcttttctatgtgcttcaaaggacataagcagagggaagtagctggaaacctagttcagggttaagataagagcacagctattcatgtggcagcatgtgcttaggactgagggacaggcacaggatgatgggagggtgggcggagggagatggcacccaggggatgagagtggcttcagcaaacgcttctccccagagactttagttggcctgcagactttgagtgtggtttgagatgtctgtggtggggcctgtatctgtcaaggcagagtgtgtatgtttggtaagtggtacttcttttagtcttgtactcccaggcagattccaccttttactccgggggtgcgaactccaacacaggaactgttaggggagtaaagccaagctgggggggatgttggacccctggagggcacagctcccacccagcaccagccaccttccccccacagaggtgcaagccagcatggccagatcgtcccatcttttgagagaggccacaagtctggatttttatgtgacatcttcagacttttcaatgctagcagttaattcagaaactgctgaaatattgtgtgggtcaaacacagcacgtctaagaggcagacgcagcctcctgcctgctggcatgtggcctccatctttagccattgacctctccccacactgacctgggcagcttgtgtcctgccagaggctgcctcccacagacttgccccccgccaggtgaggagggcactggaagaaccctgagacaggcgtgggtgtagtggggatggggtatggtgggcgcagtctccttgttccacaactcaccccaggccaagttggagcctataaaagctgtccacaaggtgttctgccctggagggctcacagcttgctttggtcactcttagctttccgaggagatccagtgctccctggccagtcatatccagtccctggtgaagtcggagaagaaccgccaggtcatgtgcgaagcaggcttgcttgggaccctcatggcctcctgccacagggccctggtcaccagtggcagccccctccactcacgcctcatcaggatctttgagaagctcgcttcccaggccattgaaccggatgtgctaaggtaccacatgctgcatattcagtgccgccaagctgggcagccatgtcctttgcagggcaggggttgcacaatgggcagtggagagactgcagggacagatggagggcacggctctgtcctggcattcaaggctggagtccatggctgagccttgggtctgtgccaggcagtgtgcaggtgcccacaaagcagacatagccccctctaatggatcacgtgggggctggagggggctccaaggaagtggagctgcattccgaggcctgtagagttcactagacaaagagaggagggaactgggcctggaaggctctgccgggaggggtggggctgggaggggctgactgtgtcctgtagggagttgggcagtaagcatgtagggactgcagacatggaggaggatggggcagaacccacctggatcctccagggggctttcctgctgtcagcctctacatgaagccacattcctggagagccatggcagggagagaaagtgcaaaggtgcacagggtgggaagcagggagcagacgtggaagacaagagagcagagggaagggaagctactggggagggcaggagtctcctatgccacctggagtgctgagggccatgcacagagcggggggccctgctgcttatacacaggagcaagtgtagagggcgcacagacagcctttccagccagcagacatgggacccaggggcgggcacgacagctgccagaggaggctgctggttatagtgctgcatgggaaattccattagaaacttataaacaattactacaaatttactttgtgacattattttttgttatgacatccatcttgaggctcctaaacttaccagctctctggtctggtctggctggcagggcagagacaccctgtctccacattgctttcagaaagggtgttccagtggggctgggaggtcagggagctccaggcatctaggacagttgtcaggataaagttggagaacactgttgctagtaaaatgtcttcattttttcctcttgtatgttatgttcagacagtttctaggtcttggaattccctcatctctgtcggccacaacaaaaatccttgattcatctcacacacacagaggcaaccctgggtgctcaggtgaggacagtggcaagaacggggcaggttaatgggaagtaaaagatgataggcattcctgctgagggatcctttacaacaggtgggaaagcaaacaggtttaaacatggttttgtctgctgctcaatgcagcaactgaggaaaaagcaaagaaattcctggtctctggagaaagaccatatccagatggagaaagatgaacccccacccagacatataagacagatgatccctttgggttccagatcatggaagcagagacagagtttccttcatgacacagcagtacgtggcgctgcactagacagaggtgtgcagggaaggcttctgtacagctcacagctcaagggcatgtcagagccttggaggcccaagatgcaggtggtacccctgtgtcaggcctagtacctggggaatgttggccagggaaccagcttagagaaaagaaactcgtggacatcttgaatgtaagatcacataagacctcaaggaaacaggcaggcccagtggagaagcaagggtgcgggatcaggcttggggctgacagctgcggtgggagcccagagcttacaaggagaggctgctgtgaaggaaagtgtgggctttgtgagcagacacaaagctccagtgagtaactccaatggggcaagccagagacagaggtggcagcagtagaatgtgctatgctggaaaagggatctgtgctggaatgaaagaaaagtttctagaaggagcaggttagcaacaccattccttgttatcagactcagcagggggcccgggctgggggccagggagccaccctcgctggtgcttaggaagtacctggtgactgtgcgaaactctctttctgggctgcggcagatactttggggttattgtcagaagcgagacagaaatgctttgagcagagacacatctcttctcttgcttgctgccctagggtcacagactgcacagggcttggctgaggggccctggccagctgccccagatgctgggctgcaccctggagtcacacaggccccgcagcccttgggggaatcccaggattcaactactgctcttcagacggcgctgagcctcatctccatgacctccccacgcaacctgcagcctcagagggcagccctggccccatcgtttgtggaatttgacatgtccgtggaaggttatgggtatgacaggctttcacatatttaaaatgcactttattaattttgcagtgcctctgatgaattataatattgattgcaaacttgtagttcccattgaatctcaccactcagcagaggaaaatgtctgggtcatggacacccgcctactcagcggcctcccaggggctgtgtccccagctatggagggccaagaccctcttttccctggtgtggctgcattctggaacaccctcccatcctgcctgcagtgcaattccttcccttaggcatcctaccagcaccagctgcagtccatccttgggaccttatggtctaaggagggttacagtgccggcaggagggtagagtgggaagatgtcatggcccagactagctgtgtcagtgcaagagattggcttgcagtccaatgatctgagacaattttctatttccagctgtttgtttattccaaccctgtccacagttatgggaaccagcactgagtactctgtctctggaggaattgggacaggtaggtgtttttcccagatggtttagctctccatcccttccaaagtatgagtcttcagatagccttgattgcagatttttacttggtgtttcaataaagtgtgagctgtgctgggcatggtggctcacacctgtaatactgcaatttgggaggccaagacaggaggattgtttgaggccaggagttccaggctgcagtgaactatgattgaaccactgcactccaacctgggctacagtgtaagacccagtttcaaaaaaagaaaagcaaacatgagtcttgccttggtcctgagtatctgcagatgagttgttcttcaactttgctcctcttttagagcaagatgttctgttcattgtgcatcccaagggtccagcctatagctagggactcaattgacattgaaaaattggctcatttcgctggtgactgatgtaggctgagatggacacattacctgccttagatctctctctagagagaaatatgagttgggctgatggccgttgagaatagaccaatctttggcaagtggcttctatgcacagcactgcacttagctgaaaacacgctgggtgggacagtgcaagtgcctgatgctgcctgagccacacgctctgttaggagaattgggtttggggtttctatgggatcatgggtgctggggagccattgccttcatgacgtttttccatgtgagttggcaccaagtctgaggacacagcagctgatcctgcctgttctgtgaggacaatggacctgtctatatcgccaaccctgttatgtgatgggagggcacatggcattcctagattggtgccctttcctatccaaggttcagctgagctaggccaaggtcctctgccccacagagcacactgcctggctatagatcagctgaccaggagcccacgtgtgacggacctcagggagatcgagatcttctctgctcccttggcaaggcagcatgccataatggggaggagacaactggtgattaggcaagacacccagtaggtgctgcacctgggctaaatcagcaccatagtgaatctgaacatgcatgctcagcagggcagaacaaagcctgagggcatgcctgtgttcccacccaggtgccaccagaccgttccctcctcctggaggtctgaccttctcctgctggttcctgatcagccggcatggagctgccactgagggccacccgctgcgcttcctgacgttggtgcgccacctggccaggactgagcaaccctttgtttgcttctccgtcagcctctgcccagacgacctctccttggttgtttctacagaagagaaggagtttcagcctctgggtaaggtgctgggatccaaagccagtttcatccacatgtgggggaaatggggctaagtcagaagctctcaacacaggtgtggttagaaacctggtgaccttctgtttctcctcatcctttgaaattgctcccttgggttccatacctggtgaaaggtctacaatatttgttgtggttcactgtggcctgggctctaggcttgtaagtgtcaggcagatgaggccccagcccttggcacagcttcagagatgatgctcagtggcttttcagaaacttcgccctggcagaacagtcacaatgggacccagggctttgccttgctgggacacaggctgcatcctctcctgagtgaggtttgtgaagaacacacacaatttagctggagccgaagcagctacagacatataggcgctcccacatatgctcaaccccaaacccagaaggctggcccatgcttggcatggcgcccagggccacccctcctttggcagtgctagaggccagccctggctctgccctttggagcccagcgttgttctccaggctcatttgcctgagatggtcaagtccagtggattctgtccacttgttcttctcctgtgtcctgagagtgtcactgtttcatagggaaaaacattgggaggccctatgaaacagtggaagcggctgacacccttgtacacagcacaactgcctatccaactctctgggactcggcctacaatggagtctctgtggaggtagtctaccttgggatagacctgaagcctggcttctgggtttgaatcctggctgtatgaccttgggcaagtcacccaacctctctgtgcctcaggatggtaaattgggcatgtatgagcgcctacctcacagggctgtgaacatgacatgagttgatatttgtaacatgcttaaaactggcacaaaggaagagctcaaagaatgactgctgctattgctgctgctgttgtcatttttcatgagaggaggatctagggctccatggtacaaggcccagtggttgacgtccgcctatgccctccccattctcctgggttcctgcagtgtagcaccacacgtgagactcagtgttcatgctgtcttccagatgtcatggaacctgaggatgactccgagccttctgcaggatgccagcttcaggtcaggtgtggccagctcctggcttgtggtcagtggcatcacttggctgtggttgtcactaaggaaatgaaaaggcattgtacagtttccacctgtctggatggacaggtcattggctctgccaaggtgagatggctcctccaagctgcacttgccccacaaccatacctcctgctactaccctgaagtggcctcggtttcattctatgtttttgttgttgtttgtttgtttgtttattactggtagggttggcatctaatgaaatctgccttactgttcaggaaacttggctgagttcagacatgaaaaggacatctttagaaaatgcattgaaggtcacgctaccagggcagaaggcaagacatgcatccaggtctctaagaatagtcatgttcatgaaaatagaaaactccagaatgaacaaagcaaagcttctcattttgaggggcaaactcctcagggaggtctgggcagggcctaaggtatgacttttccaagaagctcccaggtgaggccaacgcagctcatctttgcaccacacggaggagcaggacactagagtgggcagacaccaacacgtgtcgtcagatttagagcaagaaccatgaggaaggtaatagaatgcaaatgtatagctggaggaagcatctcatggctgtcatttagagacaccccaggtataagagaaagctgggaaaaggtggagctggcaggcgccagcagccattgtcagagaagagagggcccggaggaccatagaaggcaggtagggctggattttcacacaagttccagggagagcatcccaagctggctgcattttaaaatcacctgcaaaggctttttaaagttctcttgcacaggctgcacccagaataattacatcagaatctctctgggtcaggtaatttgacaacttactaatgtttgtaaaattttctaggtgattctaatatgcagccagaatggagaaccttacatacacagggtttctggattccccctaaatgccatagtgttcctcccctgaccttgcccagttgtgaccaccagtaacatctccagacatttccaaatataccctgggggtcaaagttgttccaggttaagagtcatcagatgagaacaaattcttagtcccaaattctgtgggacacatataggtgaatttgataccatctgctggtaaagttctgttatcaaaaaaaggcagtgatgaccaaatatatatatatgtgtgtgtgtgtgtgtatatatatatgtgtgtgtgtgtatatatatatatgtgtgtgtgtgtgtatatatatatatgtttttttgagataggatttcgctcttgtcgcccaggctggagtgcaatggtgcgatctcagctctccgcaaccactgcctccaggattcaagcgattctcctttctcaacctcctgactaggtgggattacaagcgcccaccaccatgcccactaatttttgtatttttagtagagacggggtttcaccaggctggccaggctggtctgaaactcctgacctcaggcgatccacctgccttgccctcccaaagtgctgggataacaggtgtgagccactgcgcctggctgaccagaaagattttgacaggggcattgaaagaacaggtccttcaaaacatagttaaccttttctgcaattattaacaatatcagtcctccctccttccctttctctctttcttcttttcctcattaaatatttattgagcacctgttatgtgttagctaatattttaggtgctaagaattgtttatgcctataagctaaagacctccaggaacatacatatagtataaggtgctaagaattgttttaggttctaagaattatttatgcttataagccaaagacctccaggaacatacatatagtataaaataaaaattagatttaaactgactatagcaagagatttcctatcccatggggtagtaaggagttaggagtggcttgttacagaaactagattcattttaggtgatttttaaaagggtttaaagaagtggaggtctgtctgttctgaattgggtgctgctggaaagaggtgcaatttggtgactgtgaatgttaataacttttatccagaaggtagagacacggaacagggctggacttatcattagagaggaagcagaagtccctcacattagttgggatgggatgtgtggtgtcttttgtggttgcaatatctttgtttttatctgtttaggctcaattactgagttcacttgttcttgtcttctttcacagaatatgttgatattttgtgaaatacttcaaataccttgaggcatgtcttattgatgtttgtaccttccttgaacttggcgcaggggctgacacacagtaagcatggaataaacacttgatgaactgaattgaatgtgcagccacaggaggaacatgactggctgctagtgtggttgggtgaagtggtacaggcattaacatcctccctgcgggacctgctaagcctagggccatcaacagggaggtcaggagtggtgtgttgctatatggagtggccaaagccaagactgacagagtgcgctttccaaaataatctcaacaagttgggtcaggaccagcaagtgaaactcaaccaagataaacataaaggcctgtgttttgatgcaaacatctgttggacaagagtaagatgtgagaacttcagcttaatttgactagtttaacagcccttctcaaaatgctgagcctttgtttttattgccaaaggaaacttacataaatttgtaaagatatggagcattttaatagtttgaattgggcaaaatgatttgggaacgatatgagacattagacatttattaggcaacctgaatggggcagtgtgcatacactgggaatttggaagacaggagcaaggtgggttggaggggtgagtggtgcttcagtgtgggagagagaggaggactctgtgcctgcgagaacagagagataagagagcacagaaaatcatactcctggcaagccttgatggctgaacaattggtttgtttttatttgaaaatctcacttaattggtagagtgaaaaagaatatttctgaaattctgtaaactctcatttagaaaaatacagtcatccctcagtttcctcaggggattggctccaggacccttcctggataccaaactgcatggatactcaagtcccttaaataaaatggtgtagtatttgcaaataatagatgcataccctcctgcatgcttaactaagctctagatgatttataatacctaatacaatgtgaatgctacataaatagttgtcatactgtatttttttatttgtattttttattgttatagcactattttttattgttctttttcctgaatatttttgagccaaagttgattgaatccaaggatatggaacccccagatatgcagggccaattgtacatatttatatatgtacaattgtatatatcttatgtatatatcttatgtataaaatcaaagatgtatatatcaaatgtatatatcttatatatagtgattttatagtaattataagaataatataaatgcattttgaaatagctcaaaaatagagaaaagattagctaccctcctactactttatcatattttgtaatttcagttttatccctttaaaaaatagtgtggcctcgaagtatagaaaatcttgtatactgcttagttcatttaacctctcatttaacctaacacttaggctatatggtatagcttattgctcctaggctataaacctagacagcatgttgctatactgaatactgtaggcaactgtaacacagtggtgaatatttgtgtatctaaacactctaaacatggaaaaagtacagtaaaaatatgatattattatctgatggaccaccattgcatatgtgctctgacactgacttggaacattgtaatgtggcacacagcaatatatggaagtatacttggaaattcatccaaacttttgcctgtagccacagttcattcttttttatttctgagtagtatttcaaggtatggatgtgccatagtttgtttagtcatttatccattgaaagacatctgggatgtttcaggttttggctattacaaataaagctttgtgagcatttgtgtacaggtttttgtgtgaatttaagtcttcatctatctgggatgaattccaagagttcaattgctggtttctatggtaattgaatgtttagttttataagaaactgccaaactatttcgaaaatgattgtatcatttgacatttccgctaacaatggatgagtgaggcagtttttctgcacttagcattgtcactatttttatattagccattttgatagttgtgtagtaatatctcactgtgtttttaatttgtatttccttagtggctaatgaggttgaacatcaccttttcatgtgcttatttgccatctgtatattctcctcagtgatgtccatccatattttttgcccattttctaattgcattgtttgcttttttttttttttttttttttttttttttgagatggagtctcactctgttggcaggctggagtgaagtggtgcaatctcggctcactgaaacctctgcctcctgggttcaagtgattcttctgcttcagaatccagagttgctgggactacaggtgcccaccaccatgcctagctaatttttgtatttttagtagagatgggttttcactatgttggccaggatggtctcaatctcctgacctcgtgatctgcccacctcagcctcccaaagtgctgggattacaggcatgagccaccacacccagttgcatcgtttactttttttttttttttttttttgagacggagtagtctcgctctgtcaccccaggctggagtgcagtggtgcgatctcggctcactataagctccgcctcctgggttcgcgccattctcctgcctcagcctccccagtagctgggactacaggcacccaccaccatgcctggctaatgtttgttgtgttttttagtagagacagggtttcaccatgttagccaggatggtctcgatctcctgacctcgtgatccgcctgcctcggcctcccaaagtgctgggattacagacgtgagccattgcgcctggccttaaactgttgagttttaagggttttagggttttaaaatgtatacatatatgtgtatgtgtgtctatatatatacatatatattctagacactagtcctttgttagatatgtgatttgcgataattcctcctagtctgtagcatgtcttttaatcctctttcacatgggtaaaatttctggttttgctgaaatataattcattagtttttccttatatgactcatgcttttggtgtcgtttgagaatattttgcctagtcctagatcctgaagatattctcctatttttttccctaaaaattttctagttttacgttttacactagagtttgcaatcaattatgaattaatttttgtataaggtgtaaggtttaagttcatttctttgcctgtggatgttcaattgctccagcaccatttgttgaagagtctatcatttctcaattgaattgcttttgcatctttgtcaaaaatcaggtgagcattcttatataagcttatttctgggttctctattctgttccatcgatctatgtggttatctttataccaatgtcacactatattgattttatagctatataataagtcattattagagtagttcctcccccaaattaattcttctttttcagagttgtttaaactattctaggacctgtgccttcccatatacattttagaattagcttgtttgtgtctacaaaagaccttgctggaattctgatagtctacaaaaaacctttctggaattgcattatacttactgatcaactcgaggggaaataatatctttactatagtgaacctttctatccatgaacctggtatgtctctccatttatataggtcgtcttggactttttccatcatcacttaggaattttcagtatacagatcctctacttgtcttactaagtatttcattttcttgtgcataattgtaagtggtattgtgtttaattttagtttctgtttgtttattgttagcctacacaaataaaattgatttttgtgtattgatcatgtatcctgtgaccttgctgaattcacttattctaggatattaaaaaaaattccttggaactttctacatggacatgatagaaacagttttatttcttcctttccactctgtatgtatgtaattattgttcatacataaaactattaatttgccaatactagacattcaggttcttagtagaatgactgagataagaaaggtgtacacttttttgtttcttaatattttttatcaaatttattttcaaaaggacagtatcagttttttactccacatttaataacttgttttgcgcatacttctgagatttgagaattatattttagttttttagataaaatacatttttactatgagatgagaataagatgcatcatgttatatcactttgtatttacttgattaactctgagatcaaacactactcactcttgtcctttttattttaacagatgttatacatccaggctctaccagggcctttcctttctatggatccatccgcatttgtggatgtttatggatatattgctactcctcgagtctggaaacaaaagtcttcattaatctggcgtcttggccccacatacctctttgaagaagccatttcaatggaaactctggaagttattaacaaacttggcccaagatattgtggtaacttccaagctgtgcatgtccaaggtatggagtgttttgatttacaatgttcttgctgatattagtttttaaatggacatccagttatttgtagcagatttgcagagaataagctcagcgttaaagtcagtcattagggaagacctctgtaattgtatcattatatatttacaacccaagagaaaatgtcacagaaaaggaaatgacaatatctttagatttcaactccaaagccctaatggggaagaggtgggttgggcaataccatcagcaaagaaagagagaagagaatgagataaataagttacattgcttttaatgaagaagctttttaactaaagtatactgttgacttcaattattaaacaggcagacaaaacatccacattttcattattgattgttgttattcaagcagggagcattgttctctgtgctctgtcaagtcaaaggggtcagctcccatctggaaagaatgataaatgaatctatgtcagcagcctgtatgtgctgaagggcgattgagtgctcttgagcatttctgtctccaggcccatgatgtctttgaatttcatttcctgtggcaaatggcactggccagagcaatgggacgaggtcaggtctagagccaaagtcttaccaattctatattcatggcacctttctctactagcacattgggtatcattgacttagagaccagtatgttaattcaaactggggtgtttgccgtggctgtgcagctcattgaaaattagacatttcagatcagcctatttcaagtcaggtttcttgtcacttaagagtttggttttagggaatgaggttatatactttacagatgttttaagctctggtagtttcgcacctggagtgcatctatttcatggtaagacaaatcttgggagagttcgccacagttttctttttttcttcctcttcctcctcctcctcctcctcctcttcttcttcttcttcttcttcttcttcttcttcttcttcttcttcttctttcttcttctttcttctttctttcttcttcttctccttcttcttcttcttcttcttcttcttcttcttcttcttcttcttcttcttcttcttcttcttcttcttcttcttcttcttcttcttcttctccttctccttctccttctccttctccttctccttctccttctccttttccttcttcttcttcgacagagtctcactctgtcacccagactggagtgcaatgtcatgatctgggcccactgcaacctctgcctccccggttcaagccattctcctgcctcagcctgccaagtagctgggactacaggcatgcgccaccatgcccagctgattttttgtacttttagtagagacgagatttcaccatgttggctagactggtctcgaaatcctgacctcaagtgatctgcctgtcttggcctcccaaagtgctgggattacaggcatgagccaccatgcccagcccacggttttctataactatcagagaagaggggaaaacaaatgacatgcaaacatacaatgtgcaaaaacatgcaatgtgacaacatacaaacatcctctcaatgattactttgctgtgtgacagagatattaaattgtatgaggattaatttcctgctctgtaaagttagactagaaatgtttaaagatgtgttgttacaggggaggacctggacagtgaagccacgccctttgttgcagaagaaagagtttcttttggacttcacatagccagctcctctatcaccagtgtagcggacatcagaaatgcttacaatgaggtggacagccgcctgatcgccaaagaggtacatcttctaacttcgctgctaatctctgttggaatctggtttcatggtttgcattagctttcagtgcttaagtaaacactatttcatgtttgcacttgtgtagatggatacacaaatacatgtttcccacttcatttgttaaaatatcctatgcctccccacccactggtgtcctcccagactaagcctttcatttataattattcagagaagaaaaatcataaataaaagaacaagaacaaatgacatattttaaatacctttgcaacattgaaaacactattgagcttccctagtcctgggtattaatgacccactaacactgagatattctttgagttgttgtgatttttttaattttaattttttatttttttacagatgggatctctctatgttgcccaggctggtcttgaactcctgggctcaagtgatcctcctgcttcagcctcctgagtagttgggattacaggtgtgattcacagcagcacccaatattgctgtgattaaaacaacaaacaaacaaataaaaacagtaaattttcaaaacaacaaggagatatgtttgtagatggggatgccattaaatttacttccaatttttgcataaagagctcttttgcttagcactgatgaaaatttgcaattcgtttatattccttcaccctaatggacagagggtacccccagaggatggggagtcaggaactaggtcctgttgatcatgaaagttgtggcttagcagcaacacaccgctttctgatgtaggagtccaggattcctatcttcttgcccctttgacatctgtagagattgggctcccagagcctgaacaaccctagtctgagaaggtggcagccctcaccttggtagcgctgttccacctgaaagtgtccttgggtccctcttgctcttcttagcacctcactgtgagcacgtgggacactggtggctcagactgcgtaactgaagctgctcacttacaattcagccacagcttgggagacagaatgcatgagcctgaatttggcttcaatcccctgacattggttcaattgctattcattccatgatcattgctgatggagtgtcagcactgggccaggccccagagggcctgccctccaggagctcgtggacaatgcttcttcttttgcaggactttcttaggactaattgctgctcatttctctagatgaacatttcatcccgtgacaatgccatgcccgtgttcttgctgaggaattgtgctggccacctgtcagggtctctgcggaccattggagctgttgctgtgggtcaattaggtatgttcaactgggaagctttgccgctatttgggaagcagggtttgtgctgtcatggcttgtgcaccctggagttctggagtggtggacaggatggagtgtgccagggaaccagggtcgggaggaccagagttgggagtgaatccagccagagagttagtctcccagaaagcatgaggatctgttcacctggccacatgtggcaatcagtggtgagctcagctactaaccaggctgctgtctgtgacgacaggaagctgtctatctagtgagtacagtggggcttttaagcagaagcactggttgtagttgtttgagtgaaaactgctggtcaccattcaattgagcaatagcaaggcaacaaattggtgcaagtgccctgcccagcaggatctagaggacaggcaagagcaatgggttgttagagcaatagggatactgaggctcaggggtctggctcatccaacactctggagtgaaggcagagggcggcaatctgaaatactctgggctgttcagccttctgatggcaaagaaatgacttagcacagtatctcccagccatctaagactttcagaacctcctgctcttccccccagcctgtcccaggtgcacaggtccctctggctgtggatggatggtggcactggtagctcattggtcctcctgtgctgtcggggaatttcccattgcaatgaagctgtgacatgttgatgaaatgcccactttatgccacacaggggtgagggtattccactccagccctgctgccagcagcctggacttcattggcgggcctgccatcctcctgggcctcatctccttagcgacagatgaccataccatgtatgcggctgtgaaagttctgcactcggtcctgaccagtaatgccatgtgtgacttcctgatgcaacacatctgtgggtaccaggtaatcccatcctcccacctggaactgagactcctgaaagggctgtcatccctgggaaacagggacaagcgttgcttgcctcagttgcattccctccagggtgacttctagagaagggcagccgaaagcccttgggttctgagaccagcaacttcgcagcagaggaggggcaggcgacagccagcccaagagctctgctcaggatgaggatgctcacctgattgtggcttctggcccttttcactgacaaattctaatgtcatttgtggttgtctccccaccttgtctctagcatggtggctgagagcccaggctgcagagcagactgccagagtttaaatcctatctcttctaatttgctatttaaccttagatgagttacttatcctctgcctgtttccccacctgtaagatatggactgtaatagggttgcagtgaggattagatgatttcacacaagtgaagaggttagaattatgtcaggcccagaatgagtgctaagtaaatgttagtcatttctacttcttaatctctttgtgcgtcagttccctcatgtgtaaaatgggattatgagagcacctgttttgcagggttgtgatgactgtgtttatatgtgttgagagcttagaggagcacctgcacacgggacctgcttcgcatgtgtttactgtgattgtcattgctatttagaattggtaaagtcagatgagacatggccactgcccttgagtaacttctcacatgtctgggaggcagccaggtgaggaattaggagggcagggccagggtcggagtctgggccatgtcacaggtctcaggcagtggaggcttcctctggtgtgggggctgctgggtgattggggcaaagcctcctgtgtctctcgctactgggtcagggttagagcagaagagagctgtgtgatggccttctgggcactccccctgtctgtctggactactgccacagctggacagtaaccccttcccccagcctgtccctcgtagcccactgatgccagctgtagcccacatcacatatctggtggtgtccctcctgtgtgtaaaaccttcaaaggcatctgattaccgataccatatcccaaactccctagacaggttttcaaagccattcaaaactggccacagacctttccttccagccccatctccaacccagccaacatttcagcctatgttcccacctccccaaatcctgcaccttctccaatcattaaacagtgtatgactttgtgtgcctgtggcctccgctcagagcacctctttttttctccctcaagcaccctccttctgttttccaagatcaagctcaaatagcaaaggcagcattctcttcccccagctgagcatgtggctgtttcctggtcctcttggcactgtgggcacatcccgttttaattgctctcgcacccacactggaatgctcagtctacacatctctactggaatcttctaaagatcctaaggttttttactctttgctggtgtattactgacaccatgaagacactcagtacatgttttgggaatgagtaaatgggtatgtctgagtttatgctaaaactcaagaattggggatattggtacacaaaggttttctctgaatatgctgttaaagataatagtagtaggatctattctaatacagcacaaggatatctgctgtggttagggattttaataattattgtgacaatttctaaaaaggcacaaatcatttcctgccctcatgagtgtatctagaaggagaaaataaaataagaaccaaaataattttaatataaataaaaatgcaatcggtgtccaagattcacatcaagaactactacatgctttgtgactcactggctacctggctatcttcccagaaactctgagcttctcagaaagctcagactacctcaggctcactgtggtctcattgcctagtcctggggatggtgggtgggcgcggtgagctctcagtgagggttcagaaatgagaacattgccttgagaggaggaactatctaccacagaggtacatagcgcctgctgtcacatgtaggtagaggggtcaaaaagggttttgttaaaaaaggaagctcatcaagaggtttcctggagactgagctgactgagctttccaggaagagatggtagagacaaggagtggcccaaggatgtaatctctttactcaacttaattgatcaaatgcttcctaagaccaggcactgtgctaggcactagggatgtgaggtgaacaaggtgggtttagtccctgttttcatgggacttaccatccaagaaggtggacagaaaaatactgttagcatgagggagagtctctcagatacctcctttgagtaaagaactcatcagattcagaggtttattgtacacttacacatgaaggcagaataaggaaaatttaaaactgttattctgtctttaaaaaggaaacatttcaaatatttatgtctttggggaaaatcagaaggagaagctgcgtggcaagagaggtggtaaatggcaggtttgagtgaagaaatagtattattttgtttttgcttttgtttttttaaactttcttgtccactctttataaaatgcaacctccatcctccctcatccttttctaggcacgttttctcgctttgtgtttctttgtaacctgcatgtgcatttgcgtgatgtctgcttccgtattgccacgtttgtgtctgtttcacccccaggcacatgcttcataagagcgtgtgtccggcttgtttattgctgtaccctaagaacatgccatagatagtaggtgctcagttaggattgaggaatgaatccgtgaatgaaaacaggggtcttcaattaagtggcttgctcaggagtggatttcatcagtttttaggttttactctaggctcatctgctggtttactggttgggtgggagagcataaaccttcctatctgttatttctgtctagctgatttatcagcctcttctcagactaagcaatagccagctgagttttataggatgggtgttcttaatatggggaaagaggaggatactgttccagactaacattaaaacacttccaggagctggtctgggttcctccacacggctaggaggagaggatggttgtggagctgtgcatggcataccgaatggagggtagggagccatagccttaccactgtggggaacgtaggttctgcctcacaggtgatgggcaattgcaggaaggccgggacagggaaacggactgacagaggtgttagaacaccccttgacgtcagtggagaagatgaggcatggggatgaggttcaagcaggggctgagatagaatctgacctaataggagcctgtgttcctgacctggggagtctcaggatctgtgagcagcctgggcaggtggcgctggaaaggagccagggcggtccagcaggccgccgacaggaaggaagggagatgctgggacatgctcagtgggaaatgtttgtgagacattgaaggtgaagtatcatgtgggagagaaggctctggagctcagggacaggctgtgctggaggtgtaaatatgagggtcatcgccaccatgatgatatttaatctaaggaaattgatgaaatcaccaaaaagaagctgtacagagagaagaaggttgagggggaaacaaagaggagctaaccacatggagctgggaatataattaaaacccagtaaaggagattgagaagcaagagggaagaaaaatcaaagacagttatgtcaaggaatctgaaaaaagaacgtgttttgagaaggcgggtatggtcaaaccatgttaaatgctgataaagaatagcacaaacaaaggatggaggcgtcctctttggatttggccacctggaagtccctggtggcctttctgagggaggtagccaggtggaggcagtggctggctgatgcaggttgaaaagagaatgtcaggtaaggacatggagccagggtgtgttgataatgctttctagaagtttgcctatgagcaggaggagctgcataaagctacagggattagggatggagggagggttatttttacaatgagaaatactagaatatatttgtacataggaggaagagatccagggttggggcagtggaagcttggagagaacagttatctcaaagagcagtgtccttgagatggtgaccagtaggatccagagaccaggtagatcggagactctgcttgtgacaggaaggaatgcaacacgtttgttaatttggtggtgggaaaaaagaatattcatatctgatgggttctatcttttcagcaaaatatgaggtcaggtgggggagaggaagagaggttagaggagagaggagaagcaatgaaaccatgatctttaggataagaaaatatagcttattagaaggacagagttggattgccagaactgactgagtgtcagtttgacatttgacactgtttgatgtaaagtgaagccagtcagcctgaatgttttcacatgcaacttttagccatcctaattttgtcttgctgtgggatttcatatatgtgtgtgtctgtatatatatatatatatatatatatatatatacatatatatatacacacacatgaatagtctggaaagatattgagtcttttctgatcacaaacaaggcttccgaagggcacgttgcaagaacatgtctgggaggacagggagaaagggcgggctgtgttggagccattgatggggaatggagccatggatggaaggagctgagactccagattaggtcgctcaaggctcatatgccaatggatggctgggcagactgactcgtgtggggctgcagtcaacagagatgtgaggcttggtgggacccatcttcttagtctgagacaagctgggtcaccaaatgtatgctgggacccaagtgcctccatgctgggatggatgcttcatgttgctggcttcccaggggctggtgcaactgacaggcacatctggctgggtgcagccaggctcatgggcaggtggtagcttcccataaatgcagcatttatgggatggttacgcatgtaaaggacccagtaacagaaaatgagaatgaggcttgaggagtgtgggaggaaaccaggagagagtggcattctggaaacatggaaaagatgcagggaaaagtaagagtcccagtgagaagtcaggtcatagcacagaaaagtggccacagaagttgatgtgtatttttcttctgagaacatggaatgaaggatggtagcagcagagagcagaaggtttgcagactggactgggacaagtgggtgaaggggaaatctctaatgatgcattcatgaggaaactgctttgtgttaaccttttcagataatggcgtttctcctgaggaagaaggcctctctcctgaaccatcgaatttttcagctgatcctctcagtggctggcactgtggagctgggcttcaggtcatctgctatcaccaacactggtgtcttccagcacatcctctgcaatttcgaggtaaatcagagattggcccttagtccttcaggagtgtgtgtgatggtaaatatgctaagtctgggctttcccctaaacctagcatgtcagcttccctcatagtcatgatggtagggagagggaaaaccaaacgagcctgcccagaggccctggtttgtaatgacatgtgccacctatggactgagtggcttcggacaaatctcttgacctctctgagccccactctttttcttgggtgaagtggagaccttcatctccttgcaggctgtcatgagggttaagccagatagtatctgggaaaggatttttaaactataaattggcatatacatatgagggtaaagaaaaatgatctcagttcctttgggtggtgctttgctgtttccaaatgattcttgaaaggggtgagttaagggatgcagaaggacacgcctgaggctgaggagcatcgcacacaactgctgtgggtggatcaacccattcatgaagcatcatttactgagcaccctctgggtcaggtactggccatgtcctggagacacagtgaaaactagaacccagcccttccccacagccagatgggactgggacatagccaatgtaacactgcaaatgctaggtgcttcagtgagacaggcacagggcatctggggagtgggagtgagcaggcagtcagaattcagggggaaaataaccttccaggtggagtgtatatgctatttgcaaatactgtacatcagagtgagagcagccatggggacttgagagcaagtggcttgttgggggcctacaggtttgtgttggttgcaagagcaggagagagagaaggcaggcccaaggggttagactgcccagactacactttagcctgggcatgtggaggtcctcaggagaagtttcaaagctctttctttgtttattaagaaattgatatatgtttattatagaatattttttaattagagaaaaatgtgagggggaaactctcctattaccaagacctagttaattcttgtcaaacctggatgcattctcttacagtattttcaatgtataatacatttttaaaatcatagtcatgattatactgtaggttattttgagtctagtctttgctcacataccaaaaacatttaaacattttcattacaaacacaagcactgttttgagatcagaataatattctgttatgctgagagttcctggtttcttcatcatttctctattgccaaatttttagattctttctatattttgttataaattgtgttatagatgggacttttgtgctgatatttctctcacttttaaaaacattttcttagaataaattatcaaaattaataatgagaataaaggcattatgaacaatttttagattgttgataagttttaccaaacttttgatatctagggatgttaactgtagaatgatatgtgagaattttattttaggtatgtgacttcggtgacaagagctctgaagcagggagatgggtcatgagatgattgaagaaatctgggtagaggattttgaaacctaaactgaggcaagggtagtgggataatgaggacagcaggtgaaaaagtcgaacttgaaccagaagtgacttagagacacatgacaagggaaatactacatatcaaaacaccacagggctgctactgaaggcaggaccagagggagactgacagtcatcaatatgtatattataaaaagagaatactctttgtataatatagatcaagattcggttcaacgtctaacttctaacttaagatcaagaagttagaatgaccaaacaaaatcaaaacgcagagaaagaaggaaggaaacatataaatgagaacataaattaataaaataggaaaaaaaaacatacagaggatcaacaaggccaattactgtttctcctaaaacagacaaacgtctgttaagattggccaagaaaagaagacagaagccacaaataaataatattaggaaggaaaaggggagaataccacagaagaatgagcaattagaaaggaaagagacaattggattagtaattttgtgccagtaaattagaaaacttagttcatttgaacaatctcatcgaaaatgtaagttttcagagcgcactctaaaatgaataaaaaaccccaatgatcctagaatcatcaagtaaagtgagtcactggtttaaaatctgttgacataaacaacaaccagaagggaacgccaggctgggcactcatagggaaattccaccagtcaggaaataggttctttctagcttctttaacgagctaatcttgatggcagaacacaaaaggacagaacagaaaatgaaaaagtacaggctaatcttatttgtaaatataggcataagagccctaaatatgagattagccagttgaaccaggccaagatgaatgtcctggtcctggatctgaagctggaaaagaggattgtggaggaagccagcatggcctggagaatgggctccctgtgcacaaggggaaagaagatgtacataaatggccataaaaccccactaaataagataatgtgtcttgactgcaaccgctgctgccccttctgaagtgctgtggccatgctcagccagtctggctccaaggtgtcctggccaccagcatggcccaggaattactaatgcaggaacccatcatgctccattgcctgctactagaatggccatggacaccaccctaccccaccccaccctgaataaaactaccctcttcaggagatctggtgcttttaaagctggatttaagaaaataaaccaccaataagaaccagatgctaaaaagcaaagcaaagtgaaacaaaatgaaatgaaacaaaataaaatttaaaagattgaggggagagaatttcaaaaagggaaaaatgtttcccaaatgtcatgttctgcctacaccaagtaaagtgaggtaagggatgtgtgcactgtacgtgcccattggaggtcactgacagacttagtgacaagtaagttgtggggtcagaagccactcagaagtaaggagaaacggccgggcttggtggctcatggctgtaatcccagcacgaagaggccgaggcgggtggatcgtgaggtcaggggttcggtaccagcctggccaacatggtgaaaccctgtctctactaaaaatacaaaaattaggtgggcatagttgcgggcgcctgtaatcccagctagtcgggaggctgaggcaggagaatcacttgaacccataagggggaggttgcagtgagccgagatcatgccattgcattccagcctgggcgacaagagcgagacttcgtctcaaacaaacaaacaaagaattaaggggaagtgtggggagactgaaagtggaggcagtcagtggactttggaaaatagcagagaggaagtttcagaacttttggttttgggtttttgttttttgtttttttttgagacagagtctcactctgttgccagaccggagtgcagtggcacaatctcggctcacagcaacctctgtctcatgggttcaagtgattctcctgcctcagcctctcgagtagctgggactataggcatgtgccaccacgcccagctaatttttgtatttgtagtagagacggggtttcaccatgttggtcaggatggtcttgatctcttgatctcatgatccgcccaccttggccttccaaagccctgggattacaagcgtgagccaccgcgcccagccggtttcgtgttttaagatggaagagacttaagtctgtttgtaggttgaaggagaagacgcagtaaaaaccagacagttaaaatagtagtgggagaagaaactgctaatgagacacatcctcagagggtttggagacaagagagtggatcacaggagaaacggtgggatccgtgatgactggtgtgaagcagacaggaagaggaagttgtgaggaagggagagacaggaagtcattgagaagggaatggacaggaagctgtgagggagggtgggtacaggagattgttgaagcagggagggacaaaaatttgtgagggaaggagggacaggaggttgtgagggaaggagggacaggaagctgttgaggcaaggttggacaggaagttgtaagacagagttggataggaagttgtaaggcagggttggacagaaagttgagaatcagggaggaacaggaagttgtgggcttctaagtcttaggttttggtttctttctttctttctttctttctttctttctttctttctttctttctttcattctttctttttttttttttttgttttgagatgaggtctcactctgttgcccaggctggagggcagtggtgcgatctcagctcactgcaacctctgactcccaggttcaagtaattctcctgcctcagcctcccaagtagctgggattacaggcacgtgccaccacataaggctcatttttttatatttagtagagaagggatttcaccatattggtcaggctggtcttgaactcctgacctcagatggtccacccacctcggcctcccaaagttctgggattataggcatgagccaccatacccagcctctggtttcttaaagaaggaactgactagttcatttctaagagtacagtcatctcaggggtggggagagagcaacacctgacacattatacagtccatactcaaacaaatctaatccagacatcttaatatagtccttagtacaggcttatgtgacacagaataacaatcaaaagattcagttattcatgtttcccaaaattctgacatttggcattatgtaatttcctgatgagctaggcagcctcaaatgggtgtggcaacttattattgttgctgtgttctggaaaggaaatgtgagaggctggaacttttgtgggaagtgtaaaaggtgcaccttattgtactggtgggttcacatctgactttcttagttctctcagcccttagccccaggcctggcatatcatttgttgaatgactgccttcatgaatcaatatcctaagtgtgcagggctcttggagccctacagacatgtatgttggggtgccatgctggatacccatgttttcactagagctgccttcatcaataccagctgtcccaaatggcagctggcccacctctgtgtgtgcctttgggcagtggctgtgcttaaaaaagcaggaaatctgtcactcttttcctggcggaagaacaatccactcattttattttattttgtatccactcattcttttaaaaaatgtaatgcatctttacgaaagatagtggcatgtatgatgctaggttccagggattaaagagggacagtctctaccttcacaggcctcccgataaacttgtgttcactggggttcttttgcatttcctcttcagcaagagtaagcaaagtcatgggtaactgcttagcttcaagcaaggttgagtattgaccctatgggtcactatctgtaggtgatacccatgggtacccagtgtggggcaagggaatgggcttcgtagtcaggtggattgactttgaaaacagtctctgccaattaaaaaaaaagtctggtgccagaaaagttacttagtctccctgagtcccattctttctagctactagatgcagataataggccgggtacggtggctcacacctgtaatcctagcaattttggaggtggaggcaggaggaacacttgagcccaagaattagagactagcctgggcagtaaaacaataccccactctacaaaaaaattttaacaattagctaggcatggtggtgcaaacctgtagttctaactacttgcaaagctgtggtgggagaattgcttgagcccaggaagtcaaggctgcagtgagtcatatttgggccactgcgctccagcttgggtctctcaaaaataagaaaataaatacataaatgcggataataatattttgggtctttttatggcacctcttgccaccaggaaatgtatcagttattaagtgcaagctctttttgctgctatatgagtgcacgcttataatcccacacctgaaccttgtatagtctgggccttaggaactgtcagtatttagagaagaaaaatattagagttctctaaagggaagtagaaataagacatgatggcatccatcaattctgccccagaaggatcactagcagctacatttgtttactatgaatgaaaacaacctgagtgatcaacttcactttcagaatctcagtgaatttcatatctttgtttcacttacaattttgtcatgcatgagatgacactgtggtttgggctgaagaatgtgttgcctgcgcaaattgggtatgtagtcagtacagtgtaaaacctgaaaatctgtacctggcttctatttcctgtcctgccacttgctggtggtgagtggagactgtcactcagctggtctgtctcagcctctattttctcatctgtaaagtgggaacatcatcatttgtcttgcaggatccagggaggttgagatgagtttgcaatatggacacttgggctgtgggcccaaggctgagcagatgggggagatggttagtgcaggcgtccttggttggaaccaggcccacaatgaagtgccaagtagcagcagagatggcgagagaaggccttcctacaggggaggcacctctctgcttggagtgtcaggacagctgatctgattccagagctggtacatcatgttgatgattccacgtcagaggatcacctgtccagcactgaccttctcatgcttcctgcaaatcattcttctcccacaccttcattttagcatgtgttttgttttgtcttccagctctggatgaatactgcagacaatctggagctcagcctcttttcccatcttttggaaatccttcaatcaccaaggtaggctgggtcttggcagcctgggggttagaactgaaggctgaatgtccagaacagagacagggcagggtggccagtggctcttccctgctcccagaacactgggtccccaaatgggagcacatccttcccagtggctcatgcttgtggggcagtctcctctcatggtctcgggcctcaggagggcagatgctgggggcttagaggcctctctagccccagggactagcacatactgggggctcagcaattgtgaccagcaaaggtccactctccctctaactgacttctccaaggcacttttggaattagtcagggctcttttacccttcaagtggtagaaatacaactcaaaccagcttaagggatgtaaaagagaaggaaagaaggaagggaggagggaaaaaagaatacaggaagaaaagaccagtaaagagggacttcgttggctcttacaattgaaaagagctgatctcatcctgtagctgggggaggctcacatcattttctctgagctctgtcaccactcttgcctctgcctcttccactcagtcttcaggttgcccgggctttcttctgtggcagaaggtggctcctgggcagctcctcagagcacatcctcagcttagcaccataggcagagagacagctttttaaaaatttaacagtcttagctattggactgagtctcattgagccaactgtgtcccatgactgggctggaaagtggcttcccctctggagttagaaagtggtagttcccaaagggagccaggggctgtgttcagaataagagagaaggaaggcaaggaagcccacatatcaccccacctgcctcctcctggctcaggctggtctagagctcattggtgccttcagcattttgaatgtatttgtaaatggctttccactcatccacttaatgaacatctattataaacttactacatttcgcaccctgtacttagaggtaaaattcagagaagaataagccacagtctgataaaaagagaatacagaaaaacatgttgttcagtgctgtcagaggaaacagaaccaagggcagccgggacttctgggtagaggagcatctgtcttctctgctgagcctgtaattataaatcatacacagaattgggctctggtcctgcctcttttgtgtatcagggagatggagctcagcagaatttaatgtgttaatacaaaaaaaaaaaaaaaaaaaagacagttcaaagtgaggaatctgcccaaagtcaccctcctccacatttttctccaccattttttctcttccactttccactttgttcctgtacctgtaccagttgttttctaagaaacagatatttatcctgggagctgttttctttgggggagtagaatttactggaaattggatttgtgagtatctgagggagggggtatggataggtggattctgtctttttctcctttgactttcagtggcgtgtctctccactttgtggtttggggcgggcaggaagatcacacaaccagacaagctagtgaagggccctgcactcctggctggtgggaagtactccccagtcacatgagtgtctgctgtctttgtttgagtttctgaggccagcactagttttccctggggctcagaatttaaaagtcaataattggggtttgtctttgaaggtggtttccggggggcggaggggacaggcagtgcacacccgagcgactctggcacttagcagacacatattcaatgggtgtctgacggcatcttgacaaattgccaagagagcattggagttaaggggccatggaacaagcctggcttgaaaaacctttttagcagaaacacagcaaatttggttcattccagtaaaagcttttactgtctctctcctgtactcaccagggaaggacccaggaatgctgaagctgcccaccaggcacagcttatacccaagctcatcttcctattcaatgagccgagcctcatcccctccaagatctccaccatcattggcatcctggcctgtcagctgaggggccacttcagcacccaggacttgctcaggtaccacaccaagctgcccagggggaagagcagggccccagggctgtttaaaaagggaggacagaccccagctctctccccattgtgctcaaccctgaatcacttggaaccttctaggaatttttgcccagggctgagagttggggaaaggatggtttgctgaagtcaggatgggacaggccggtttccccagcagggctgtgtgtttactgttcccactgctcaggctcccccactgtggccaaatattcaggaatttccataagcactgccatccttgccagccaatgacccacatgcctggctcctgcagactcctgaagagcagtcccagccaccagtgtgtttccccttctctttcctgtcactatctaattgatcaggtagagccagagttagcgtctctggtgaatcctgactgattttagaagtctctggaaatacacagcatgccatgatgatttcccttaaactctcacttgcagctgcacgtgggtgggtctatgtgaaaacactggcatgtactcagcggactcagttgagcccgcctgcgagcctgtccttctctccctgtgtataaaggattgggctgtttgttgtgtacaccctcaagccttcgtcggtgaatgagaggcagatctgcatggacggagccctggacccttccctgcctggtgagaagacctttgccagttcgaaggcagtaggacggccctcacggaacccctgagaggcccacattgtgcagagggaggggctaagtaaggaaggggaaggcacccacagccaagccgtggtttccaagccgtggcctgtgaggctgtcattttatgatgagagtcagaaatgaaataaaattatagattcctgctttgaaatgtgggactggtgttccaggcctccagaataaaatcagttccctgtagaccagcatgtgggatccgggatcctgcctcacttcctggttgaacccccactaccccttactttcctgatgagccccaactccagcagtgaagcacttgcaggcccctgcaggtgatggcctgccctctgtccgtgcttggcacgtgctcttcactcaagggaaatgccacccctcccccactagccaagctgtccccagtcccaccaaaccagattaagtcactttctctgtgtttccaaagccccttggggttaccctactgaatagatttgtagtttgtttatgtgagtctcccttttcgcctagccaggtgcagaactgcagctgtgtcttgttcaatttgttccctctgctagggcagtgtgatggcagcaatcacaactgctttgtcctgggccctgcggctctgcactgtccaagacgagagcccctaagccacatatagccatttaaattcaaattttaactaattaaaattaaatgcaattaaaaacttaattcctcactcactgtagccacgttttaagtgctcactagctacctgaggctagcggctactctattggacaaggtagatataaaacagttttatcatcacaaaagagtctcctggatagcattttttaatctagataaagtattatctcttatccttagatcaagccgcaagaaattactattcccattttgcagactaagaaatttaggttcaatgagattaggagctaattgaagatgggaccaaaatctgaatagacggaaatatgactccatttccccaggttgcctcatcagtcctatttctacagtatggcgtggtgtatgccctgtattggtgtgaaattgctggcaactgagggaatgaacaaatgggtaatgggccaagagtgaacttatttagtcaaccttccttctcatatgaactgcattctgaaacttttacctaaccaacatattaaagcattgttaatatgtccttttgggctttaatgactcttcagaagtaaagtttcttcttccccttgctccatatacctctgctatgatttgagttctgtttttattgtagcatagacatccaaaagcctagcctgggagcaagttgaaagcaggaacaaagagaacaaagaccatggtcttcagcactctgttcctgattacttgcataatatcagtgcatagtaggtgattatgaaatgttgcagcctataataatttaaaaaattcttctactgaaaggtatattttcctttattatttttaggatttttgttttttggaagatgtgcagcattgcagacattgctaattaaaggaaacttcagtaacattttctgaaattctttttaagcattgtgtggaggctggaataaaatgccaaaattttgagtcccagccatgccacaattcctgggtgaaataagcatttggtgaatatgattgcttactgcagcaaatattatgtctctttacatccattttctctcaaatctgaattcttttttgtagctggaagccaaacatctggaaagacaatctggctcagaaaccagttgctggagatgctgctcagtgtaatatcttccccccagcttcatctgtcctctgagtaagtagctccaggaagagcaatttggcaggaggttacctcatacagggtgtggcattaaaccttttcttaatgaaaagtttagcatctctgagtctgttttctgcaatgtatttcctgcactagtcagaaagaaaattatattctctctacccaatgaaccagaccttgccctaagatattctgatgcaaatgttaagtggacatgagtaactagaaacagatttggtataattacaataaactccttttgtcaccatagctatagtgtaattgttattgttttggcagttgtgacaattactgattttgatgtcttgtacttggcagacaatagaatgaagaaatcgtgagcctaaataacatctatcaaggaaaagtcttgccaaattcttctgctatttactgttagtgagtttgttatttttccaagttggaaaaagaagtatctaccgtcaattaacttctaaaatcaagtgtaatcataaagctgattccattaactctccccactgcctgcctgctttacctccaaccttggagtcgttcatttgacacctaatttgttgagcatctactgcatgccagacactgttcccagctcctaggatgcagtgctgagcaagtcagcccggatccttgctcaacctgtatatgcatctgggcttgggggtaaagagttacccctcagtaaagcagctttataaatagtgtttaataatttaccagcctataaatcctttctttcttagaatcaaaacatggtagaactggaagatgccttggaaatgagatagtccagccactttcttttccatctttttgaaagggaatgtagtgcagtgcctaacagctgggctctggcatctataccttccgggttcgaatcctagccctgtccccagggacccagaggaggctacttaagccctgtatgcctctctctactcatctgcatgagaataaaaattgtattatgttggtgaaaatgtaattgtgtttttttcattacttttaatgccaaaaactgccaatatttttgcaccaacctaatactttcaataggtgagtatagtaaagatgaaatgaattaatatatggataatcctgagaatggtgcctggaatactgtaaattctctgtaagctaattgctattatggccatctctttcatcatcaccatcaccaccaccatcaccattaccaccaccatcatcaccatcaccatcatcaccatcaccatcaccaccaccatcatcaccaccaccaccacattaatcaccatcaccaccaccaccatcatcaccatcatcaccacaacattaatcgccatcaccaccatcatcaccatcaccatcatcaccatcaccctcaccaccatcaccatcatcaccacattaatcaccatcatcaccacattaatcaccatcaccaccaacagcatcatcaccatcatcaccacaacattaatcaccatcaccaccaccaccatcagcatcttcaccaccagcatcaccatcaccaccatcataaccactaccaccatcaacatcatcaccatcaccaccagcatcaccatcaccataatcaccaccaccatcatcaacatcatcaacatcaccaccaccatcaacatcatcactgtcaccaccaccaccatcatcatcatcaccaccaacatcaccacaacgttaatcactatcaccaccaccaccatcaacatcatcaccatcattatcaacataatcactgaggaaaatgatcagagcacatcaggagctctgccaaagtcatccagttgctaaacatcagaggcagggctagaaaagaggacagcctcttctcttcactcctagtccagtgctcatttcagtggataccagccagattctcactatgcctagtgtgtcagctgagaacacaggtggagccttcacttgttcccaaaagtctgggtcctttgctgaacccagtgtctttggccaacccattggccattcatctccctgccctcctgtttcatccaggtcccatcagcaagtctgtattctccagactcatcatttttgaaagtgacgttaatcatgtttctttttttttggtgctaaaactgataaaaatgcataaatattgaactatgccatttagataaattttgactagtgtctttaaaaagggaggggaatattcattatgtgttttatgtgactacattgatggtaattaaattagatgggtggctagtcatccactgtgtaagtatgaatagtagttatatagggctattaaggggcatgcgcatttttacctatatgaatacacagtttccaattgcttcaaaatgctgtggccaacttacactgcaaccattaatagacaaatgcatcatttgcacaacaatcttgccagcattttattttactattctttttaaatgtaatacataataagtgatgttaaccttaacttgcctctccttggtgacttgtaaggctggacatttcatattttctggacatgtcactcgctcatggactgagagaacattggttgcatttattaatccccaggtcaaaggaagagatgtttctgaaactggggcctgactggttcctgctgctcctgcagggccacctgcatgccagcaccactgtgctggcattgaagctgctgctgtactttctggcaagcccctccctccgcacacggtttagagatggcctgtgtgcaggatcctgggtggaacgcagcactgagggcgtggatattgtaatgggtgagcacgtggctgtctccagggagtggggcaccacctagtcctgggatgtgaatgaggaccaagccaggccccttcttatttgagaccatcacagctctgtgcagcaggatcacctcgagccctgactccaaggcctacatccaaatgagcccagcccccctgacatcctttgcaggatcccccgcagcctcactgcacagacactggaggctgccttccattcctcccacctgcttagccctgttctcctgggcactgtatactctgcttcctcttcctgaggggatgcctcttctcctgatgtggattcatcctgagatctcagttcaaatgccacttcctccaggagatgaggggtctccctgaattgggacacctctgttatattatctctgcccttattatttttctctttagtgcttcacaaaattcataattatttgagtatttaattgcttaatgtctgtccctcccactacaatgcaagcttcatgagtgcctggaattctgtatatttggttgaaaccctacacccttgttgcctaattcaaagctgccctgttgcctcctacatggtgggcagcaagtatgtttttgagtgaatgaatgagcatgtcaggaacagcaaagggaactactgttgagtgcctttttgctcccatctatgtgtgaatatattttatcatccagcatttctatgggatgggtgggtggccgggtgttcctttgtgtgtccaggccccaccttgaccagcagctgttctcagctgacttttgtgccccctttgcctgatcaatagacaacctgaagagccagtcaccactgcctgagcaaagcccatgcctgcttcctgggttccgtgtcttgaatgactttctggcccaccacgtccacattccagaggtctacctcatcgtctccaccttcttcctgcagacaccactcacagagctgatggacgggcccaaagtaggttttcagagcacccacagggtgacacacttggttttctgattccacatgactaaggcaggtcgccaagaccctctgcacttacctccctctgcttcttccagctcagatggggtgctggcccacttccctccctagcagcccacacccttggccagcccttcaaatgctccccttccaggcccttgacttcctcggcctctgctcccatccttcctcccagcaagtctctgatttggatcagttctattttaaaaccttccttttgggcacagctaggggaatgacatgatgctggggtggccctgccccagcaccccagcccctcatcctcaaccacccacttaggtcatcatcttcttgcccctgttgctaggacagggagacttttcaaggctggtcatggattccttcagctccttccttgggtgacctcatcccatagttatcctttctttctttcttttcttttttttttgttttttttgtttttttttgagacagagtcttactgtgttaccctgggagagtgcagtggcgtgatctcggctcactgcaaccgctgctttctgggttcaagcgattctcccacctcagcctcccaagtagctgggattacaggtatccaccaccatgcctggtgaatttttgtgtttttagtacagacagggattttccaagttggccaggctggtctcaaactcctgacctcaggtgatccaccctccttggcctcccaaagtgctgggattacaggcgtgacccaccgcacccggccccctttcttccttttgtattttcagtttttccttttctaccaacccgttcctcataagccataattatgttcagctgcatcccacctaaaaccagaggctgccccttgataacactcctgaccaaatgctgcctattgatcactttcctatccttccttggccacatttctccaaagaggagtctgtgctcaccgtatgcaccttctcccttgcactaaattcaggtgactttcacacctgcagcatcaaggtcagactccatagctggcaccaagccccctcatctctggctgcctgatgtatctttccaacccagctgcaattcacccgccctcagctgtgagtctcctaaatcatcttcagtaagactggctgctctgtgctcacccaccctgctgcccttactcactcctctttcccaccatcgtctgcctggtgggagtgtcctccctcagcactcagcttagatgctacttcctacttagacccccagacagaggagaccatttcctcctttgtgcctcagtgtagtttaccctatatggatggcaccaatacaaatgtgtgcctgcctccttagaaactgagcccctgaagaacggacccacctttcactcaacttcctggaacctgacaaatagccaacttagaaactatttcttggtctcaatcgagttgagttaaacctaactgaattgaaatatgggaggggcgtggctttgccaagagaaggttaaaaaatctacccctcttgtatatctttataattgacaaatctaaatattgacatatgctaatagcattgtatattacacttcaaaataaagtttttaatatgctgtactaaggtcattgataccctgagtttttatttctctaacatatctcaggaaacagatgtctgctaagtgttggaacttgtgatagatgttttacatattttattttgcttgatatttaaacaatcccatggggtagataatgtaattctcatttcacagagacgggaaatgaactgccaagaagctcaatagcttgcctgagctcagctattaaaaaggcagaatcaggccatcctgattctaaaccctaagtttagaatctctctatacctctacatgctgaagtttcccctgaaacctttgaattctttatatgtcttatataatctaatttacaaaagttaattaaagttgattagcatatttacttatgatgtcagaccaaaataactgaactacatgccagtctctaggggatcttcagcaccttcttggaggtgcttgtttcccttatgcaccatctactggggtgaaattgttcctatggatcaaccacctaggctgccagtgtgctcttttgcttttcccactgggaacccctggaaacatgatgaactggctgcaaagctcgttctcttggtgagtagccgcaggtctgcttacagctcctgcctcctcttccaggacagccttgatgccatgcttcagtggctcctgcagaggcaccaccaggaagaagtcctccaggctgggctgtgcacagaaggtgccttgctcctcctggaaatgctgaaggccaccatgagccaggtgagacccattccccacatgctgccccgaggaggttctgatgggaaggccagtttggaagggtcaccttgacttttctcttagcatcttcccactaatgcaagtaattagccagatcctgtagaagaggtgaggtaagttcctagagtgactcaggggcacaactggaaacccagcctataggtctctgagctttatgtgctcttgcaggtgatacctgtttatcatttgtttaagcatgggatttcttcactggaagatttattgccttcagtcaaagggaacatttcttaggaggaggaagggcctctcctctcaacgagtccatctcctcgctcatgagtgacctggggaagggacctgacttagagaaggcagatggccgccagctacaggcagggcatggagtcttcgggagtgagaagcctttaatttgagccttcaaggtccagtagaggtgggtggtgagcagaagagttattttagacattgggtagaggccatgtgacttgtgaacaggaataattaatggtaagccaggtcagggagggtttccagaaaaggctgaaaaattctgacttcatcctgtaggcaccaaaggcaattggaggcctgattgtatggggaaacttactgcttttgtaaaatgatacatgattacctttaacatttaaacaaaagggaaaaacagaaagtaaacaacacccacctgacacacacccacccaaaaatgagcactgtgaatttggtggaatctttccagatacttctccaagattcgaccatatcctcacagaggatgagaccacatgtaccccttttgcctttttttcctcaatatttgtggacctcttctcatgcaaataaagtgaaaaaacatggtaatcatttgtatttgtaatggaaattgatgttgttttacagagtgttgtttgtaatgaactttcttaaacaaatatctttctttctgtcttgatgacctctttagtgtattctgggatgtagtatagcaggtcaaagtgtgccttcaggcgttttcttttggatgtacttctcagaaagattgcattagtcattatgcatacacatcccaccagcaaatatctaactccttatcttgttcagaaggactcagccccatcctcacagcctcaacatcatggccaaactgatgatggcttcatagttgagttcttttgcatttattatttctgaggttgaaatcatttttcatatgtttattagctatctttatttattttcctctctctctattttcctgtcaattgcctgattatatcttttgccagtttttctgggtgtgtgggattatgctgagaaagtagagatcccactttttgccctttttgaaacagattttttttttcttttttgagacagggtcttgctctgttgcccaggctggagtgcagtggtgtgatttcagctcactctagcctctgcttctcaggctcggatgattctcccacctcagccacccgagtagctgacaccacaggtgtgcaccaccaatgcccagctaatttttgtatttttgtagagacggggattcatcatgttggccaggctcagaagtgtttttatcgttattattagatacccttttagcacacagttagataatcctatgctttttttttttcttttagccagtttcctatgatgaattacatcaatagatttctttgcattctttcaaagacctcatttagtcactctgtccttattctgtttgtattttctttatgatttcatgcatcctataaatgatattagtctgcaatttagtttttgttgaaaaatatttttcaggttttgacatcagtattatgctaatattatataaaaaagacttctctcctttctttgtattcagcaagacgttaaatccatgatttttatattattttaattgttcctatgaaattgcctggacctaaatttgtcccattattattggcttgtttaggcttttaaatgtcttcttgacctagtttagttaattaatattttaaaataatttcccattcatttaatttgcacaaatggtctcctttaactcatgtcattttctgtgtgattgtttctcccttcgtattctcagtttgtgtcctgctttctccttcttggactctcttgtgacttaggagttgaaggcttgtggatttatataaataaccagctcttgggtacatttatcagtctcctgattttatttctgtcaatttctaagattttgattttggcgtcttcattttttgttatgttctggaatttctgtgactgtagtgttaaagctctctttgattcacattttctaatgtccatgtggtgaagatttttggtttttaaacttttgttctctatttctagttatgttttggccctgctcagatcatgtgatctgtatatttttcatcttcaagaaatttattcatggttttattgtaggcctaatgagcaattaatttaggggtacctgaaaagatgtatattttctgtatggagcataaggaatctgttacctgtttaatcaattaatgttattcaaaataaagcaaacaaaaggaatcacatgcaagcatttaaaacaaagaaaatatgtaatatgctgagagaagtaaaaatataagaccaaacatgtatgtcataacagcaaacataaaaaggttaaatttctatattaaagatgtgaattttagacttggtgaaaaacaagactcagacttctaagatctaacatgtatgtatatacaacaataacaaagttactcagtgagtttggtacaatcaagatctgtgtcaggaaagcatcatctacccaatacagtagacaagtatcaaaaataaaaggcagaaacttaaaagataagagaaaaaggctaggggtaaacatagaacctacttcagagggttgttgtggggtgagaagaggcatatgtatgaagcccttacaacgtctgcacatattaaacccttcctcaattggacactagtgtctggtgctaatctgcagtcttaaataatgtatcttgttgaaagtctcaggaaggaatcttctccctagacctcagctcctctggttagggaggcagcgcccatcatgctgccctgcactacctctcaccaagtgtgcctcagcccctggcaggttctgaggatggtgcctgggcacagaccttcccggccagcgtgctgcagttcctcagcctcgtccaccgcacctacccccaggacccagcgtggcgagccccggagttcctccagaccttggccatagccgccttccccctgggagcccaaaaggtaggacatgctgctgtcccacccagagagagcagttgtgagcatcatcatccttcaagggcaaagggcaaaatccctcccctcccccctaaaattaaaatacattttaaggcaacttgagcggaacattgaataagcagcttggataaccatccttttttggctgagatacaccttgaggtcattttcagctctgagattcaataatttttttgagctgttaagaatctcagtaatgagaagtctaatggcagataaagtccattgtctgtggcatacacaggcactgacaaggggagacagtgactcccattccaggaagtctgctgctgtgcaccacatgggggagggcagtcctgggagtgcatcctgcaaaaacttttgctcttgggaaccctcatccaacttgcaggcccctgggccatgacttgtgtgcccttctaggcagtgggtttgcagaggcccagcttagagccagacaagccaaggggagggcagagcctgatttaaggatgaggtcttgggtcttatgctctgggggttagagaaggggctatgggaagacatgtgagtttgaggcctccagctaggcccagcaggtcaaagcttggctgggtcagggccgtgtgggactcaggtaggctaagacctcctgggagctgggaagcgagaaggaggtgaggactaaagaagaaggtcaggtatggaagaaggaagggcagaaattcacacaaccacccccactctggtggattaggaagtggagacccagtgagggcaagtgagctaaccgtgtcttcctgcaagtt

SEQ ID NO: 1227 - DNA, 26224 bp, Homo sapiens
gaccccccctttcaagttcccaggccttctcctgctgggaaaggctttctcatgtctactcacatacctttgctgcatactaaacccatttccgcgtgtccgccggtcactctgccctgaatgataaccttcgataggtttacaaatgctcattaagtcacccttcaagtttatcttcccggagccgataatcacaatgccttcagcttcctccgtgttacaaaaagcaaagcgaagcaagacagctggggaagcagggaggcctcctttatctctggctccagctggactcaggaaaggctctcccaggttgtgcctccccacagcaccttgcctcccagcacaagctggcccaaaagatcaagcgcacctgccaattaccaggaaagcaggggcaagagggagaactgatgtcttctatggaatgaggcactatgctaagagctttcccctcaattacttggtgaaggaggtagtaaatccctatattaaagactaggacgcagagaagctaagtgactttgcccacggtctcacagctagtgaggggggagccatgtgacccacagcctagtaagaggaagcccatagtacccacagccttgcttggcactgggaaatggtttggatatgggggaatggggagattaccgtttgctccctcctctcacacctcctctcaggaccctcatatctcacacatggaaagtcatctcccaacttcctagcatgggagaaacagtgctggagaggagcaggtggctgcacccagtcccgccagcagcctgtctctgagcattgttctccacggtcaacaatgacggcactgaattagcctcaggccattgtggttgctggggtaggagacgtagtgggggtgggggatacaggtcaagaggtgacaacccattcattccctcctagtcattggagatctgagagctgcagcccagtcagtcaggagccctgagcccagtgtgtccaggaatcagggaaaacaaagaggtctctggagatgaaaggaaagaggaggggaggaagcccccactgactttcccaccctccaccctccactgtccaaggggaagaaaggccaagggcacagtgaagctgggaggaacagccagcttcactggaagtagaccagagctccaaagcctgcagacctaggcttcgctcccagcacaaccactcgctcaacgtgcgattcagttacttagcccctgagtctcagtttccctatctataaaatggagaaaacaacccctgctttgcagggctcttgagaggattaaatgagatatcagaggcatccggcacaacactcagcctaaaggagctcagtgagcacagttttccttctcttcttttctgggatttgtctgccttgggttcccaagactaatgaagtccacaggaaaagcagggtggctgccttctagcccttttccaagaagccagggaacctctgcaatcctaggactctgtggacctggctgggcagaaggcagcaggcagctggacctaaagcatccatccttcctgcccctccaatgctggcttctgggcctggggggacaagaggccgtgaaagacccagaactactgaccccagagggagatgtaggatgctgggggagggcagtgcaccatcagaggaccctgagatgatctctagcccacctaatggggctgcgtgaaagactgatggggaggtgggctccagggccaggcaaagcacttacttgtcatctgtggccaattctgacttccagaaagtttctgagccacttccctacccgccctcagcttttatcagaaaacacatggcactcagagaggaaagtctttactagaatatcagcctaaaccaactcagtcagacaagtaaatctcctggaaaaaataatagaagtgatgtttgaactctcggtgctatttctaaaccactccctgccaggtggggtacatggagagctgcagagctcagctaaaacaaaggtggcgatgttacccccttcaaagtcactgctcatggggagagcctgggtcacagcctagaggcggaagggagtcgaggctctgataaggcaggggaaggacaggacagtgcctggggcctgctgactgttccttcaccccagagaccacagggataatcagctcacagagccttccggcctcaggcatttagttctcactctagggcctcttgtgggagagagggacgaggacccaacaccagcctctccccagggtaggctgagcgcctccccattaaaggctttggctgtagccgctctcccgtgcagaggtttccccggcggcagcggcccgcttcatgctgctgccgtctgtctttctgttactgctgaaatgtgtccccacaagattcatatgttgaagtcctaaacttcatatttcttcataatatgactgtatttggagataggcttttaaagataagattaagttaaaatgtggccattagggtgggccctaatctaacctgatggtgtctttttaagaggaaatttggatacaccaggagtgcacaggcacagagagatacccatgtaaacaggcagcaaaagggtgcccacctgcaagccagagagagaggcctcaggaaaacccaatcaagttggcaccttgatcttggacttccagcctccagaactgtgagaaaataagtctctgaggtcggtgagccactctgtggtgtttcattatggcagccctgacaaactaagacacttcccctgtctgggggtcatgaacaagagtctgggggaccccctccaacacactcccaagagccccagtagcccgggcagggtcccctcagctcagcaccacccttagtcaaccctcagcttctccagcctcctccagaaatctctaactgcctgaaggccaatcagtgagccaaccaaggctgtgtgcaggttgggattgctacaagacaccaaggcagtccaggaaaggcctggggactcagagcagggacagtgagacaggggcagagaagcaacaaacagcacagccaacaggcctctgggctgaggatcagggtaccctcatggttccccagctgtcggccacagggctactgtaggcctcagtttccccactacactcaggcaccctctcttagagcccagagagaaatcagggtcctaaagtgtggctaaatgcatagaatggaaaaaatacttctaatcacaacaaccaacttttcctagtgctaactatatgtgagccactgttccagatgctttggtgtgttttccttgaatccttgcaataaccccgtaagtcatacattagccccatttgacacagaagacactgagaagaagcttgccaaaggactgcagctgtaagaggcagtgctgggctttgaatgggagcagtctagctccagagctgagcttcttgaggagagcagattgcagggtgggaggtggggtggggtggggtctgagcccatcaaggccccagcatatatcagtgaggtgagagccagccaaggacagggctttagggacaatagcagctgaacaatccaccttgtcatcaatcaaccaaattataaacacacaggactcgcatctgtgggaaagactgtgacctcctaccctcccgcacgtggggaaaacagcttggagaggatcaaaggggcagaggtaccccaggagttattctttagtctgtgtgctgggcaaacaaaactgggagggggcaggaaaagcaggctgcaaccttcatcagaggtaagtcacatgagccaccagccagaggggctgtggctatgccctacggccggcaggcacccaagagggtttcccctcatcgtcaactcaagcaaactgcaggccagaagctgaccttggtttggcatgatgacaaggtgcaagctgggaaagggagggggcatggggccgccacagggccagctctgctaagaatcccattatcttgggggagccatttcccactcgaggggcagaagaagaatcagtgattttctctcttttatttgaactccttgggaatgacagacaagtggaaagagggtttcatataaatacaagaaggcttatagtctgcttcttgaggaggtggggaaaccagagccttccccatctctattttcaatgcttacaggcttcacctaccagcccaccccaccctctcaggcatgtggctagagggaaggcatgaaggggaaaatggagataaaacagagacactccagaagcagtggctcccacaggatctccaggaagccattctcaccccttcccaggattcctcaaaccaaagggttggtccaagggtctgccgagaggctgctggagagctccacctggtaagtgcattaagaggatccctgggccttgctggattccttggagttttcccatccatcctgctgagctgctccagagctttgatcactactacacgaagggtttcctgaatgctttcctgaggacattgttccccactatagagtcatcagggtcaaattcatcatgggctatcctgatccaggtcctacccaggaggaaaatgcagccttctgcccaagccccagtcccctagaaaaataagtcagtagtttcttttggttcatcccattaccagccttggggaaggtaacgctgtagcaaaacacagctgccattagctctaagctgccaggcacctcaaagcacacacctggcggccctgctccctatccttctaagagacctgtccccacacccagccccagtacctgctccatcccagaatcacactccaggacctcttaattcattcaacatttattgacaatgatcatttgtgaggtactctgcaaggggcagaggagtaagaattggtccctgccctcaaggaactcacagtctagggggggatacagacacaccaatcccagtgccttatttaacaacattcttgcagtggaagaatgaacacagggctagagaagcagagcaggaaagacaatctgtgcttaggaaaactgcaggtggccccgcatgctaaatcctatagtgtaactaggagtttactagttaccaggcagccagtgagggaagtaccaaggaggcacgatgtgtagggcacatggaggtctcaaagtttaaatgggcataacatattcaagatgtggcaaaaactaggttctatcatggggaacaatgggagatgaagctaaggaggtgggcaggggcacgatggtgaaagagcttgcatgacatgcaagcgcctttcatttgtttcctgtaggcgaggagccaggaaggtcttcagaaagaaaatgctggcagaaatggggagaattttcaggaagaaaccaaaagcttaggcaaggaatgaagagggccaaaagcagcggaataaggtggaaaacaaaggatggatttcagatgtagaagtggccaccatgggtgggtgatggaatccatgggagggaggaggggcaagatcaaaaacaacctcaacaacaggacagagggcagagactctgccagacactgcactaggtgtcttataaacataaacactatgtcaatgtcaccactctgtgaagtaggcagaattagccccattttacagatgatgttcagaaaatttaaataacttctctagtcacacagctagattacagagttaggcttcaaacccaggtcaacatttcaaccgttatattatatggtaaatctagacagagatgggtggtatgctgttttggataatgatctagaatttagggggaaattctgaactagagatatacatttgagagtcatcgccactggggtgggtgaagccacagatgaggctaagactgtccagcaagaaaacaggcaagaatgaagctggaaaagcactcacattagaacaggagggagcaggggcaggagagctggaaaaggaaactgagatgtggtgatgtcaagggagaatcccatgaagagaatgttgtgtactgcaaaaagcgagaatatgaccagtatataagatctgcaattacaaaggctttgaaccaaaatgccttgaccactgtattggtggaggcagagagcaagcagtaaagagcaacaaagggcacagggatggggttgggagcctcgaggagtttggattaaaaaaagattaccttggccgggcacggtggctcacacctataatcccagcactttgggaggccaaggcgggcagatcacgaggtcaggagatcgagaccatcctggctaacgtggtgaaaccccgtctctactaaaaaagtacaaaaaattagccaggcatggtggcggacgcctgtagtcccagctactcgggaggctgaggcaggagaatggtgtgaacccaggaggcggagcttacagtgagctgagatcctgtcactgcactccagcctgggtgacaaagcgagactccgtctcaaaaaaaaaaaaaaaaaaaaaaaaaaaaaaaattaccttgaagtgttgcagactctgttgcatccacaacccatgaaggaagagggccgggcgagatggttatgcaaattactccagctgcacttagcagcttaggctcagagaaggagaaacggaattgcagcaggggttggaagtgaagaaactgggcagtgagagagggaataagggccctaaggactttggattcttctacatggaaaaggtgcccttgctggggcgctagtaaagatttttttaaatctgaataattagaagggcccattaggcattttttaacaaaaaacaaagccagagtttacttttgtattatgtaaaaaggatctgattaacacataattgatgttaacaagtttaattcaaaaagaataaactgttttttaagtaccagaggcactgctggaacaggatgaaaactgatacaccggttactaattactcttcactcttcaaactgattcccctaaagacttctacttagcaaatactataaaatacgctctgtacaggaaagaaataatagcacatgtatttgtattttattattcagactggctgccatcccaactagataaaggaggttttactgggctgtaatatctagcacttgcatgttttcagagcactctaaactggttgtctcactcttttcacacgatcagcagggaacacgttccccattttgcagggaaaccaaggccagtagaggtgaagcggcataccccaggtcatcactcagatcgcttgcctccaagtccaaggctctttcccctcccaattctcctgatctgtgacctcctgggcattctggccaatctgcttccctctgactttgcagactgcactgatggaactaccactaaggcaggtgtggagcctgcaatctcctgaccagcttgtgcttcttggttcttatgcaagccagttctctctgtgaaatatttctaagcagccctcaaccaccaggtctatgagggtccctgttgtccctcagccaaggctgctctctcccctagatccccacctcaccagggtcacaaggatacacacaactattgcaggaaacataggttcttcctgcaatacaattaaagctgctaacatttactgagtacctactggttgttgtgaggatgaggtaatgtatgtaaagttttagcacagtctgtgacaatgtatataaagttcttagcgtactatgctaagaaccttacataattacctcatcctcacaacaacccaacaaaaattcttacccctattttacaggtgaggatattgaggttcagaagggctaagtgacttgcccaaggtcatccagttaattgttaaggcagtattcataactcgagcctgtcagactctagaatccactttatttttcctctgctacactgccctggctccctaccctacaagtgcttagagatctaaagcaaagtagaaaaggaaaagtgagcaagacggaggggcttttacattttcactgcctggctcccaacccagactctggcaaggctaattccatgatgtttcactcagcggcagtcccaccagcctggagccctggggagctgaccagagtcaaaaggctccctggcaggcttgttctggcagctgcccagccgacttgtgctaacacagcaacaggcacaggaaagagtctagaaagagtggaaaagcaccagacactgaaccgctgcagggagagaagtgattcctgccgtgctcggagaggaccctatactaaagccaccaccatcattgggctgggaagagacgggggtaagcggggagcaaaaagccccaagcacatccactcactcatgtgtttcagtgaactgtgactggaaggccagtcaaaaagagggtcacatgcctccaaggtgaatcagcaagcatggaagaaaaccggtctgcaccttggttcatcccagcaaccctgacctgtctatacccacgtccacataaaccttgctatctaatgtcacccgagcagaggcaagagcacatatactatcttacagccaccgcaacggctgatttcagccagcctgtgggaaagaaagatctagctgagaacactaatagacttgctagaggaagaattcagtgacaaagtgcccttggaaaggaaagaaaagaatttaaaagggggcacaatcaaagtgagactggaagaagggagccacctggattcccaaagatagggctctctcgaccagacaccaagtggaggccaacgggtggtgacagggatattttaaaagatctgaaaatccaaaaatgtccatgggaaatgtgtttgctattatttctgtaggctttccatcctcacatttttcttaggttattaagctgcctttgtacaggatgcccaaaagtgttttgagggaaaccaattctgggatctaatatttgtaacaagttgttagatcgccaaaaaaaaaaaaaaaaaaaaaaccataattataggtgtcatcagaaggaggaggcagtttgagaggtcacaaattggcagccactgggtcaaattaaccccacgggtatgatagcatgcttagaattttgtataatgaattatcaacacttgaaaatcagaaggttacacacaccaaaaaaccctgaatttctagcatctcttcatttttttttttttaccccctctggagctcttagaacatcttttagaaaaattcaaaaatctggtaccactggatgagcagcagattggaaggtgagtcaccactgccccctttcggcaggtctatactttctgccagcgtggtggctcatttgtcacctgacctctgtcagcactagtgtttggtttagcccagggaagtgactgcaggcttggtaatgcccaggactgccatagggtggcagcactggtgtgccgataaggcctgctcatcagccagaacctgcagccagaaccagaaatctccttacttggtagctgacagtctcttcccaagttccatccgatttgttccctgggaagcaacagcagctcatttccgcattcccactaggcctcagggagccttagaagaagccaacgactcaacctgctccctcctctcaggccaccaccaggtcctggaaggcacctccagctggcacctcttcacagctggcccctctaactgttcaggaactccaccctcacccacctgtggacaccatcaggcctcacgagagagaacctaagaagcagggccaatacccactcccttttagaggcagatcaattcatcaaatgctcactactgccctgtgctgactttagttaaacatcagtaggcttcaagaggcaacagcttcttatgcttcttcctgctctctgcttttactcccctcacagccttaccagcaacgtcttcagtggtaagatttagtagaaactcctagagcccttttggaaagacatttggtgttatgcatgagatcctcaaaactgctcatttatcccatttcatccaaaatgacatttactatttttactgtttattccaaaacgcaggaaaagcttcatataagatattcgttgcagtatctaaacgagtgaccaaccagaaacaattcaaatgtccagcaatatggaaattgtccaggataaacttatgtcatactcccacttgatagacaattatgttgctattataaacaactacagccaggcacggtggctcacgcctgtaatcccagcactttaggaggccaaggcaggcagatcacaaggtcagaagtttgagaccagcctgaccaacatggtgaaaccctgtctctactaaaaatacaaaaattagccaggcgtagcggcgcacacctgtaatcccagctactcaggaggctgaggcaggagaatcgcttgaacccaagaggtggaggttgcagtgaaccaagatcgcgccactgcactccagcctgggcaatacagcgagactccatatttaaaacaacaacaacaacaacaacaaaaaaaaactacagactgccaggcacggtgcctcacacctgtaatcccagcactttgggaggccgaggcagatgggatcgcttgaggtcaggagttcgagaccagcctggccaagatggtgaaacccctgtctttactaaaaacacaaaaactagccaggcacgatggcgcacgcctgtaatcccagctacttaggaagctgaggtaggagaatcgcttgaacccaggaggcagaagttgcagtcagccaagatcacgccactgcactccagcccgggtgacagaatgagagtccatctccaaaaaaaaagaaaaaagaaactacaggccaaggccggaggatcacttgagcccaggagtttgagactagcctgggcaacatagtgagacctggttctacaaaaaaataaaaaaattagctgggcatggtggcatactcctgtagtcccatctacttgaggagctgaagtgagaggatcacttgagcccaggaggtcaaggttgcactgagccgtaattgtactgcactccagcctgtgtgacagagtgagaccctgtctccaaaaaaccaattatgatgaccatgtaaaatgggaaaatgataatagtgagaaaagtatataaaattaaatgtacagtaatgataactatctctaaaacctatgcagagaattagtaaaagacaacaaaatgttaacggttgttattaacgagctgggaacatgggtgacctttttaaaatccctaccaaattttcttgaatgtgcgtatatacttttatagggaaaggcgtctatgtgtgtgtatgtgaggtctacctccatttagacttgaaggtgctgcagccaattgtaataatggtaaaaaggttcctgggaatctgtgcctccagggttcagtgcaaccgcactagtaaagcagtttccagggctccttggcaccctttaataccaatgttatcctgctctaaaatgcctgtacttgcctaactcctaagaagacccccaaataccacctggatgataagattcgatcattatggttctcagataccactttaatcaggtttttcactatacagtgatgggggtagaagatggtgactgttttcaagcaaattcacgaggcacatgttcgtccctgccccaaagtgaacagtctgggcttcccagaacagaaaagtgctttccttcctgggggaatcccattcctgagctgacaagacagatttcagtaagaatgagcacaaaggatagggcaaaatagtgaagggagccaggtgcatatttgaattctttccagtgcagactggaactagacatgcaggtatccctcctaaaggcaacgcccaaatcccagccattcccactagaggccaaaccgcctgcccacagagattgacagccaatgttcatctcataactctcctcccagcagtgcaccagtaaactcagatgcctgagtgcttgtggccaccacacaacagatgcggccttcctcttcactggcccctcggctgctgctgggtctgcctggccatcaaggagcagccagtatttgtgtggctgtgtggtgtgggaagggccagaataagcaacaaagccaattagatgtgggttctggggctctgtcaacatggtagcaggacaagtcaccacccacagtaggaccatagggccctgtgtcctccattaattcttctctgggcggtttctgttcagcacagctttcggggcaaattctagcttgtccttaaggctcaccacctgcgtgtggtccttgcctagaagctcatccagcttgcgatcctcccggcgctctgagatgctcttttcctcctccacgggctgggggtcctttcccctgatgaaccattccaggtggtaacccacagccccgaccacgaaggcaacagggaatgtgacataaggagcataggtacgaaccacggtccaaaacacaggccacatgacatctgcggaaaagcacaaggcagcattagagaacccagcatcatctcccaccaaataagagcaacccactagagctctccacttaccaggcagcctggcacaatttttttttttttttgagacggagtcttgctctgtcgcccaggctggagtgcagtggcacgatctcagctcaccgcaccctccacctcccaggttcaagcaattatctgcctcagcctcccaagtagctgggattacagctaatttctgtatttttttagtagagacagggtttcaccatgttggtcaggctggtcttgaactcctgacctcgtgattcacccacctcagcctcccaaagtgctggaattacaggcgtgagccaccacacctggccagcctggcacaatttactgagcacccacccccgtgcagagcaatgcgagaggtggatccctgaaataatctaggaaatttcaaaagattccattgttagggaagaaggaaggatctccattttacggaccgtactctttgacaagtgtgcaccaatatatgacaatgttccccacaaggggacctctgagccttacctaatagagcttcaagcctattgttgaccccaggacctagtctgccaacatttcaagaagggaaaaagatgcctttctctgctctatgaaatttctccatgagcacagccggccaccttttccccatgaaacacaatctacgatgaatctcctggtttcacaatatgaaaagtcgttccttttcctcatgtaaagcataaggagcatatttaaacagtcaaatacataatgcattacctaattattctggattttaggtaaatagataatggttttatcctgttctgaacctggcttttctaacaatggaacaaacctatactttacaaatctgctgactaaaccattttcaaaatatcctatcttggctaaagacggtggctcacacctgtaattccagaactttgggaggcttgtaatccccattactcaggaggctgaggcaggagaatcacttgaacctgggaggcggaggttgcagtgagctaagatcaagccactgcactccagcctgggcggcagaacgaaactccgtctcaagaaaaaaaaaaaaatcctatcttcaaccaaacccataccttcatatttacataaaaagctcctgaaaatatcacaaatcattatacatactctggataccgcagaacctgaagattttctgtgaaaaatcactgtacaagcccggggggtggggtggggtggggtggggcggggagcggagtggaatggcctcagggcctcctgaattgaagtagggcaataccaaagtaatgtaaaaacacacaaattggatcactctaatggccaattccatctcaaatgattattaccattatcaattatcaaagatcattcacagttataataacacagctaccatttattgagcacttacatgccaggccttgggctaggtgcttcatatacactcactctcttaatcctcatgtccaccacgtgaggtagatacataacccactatcagagggttaagagacttgcccaaaagtatccactaaaagatctttctgtttatgcccctgtaggtatttctccaacactactatctctgatctaaagtgaacaatcgaaacctcaccaaggataagatgattctccccctctctctttggttccaattctctttgaaggaatcccaatgttctctagacgtaacactataaggcagcggtccccaatctatatttggcaccagggaccagtttcgtggaagacaatttttccacagatgggggttggagagggatggtttcgggatgaaactgttccagctcagatcatcaggcattagattctcataaggggcacacaacgtagatccctcacatgcgcagttcacaatagagtttgcactcctgtgagaatctaatgccgctgctgatctatcagaaggtggagctcaggcggtaatgcttgccagcttgcccaccgctcacctcctgctgtgcagcccagtttctaatgggctgaagaccaccactggtctgtggcccagggggttaaggacccctgcaataaggcagcatcatgaaatttaaaaaaaaaaaaaaaattgcagcatctccaagactcccccgcttattgtctcagcaccaggcactatgatgacaatttacacactaatcatcatttgatcctcataacacctctatgatgtaggaattattagcccagactcttgtgaaggccacaaaggctcacagacattatgttaacttatccaagatcactagaagtgatagagccactgattttgaacccaggcctctccaatttcaaagcctacactctttctagtgggaagaacacactgcagaggtatacggtttctgtccaaaccctggacttagggagagcttcctacagttttttcccatcagcctggcatttcattacctagaagagctttccttttcccaaactctgagattgtactcagggatttatgaaattcagagacatagtaatagttaaaagaggcacctctgaagaatcccaaacctaatacttctccattttacttccacctttaaagcaagtcctctgtataagtaaatgcttccctaaatagcaactgtccgttcagatttccaaacctgtcttaaaacatatcgcgcatgagttcacaactatctctcacatgcagcataaagtctctcgctaccgtcctgctcacattctaatcattcccaaataagtcaattcattcctttattcgacacttataaccacttactctgtgtcaggcacgatgctggcttaccctgtctgcgtttctcaagacactttaagctccaaaaggctaagaaccgtgtctgtctggcccaattatgccctatccatccaggcacctctcctaccctgcctggcagagtgcccaaaaaaggtctgctgaacgaatgaatgacagcccaaactccctagtgtaaaatcacaacatcctccacccactctcccccaaaaggtggcaggagcataacagatgcctttgctgattacaaaaacctaaagactccatcatagtcgtccccaggcagggtatcacaatgaaagaggcaaaagtgtctgaaaaacactgtgacgcatatttccagcccggcatggaggacgtctgccaaaagcatccggtaaaggtcaactgggctgctgggaaacctgccccagtgcgagggcccggaggcccaacgaggccagaagccgtagtcccaaattcaagaactactaacaaggacacaggaggcctgagaaggcggaagaattagccctgacagtcactagagcgcagtccaggaatgggagcgcaagtaaggcgaaggtccatccaaatggctacccttctcccttctgtgagtctcccggtcccctgtccctagcccacctcattcatggcctcatcaacgtccgtcctcattgaggtgccgagaagccctgtctgcggagggctacctgggctcccagacttggcaccagaacacccgccagagaggggagctggcagatctggccgggaccggggtggaccctagcgatcactcctcccgtaactcagaggttactggcctgggctgacccgacctgctcgccgggaccgcgcgctcacctgcggcccagcccacactccccagtgcggcccccgctctccgcccgctcgccgggagcacggaagtcgccgcacccagcggcccgcgggaccttgccctgtgaccctgcccactggccgccggctctctcggagcgcagggattggctgaacttcagccaaaggacggaaggaagctaggcgtccgcaactgggccccactgcgctgaaatggacgtcgcgccctctgttggccgggaggtttctcagtgatgtcgccacgtgttttctgcgtggaaaaagtgaaagatcatccagtcatttttttcaactgatgtttattaggcgtcttctaagacctaggtctgggcacgcaaaaacaaaagacatgatccctgacctcaagaagctcttcttagaagagtatattttagtgctttaagacctcttgggatccgggctagctttctagtgaccttgggaacattattaacctgtctgagcctcccttccccttctgtgtagaggtaataacacccatttcgcaaggatggtgtgagggttggaagagataatatttgtaaagtactgtggcaggcacacagccagcagggaaataaatgtggctattgttagtgtaaaaataattcaaatatagtaaaacctaagtcttacatgacctcttgggtacaagtattcacttcctcctctgtgtccccactgtaccctatacagacatcaattttatcatatacagaaaagtcccaaagctcaagcttgttaatgctcccacaaggcccttcccaccctcatcccactaatctcagcctgcatatttattttgctcgcacatactaaacccggcagaccacactgtttcacacctcagtgccttattgatgctttttcatctaccttcccaccttttttgttgttgttgttcaatttcactcttgttgcctgggctggagtgcaatggcgtgatctcggctcaccgcaacctccgcctcccaggttcaagtgattcccctgcctcagcctcctgagtagctgggatcacaggcatgcaccaccacgcccggctaattttgtatttttaatagagaaggggtttctccatgttggggaagctggtctcgaactcccgacctcaggtgatctgcccgcatcggcctcccaaagtgctgggattacaggcgtgagccactgcgcctggccgcttttttttttttttttaacaggactctcgctctgttgcccaggctagagtgcagtggcacaatcatagctcactgcagcctcaacctcctgggctcaagtgatcctcccacttcagccttccgagtagctgggaccacagatgcacaccaccaggcctggctaatttttgtactttttgtagagactgggtttcaccatgttgctagggctggtctcgaactcctgagctcaagcaatccgcccgcctcagcctcccaaagtgctgggattacaggcatgagccaccgtgcctggccatgtagtgcccttcccacctttctttactatgccagattgtgctctggcacaattttcaagcttaagggtcacctccagaggaagcctcatacatagactgcttatcacattagacacccttcctctattatctcaaacagctcaaagctaagctctggcagtgaagatggagaaaagggaacagtattgtaggggccaaggttcactgaaaatcaactgacaaaaggcagattaataggagaaaagacatacaaaattttattttaacgtgcatagcacggggcggggaggcgagggggtgggaagggaagggtcacaggagaatgattacccaataacccaatggggtacagaagcgtatacactctttttcataggggaaggggagagatggagaatatagacaattcttctgagggcagcaagtgattcttagggcgaaaaaatggacagaaattaacttgtaaatgattctctttagaatttgaatgagcccgagaaacaggcatcatcttgtgaaaaatccatccaggcgtagttgccttcctcagtcttcttttctgagctagatgagatttcggagaggggaggaaggcaattttgtttcttttggaaagacgttttctcgatcagattaggaaattctagagagagtgcctccctatacttgggagagaaggttagagggaccttgattctgaggcagcttcgaaggcctctcagcatgtcaaagcgccagtctttggggtatcgctttctgagccccaacagtacaaataaatatttaggagaccgttgttagcagaacctgctcactaactgaatatgtggagaggagaagggaacagaactgtccagagtaactggcatttggtcagccaatcatgtgctaggcaatggggatgcaaaaatgactgggaccaacctgcctccagagttctctgactaaagaaacagatgggtctacaaaatgtcaatagaatgtaagaaatgtgatgacagaagtatacacacgcagcacagaggaggatcttcagcccagccaggaagattcagggaaggctccctagaggaaccaagccttgagctgagtcttgagtcatggctagcagttccctcaagcagaattgctgaggggctcaggagcatagactgagaaatcagatagccatgggttcaaatcctgactcttgtctgcttatctcagaaaagctatttacactctttgtttttaaaaaaagacaataatagtacccactcctagggttgctatgagtattaaatcacctaaatgtgtataaagtgcttggcatagtagtttgcaccttctcagtgctcagtaaatggttattgacatgttaagtatttcccaactgtattgctccttctgtaatgtcctatgtccattcgtggcattactcattcattaagccagaaatctgagtgacaccttcaaggcgtcccatctttacattattctccagatccagcttactgcacttatgcctcctaaatgtctctcaaagtcaacatcattatctcttacctggaccactttagcagctccctgaatggtctccctgctgtcttgttgccccatccagtccatttcctttcttttggccgtagtttcatctttcaaataaaactatgaggtttccatcttagcctcccacccccaactctatgggtcccttctggccgtatctcctccacgccctccacagccaccataacctgtcaccctctccagcctatgctttcattcccaacacacatgtgcttccatggctttgcccaggttggtcccttggccagaaatgaatttctcccttctcttccttgactacaaaatgctaattcatcctgcaagatccaactcacaaggcagaaggctttcccagactgcctgtgctatggttgtaccctccaaaacttacactgaaatttgtcattgtattaagaggtgggacctttaagaggttattaggccatgagggctgcactctcatgggtggattgacacccttataaaagggcaagttcaactccctcttgccctctcttgccctctcacctgccatgggatgacacagcaagaaggccctcacaagttgccagccccttgacactgaattccccagcacccagaactgtgagccaataaatacctgttcattataagttatccagtctgtggtattgttatagcagcacaaaatggactaaaacaccctggttgctagaggctctctcctctcaatcccttggcccctctgggagaacaggtttccctttgcaccataactttctgtttatatgctggccatggccagactgtaagcaactcaagcaaaaggactggacctaatctttcactatctatggggctcagcataactacctaggccacaagaaccaaaggagactcatccacaccagacatggaaaactctatgaataaagtcatagacccataaaatgctgtataaatgtaaaggttaaactcagactcagccacttcctggcttcatggtttgaggtaagctgtttaaacctctccaagcccatttcctcatctgtaaatgggggtgaaaacaatatctgttttacagcattgctctgagttcaaacctcacccatgcccccaattttagagatgataaaacaacctcagagaggtaaactgacccagcccttctactggagacctttggacagtcatccaatttaagtcttcccaaagctggctgctcagaatcttgtgaagcacttgttaaaaccttattcgagggcagagtctattcactaagtcttggaccaggcccaggagtctgtatgggatcacctccaaacggactgcttttgggaattcagatcacattagagttctcctcaccttccaggctcatgtgtgtacgtggaccatctcttgcttttccaaagttgtctaccaaaccagtctataaaacgttcatgccactcctctgttcaaaacccttctatggctccctacagcccacaagacccaggccacctgcctcaatgagacccaaacactgatataatcaagtctctgtgctcccaatgtctcttcctcttccaagcctttgcacagctgttccctgatcttggaacattcttcccagccctggccctccttcagcagctaatctctaatcatctttctggcacttactcctgtattttaactgcttgcttatttgtctgtttttcccatatgaccataagttccattaagggtagaaactacatcttgttcagggctattcctgtggcgcccaaaagtgataaatgtctgctggataaatgaatgagaagaattagctgacccagtgtggcccagaaaagcagccaatcctgaaggcttttcctcctgcctggaggtgacacaccaacccaaaggactgctcaaggagtggaaaggggctttctgggtggagactgccatcagccctctctggtctaagaagcctgcaaagctaaaagctcatgatttggcattagacctgggtccaccacatttagtcctgtgacctcagacaggtcttgtaacctgccctgagctttggctttctcttctattgtaaggaccagccacattcatgtaaagcactcaccccttgcctgacccacactgaccactcaataaagccatcgatactaggttctggttgccatttagcttcccaggagagctctgttctttgtacttcctcttcccccaccccagcctccaccaaggtggccacccataggaggcatcagaaaatgcggcaggactgaagattttctgctgctgatcaggaatgactggagcagaaggaacattgtgcccctaggggaagggaaaccaattatttgtcaatacctaacaataaccacactcccggtttattgagcacatgctgcgtgcccggcgagctccggacttccctctctgggggaaccctgcggactgggaggcagaacgggatacaccgaaataggaagaacggagagcttggcaccctccccctcttcaccccacctgggcccctccaggagggtccaggcccttactgtgggcatcagggggccgaatctcctttccaccagctggcccatccctggaaggagctcaggcaacccctgctatctccaaaccaagagagtgggctcccggtcccttctcccttcacccccgtcctcccacacacgggacggaggtggcctcttctggagagagcagctggctcgagtgcagttctgccgttttatttttcctgggatattcaaggggatgtgggaacagccacaggtgtggtgaggggaagcccccatctcccctccccagccgctgggaaaggggagaggcccaggcgccctggtcctgggttggtccagccactgtggtccctgggcccagtgggcagagggctgaggatggagcccctgggagggtggggcgggctcctaggcagggttcgggattcttcataaaaagccacgaagcttgatccccacgaagcccagccccgcggggtgggggagggggggacgcagagcccagatgagggacccggcccggcctggcccgtgggggaaagaatggcagagatggtgcccatggggaggaggtggggacaaagcgtcggaccaggtgggcaggggatccaggtgaggggcgcagggcggagaggcacggccccctgcccagcccgggcgccttcgcgtgggatcaggaaggtaaaaaacccacgagagtgtgacgggcccgggggccggggcgtccggtgccggtggggcgggcgcacggggcggcccgcgttcacagtgacctcgacgctgggtgtacagtacgggtggagaaccgcgggcccgggccgggctgggcgggccggaccggtcacagcctggtctgggcctcggggatgtagatctcgatgctgtcggcgctctcggtggccgagctgtggcggaaggaagcggcgcgcttggccgccaggagccgcttgcgcgcttcctgccgctgccggtccacggagtccagggagcgctccttcaccggcacgccccggccccgcaggggcttctttggtatcggcggagggaccttcttctcctcctgcggggcagagggcgtcgctgagctggggcgccgaaccatcccaacacccaggtgtccgcccccgcacccccgcgcccagagtgctgacgaccgcgtggctccgaacgcgatggcgctcagaatccgccacggatcccgtgacctgaagccccaggtgctcctgttccgacaaggtcaaatccccacattttccaccaaagcgcggcgcgttcgagcgccccctggtggcgccgttctcaacagctcgcagcagagccggtttttcactccgggtcccgacccgaaggagggagttcccgacccaggctccgcaatgagggtgcacataccaggcctctggccctcatcgcagacaaggtccagggacctggcggctgaggggaccctcaaggctctgccgtcgatgcctaggcccgaactgaggacagtctgtccttccgtaaggtctacttttgctctctccagctgcagccgccgccacccccccaaccccgctcccccgcgctgaggaagccttggggttctggcagctcaagcagtgatgagcactggggccaagcagacggcagtggccacgagcgtggtcactctggaaggggatggtcacctatcacctgtccaaggctgcccttgctgcccatggatcccttcccctgcccccttgttcgtcccaccctccacctctctggggaggggaatttcccagagtctggcctctttgcctgaaggcaccccagccccaccttaggctccaggagtttccagctgttggccttgagttgctgtagctccaggaacttgagggtcacatcctcgatggagagctgtaggaggtcccagaaacccgccaggtcctggaaggtgggcacagggaacgcagtgggatcctgcaacagaggaagatggagggaaagtgattggtcaaggaggtctgagccccagccaggacaagagaaagtcctatccacccttactgccaggaagctcagcctgggagagtgggtgggggctgggagacagggggacaagagcgagcccaggactccccttcttgtgcacaaacacctggtcctacctccaggcacaagactcacagctaccccagaaggcatgcaggcctggtctcacctctggtacacactcactctgggtcacctgcctgtctcacctccagcacacacacactctgggtcacatgtatctggtaggatctactactatgggcactcaccatgctttgctgacacagccggaagaactgctgaaccttctgggacaggagaagttgtgtgctgcccacagcactgcggatcttctccaggactagaaagcagaaggaaattcagggagggaaatgatgcatctccttccccagcctccacgaagtctgccctgaatgacgctgacccctcggttgcttggcactgtgtatccatcagtctcctccagccccagccccatcccatcctcaagttcctaacaagttctcgctccactacaccaagactgtatcctcagacactgatgttccctccttcatacagcctacatttcttgagtgctcatccttctttatcctttctccctcccgtatcagagaacagacggaaaccagccccagcctagccctatagccttggccagggcattagctcaatgaccacccactggctaagctttgttcatcactccccagtgcatgcaagactccttggctctttaagaatgaccaagtaatttcatgtacataacacatcttcatagccactgtcccctcaactcagagattctggggtaagactgtgtctcccagtggatctgacttacaggaagggccatgctctccctcgggccagggccacatctccctggctgaatctccctcttctgtgcctcagacaggatctgacattgtgaactgcctccctctctgtaatcttggtcgcaccacctggatccccacaccagtccagatctgaacggagttcccttagtccccataaacttggtgatttggactagcagccatccatagaaggcccagccctttggcctgcagtgtctgcagtcccagccctggcctctaaagctgcaccatgtgcaccctgctccctttcaagagctcccagcatgtcttgctgccgatgttgacccgccacgctccagtgcagaagaccagtgaggcaccaaccgaaggggcctcctgttacactgcagccccagccacccccatcagggtctcctgagcacacacgaggccatggtccccagagtccccttgttccgatgccgtgactcactctcctcgggtagctcatagtcctccgcctcacgctccatctgctggcaccagtgctccagcttctccacctctgcccgcagcatcttgatgaaccactcgccgtcgcgtgggcagggggatgcgcggcctgagtcggggaggctacgtgaaccgcgctctatccaggagtcacggcggccggccccagggccgggggtgggggcgggggcagggccgggcgacccatcggtggccggcggctcgtacggcagtgggtagccctcgcggtaggcccactggccctgcgtgtggaccgtgcggaagactgagtaggtgggggcccggggcccaggctggggctcagaggcgtgcctctggaaggagcgtccaaactgcagggccttgtcttctgtggccaccgtggccaggcctgccaggccctccagctccaggtctgcctgcacgccagccgtcacactattggagcgcttgaaccttgctcgcctggggagaggggtggctgtcatcccccattgcccaggctcatgccagctctcacccccaccccaagcaaaaaaaaggaagggaatgagaaagggaacctacaaagtgatggacattaacctatgcactttaaatatattggtccttgcaacagctacgtacataatatacctacctattgcactgcctctagataggggtgatatccaagctatttagcaaccagttcagtccatggacagagcagatgctggcatataccaggcagagcaggcacagaccaaaatgctgcagcagtgccctggagaggctagattgtggggtgggctagaggggtcagggaggagccagggtggtggctctttaccagtgaaggcagaagatatttcaatttttttttttttttttttttttttggagatggagttttgctcttgttgcccaggctggagtgcaatggcgcgatctcggctcaccgcaacctccgcctcccgggttcaagcgattctcctgcttcagcctcccgagtaactgggattacaggcatgcgccttttgtctctttttggaagagacagggtttctccatgttggtcaggctggtctcgaactcccgacctcaggttatccacccgccttggcctcccaacgtgctggg

SEQ ID NO: 1228 - DNA, 61901 bp, Homo sapiens
cagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgagctggggatgagggattttttatttttatttatttttattttttggtgtgtgtgtgtgtgtgtgtgtgtgtgtgtgtgcgcgcgcgcgcgcgccaggtttccccgagcagaggctgagcccggccccctgggctgcccgccaaggtggccaagttgcccggcccctccagctggtctggccaggtccctggggagctggtgtgatgggttgggtggtagagggaggctctcagattctctgcttccggggcagggtggaagccagcacaacccctgtcaaggctccttacagcctcttcagcttgaggagctggcctgtgggagtcacttccccaaggacagggcactggccaggcagagggtagagatgggtggctcagcgcctccaagccattcctggagctttgactgcccggagcccaggctcatgagaaacagccccttccccatacctggaagactgggacccctccttggggtggtgaggaggcggggctctccgcaggcccctcccccatcggcaagagtgcccacagcccctccgctgcctggggtcccactgaggccaggggcggggagcgccaccttggacacttccgtgcttgccctgcagggaccgctccagggccccggagcacagcgccccctggagaggctgtgcccggacctgaggcgccggcgtgtcaggtaaaggggtcccccttcccgccagttccctccacagccaaggaaggggcggggaagggccccggccctcgctgcccaaggggcgcctccagccttgcctgggtgcggccctgggggccgcggggatctgtgggcctcaggggtctggggcactccattcttggggaaggtaggggaggggagacggctccagggtctctggagaagttgtggggtatcctgatctcagacctgagcgcttcgacctattatttgtggggaatggggcgctggattctgtattttagacgatggtgagttaggcccggggaaaacagggtgagcaagttcccaggggatgacctgtccaaggggcagctcccaacaacaggacagagaccagctaagaggggggatacaaaagagacggacacaggggcagagcaaggccctttaaggcagtgagcgatgggacgcgcccgtttggggacccgaagtgcagggcggtgagagaaccaggttgcacagcagtttcttcctggtccaccagcaggcttccctgggccatgtctgggaggggcagacatgtgggggctcttagctcccctaccatagggcagaagtaaggttatgaattagggggtggggacagaagcctctgggaagaggggacctcgggattttagcagcaagactcccagaggcaatttggcctggaggcagagggatggccactgtgacctaggagcccacctgtgagtctgagattctctatgctggaagatcccagaatggaagactactaggcaaatcaggagggaccagggcccttcagagggtcccgaatcttcccatggggaagaaatgggaagctgaccctggaacccggcactggccctactcaaccaattccttttgtggtaaatgggcagggtctgcctcctgcagcttccccctggagtgagtgcagaggctgtatccctaggaaggagtatcttacaccaggcctgcccactgttctcatcgcaagctgcaggctgctgccccaagtgtacagatgaatccgagttctaacaagcgaaaaccaaacagagtaacctttgaaccatcgacattacaaatctcttggaagtccagcttaccgggtgagcagttggttctgtctctcaattaactgtgggtgctcagaagtggtggtgattgcacaagccctcgcttgaggtgtacctaatgggcacacatctgcccacttctggctacccctgtcacagctctagtctctgcatgcctgtgctttttcaggcctgcctccctgagaagcctggagctgagccaggaacaagacattgcctgagactttcagtgacacctcctctagctgacagctgttcaggagagccagaacgctctctctctctctctctctctctctctctctctctctctatatatatatatatatatatatatatatataatttttttttcttttgagacatggtcgcattctgtcacccaggctagaacgcagtggcaccatcatacctctctgcagaggtatgacctgggctcaagcagtcctcccacctcagcctcccaagtagctgggagtacaggtgcgtgccaccatgtccagctaatttttggttatttgtagagatgaggtctcactatgttgcccaggctgttctcgaactcctgggcttaagtgattctcctactttggcctaccaaagtgctaggattacaggcatgagccactgcacccaggcagagaaatctttagataacatctacatgccaacaattcccaaattggtatctgcagtccagatctgcagttctggaattccaggctcttacatccgactgcctattgatatctccactttgatgcctagtagacatctcaaaattaatatattccaaactgaactcttaactttattcccaactgcaaatttgttctgttccccacatcagttaatgggaactcaatctttccagtgtctcaaggccaaaattcttgacttctctctctcatactcacatctagccatcaactattcctattggttctaccctcaacatggatacagaatctgatcatttgcatctaaccacctcccttggtgtgaaccaccgtctcacctctgtattattgtcataacctcccagttggtctcttgcttctgcccacaccccatgccattctccacctctactcctgatctattctcagctgaacagccagagtgctgttgttaatcaaagtcagaccacttttattcaaaacctgcccagggctcctgtccccagagccaattgtctttacaataagctacgagtccctcatgatctgccccattactgctttaccttcacctcccaccactcttccctgctcctcccattccagacacccaggcttccttgctgttccttgagctttccaggcacgatcctgcctctgggccttcacacttgctgttgccttggcttagaatgctttcttaccagatatataaatggcttgccattcacgttcttcaagcccacttaaattcaatgagattttctttgacctctgtgtatatacaaacccaaatgggcaaatacaaaataaaaattcttttagaagggtagttcctatgaaggaactccctggtgtgtaagaagctctgtgacagcaaagattattgtctcttttgttccctgatgtgtctaggagagtccttttacatagtaggtgctcaataaatgtatgctaaagaatgcactcattgatttcctactatatgccaggaagcattctaattttttttcacatattaatttatttaaatccacaacaataatagatactgtgatgatcatccccaggttaagatgtcagaactgaagcttgggggattttagtttgctcaaggtcacttcttacatgtattaagactcattgttcatttaatcctcaaataataacagatagtatcatcttccctgtcatacagatggggaaggtaaagttgacagagtttaatttgctggagatcacagagctgatgaagcagaggagctgaacttggaactcatgcagtttggtgccagggtcattgtgtgcagctcccgtgctttgggtccaagtcctattctgagaggcttttcttgcagggcagtgtgagagggcagcagcaacttgaactcaggcctgtgtcccatgctgctttggagcccagtggtgtcaccagctccttcctcttgctttaccttctcccgacttcacttggggcaaacaggctgtattcctggcctcaaccctcaggctcagagaggcatgccctgaaggctgtgccagtctagttggcaaagaagcctcccaggctgacttggggtttcaagtccattcgcaatcaaaactttcaaagtcagtctaggacagccctagaaatttgtggccactgggagtgacttaaaggtctcctcccaattgtttttccatcccgggccattgggccatacctgatgcagaaagtcttttttttcttttctttctttctttcttttttttttggagatggagtctcactctgttgcccaggctggagtgcagtagtgcgatcttggctcactgcaacctctgcttcctgggttcaagcgattctcctgttctcctgcctcagcctcctgagtagctaggactacaggtgcatgccaccacactcggctaattttttatttttagtagagatggggtttaaccatgttggccaggctggtctcgaactcctgaccttgggtgatccacccacctcggcctcccaaagtgctgggattacaggcatgagccactgcacccggctgaaaatctcttatctaatccccacatgatggcctttccactttggcttccattggcctagagaagctggttctggggaccctggtagcttctgggccttcttggtgggcaggaagggagggggaggatgactctggcttcctgttccatctggtggaatcagctaaactcccccaactacatcccttttcaggattgcgccaatcagaaagagaagcctatgagttcatagtggactttctagaagaagaacatatggtaagaaagttctctggacctttgtgtgaactgaggcggaaagtagaaaaaaataagagggcttatgcctccttgggttttgagtaccagccctggcttggaagccaccagatactcagcccattgttgcctcgtgactgggcagatctttggtggctaggccactggacagggtgtctagggcttagatcttgcagttcccttcctgtaggaaggatctttgtcagagatccttagccccactgtcctccagagccctacacaggtggccagacattggtgagcagcagtcctggggacagggacattgcactgagaaaatcaagtgagcaatccatcctttggcctagttgatgggaatctgggctgggtgtgaggagcaggggtggggtgtaggtctcaggtgctgcctgtgggcagagcctaagggctgaagcccagcttatgggcagcaatctgtgtattgtgtcctagtctgagttcaccaagctgaagttcctgagagctgtggaaaccttgagtagtgctgtgcatggccaagcagacggcaatatggacgattactatcccaaagccatcctggccaagaaaattgaggtgagaaagacccaagctcttctgggagttggtcattcagggatgaggatgacaagtcccggacctgagggctggcatctctctctgaggggggttcttgttttttttgttgttgttgtttgtttgtttcctggcctttctagatactaattcttgaagaatccactgagattttgatgggcaacatgcgtcagcaagccatgctctgcatcgtggcgctgaggtgcctttcctgctcttaccccctcagagcgcctgggtctcttgtgctcagaacatttgggttgggaggaagggcaaggtttggggacttaaattttggcctgtgggtggcatagcccccgtgtctgccactttatctgcctgcatccttgggtggagggggtgttctccaattgtacttttggaagcctattaagacgtccagtgagggaagcttccctagcaacccaggccctccttccctggaggagaggctattagaaagtgtttgggggctcagatccccactgtttcctgcatctcagaaacagcagcagagcacattctcccagagggtcccagtctctcccagggaccccaaagccgcttgtcattccctgcctctccctgcagtcaggtgaatccaccattccacttgtcccagaaactggatctggtaaatgtgggcgtctccagcctgttctctctgccgcctatcgtgcccagcctgtaccgaagagacaatgcgagtctctacctccaggtaatccccacctcttcatggagagctccacggggaggttttgtctttggagtcacctcttgccctttaactctccctcctttctcctgctctgacctctctgcagagctcttggccccatgttcctggggctgctaagaagcactccagctgtcgtaccctcacctgtctttccagggattggcccatgctcccaccctatccatgtccttgttcactaaggctcacagcagcctcagtcacgggaggagacagtctgataataaaacccacagatactgtggagcaactgaccagtagactgccaaatcttcccaggggcctctaattttttatttcatttttaatttttaaattttgagacggggtctcactctgttgcccaggctggagtatagtggtgcaatcatagctcactgcagcctcaacctccggggctcaagctatcttcccacctcagcctttgtagttttaaaaatagatgtgtcctggacctagcggaatgaatctaatgcggagagtcccacgggatctggctttcttggggagaatggcccaatgcctacatttcaccaatgggctcacaatttgggctggacctggtccagtcttcattgagaccaagaaaagtcagcaccaaggaagatcagagtgtggctggccatgagagagagactgccgggggtggcagagccaggctggccccacttccttcctccagaggtaggggacaaggagatggagtgcccccagggagccgagctggcactgtggcagtctgttctggacactccctgtctcttcacttgtcagagggtccaggccttagacaacatgttgcaggctcttgtgatggacaggatgaaccctaacatgctcatactacaaaacttcctggaggtaagtggctgtggaaatcaaggaaactgaaagtccatattaattctagtatgtttgggaggaaaggaaaagaatatcaggatagcctaggtgtcattctagtccaaagaccatcggttctcaagcctcagcatgcataaacatcacttgaagacaaatttctgtatctcccacgaaataccattttgaggatcacagttttggaaacatagcccactaagctgaggacccatttctgcccaggacttggacatattggggcttcgatggtaataacatttatatctgtgccagactttaatcttcaaagtattttccccttttgcagcatctgccattgctctgtgataaagaagacctcagtgcttaaccacaggctactcttatatcccttaatgtaatccccaccagagactcattgtacttctttaactgtctttagagcttcagagcgtttcaaatattcttagttatgacaaattgttatctcctgagggtagttgagttggggaaacagccaagaatcacttgaaaccgactttcatgaacacgatggtaatcaattacggtaataaaattttgcataaagcattaggtgtgactacaaagaaggagacaagattgcccaggcatcttataaaaagaccttgacaaggccaggtgcagtggctcacgcctgtaatcccagcactttgggaggccgaggcgggtggatcacttgaggtcaggtgtttgtgaccagcctggccaacatggtgaaaccccgtctctactaaaaatacaaaaaaattagctgggcgtggtggtgggcacctgtaatcccagctactcgggaggctgaggcaggagaatctcttgaacccaggaagaggaggttgcagtgagctgagatcaggccattgcactccagcctgggcaacaagagtgaaactccgtctcaaaaaaaaccccccaaaaacccaaaaagaccttgacaagggctttagctagagggaaatttgtccacatttggatgagtgacatagttcttttggaatgtatcatctctggtatgtttgttgagaaggatttttgtgctttttaggcaaccttgctataaatgtaagaacaaatgttctgttgttcttggagtctgtgggggaacagagatgcaaaactttggtcctggtcagggtacagtcttcaagagatccattactggggttctcattatccaaagataaatgatgccctgcaaaattaccacctgaaacaggttccaacattttgtataaaatagtggaggaatcaatttatcttgataaataaaattaaaagtataaaaataagttatttttatgcgaacaaaatgtatttttgctactttgaggtaattctcagtcaagtgtgtatatattttagacatatttttcctacaaaatgacatgatagcataatacaacatcatttatttcacatttgactttgcagagctggatcagaaaggtcgaatttgagggctatatggttttcttaagggccctcctttttcttttgtcttctttttttccgttttaaaattaaggtataatttacatatagtataattcagcttttagtgtgtagatctgtgggttttgacaaatgcatgcagtcctgtaactacagccacaattaagctatagaacagttctatcacccccccaattcccccatgactctatggtcaaccccttccccattccccatccctggcaatggctgatttgtttcctgtccctatagttttgccttttctaaaatgtcatctaggtgcagtggttcatgcctatagtcccagcacttcaggagggcgaggtagggggatcacctaagccaaggagtttgagaccagcctgggcaacatatgagaccccatctctactaaaaataaaagaaatatattagctgggcatgtggtgtgtgcctgttgtctcagctacttgggaggctgtggtgaggggatcgcctgaagcctagaggttgaggctgcagtgagctgtgatcatgctaccgcactccagactgggcaacaaagctagaccctgtctcgaaaataattaattcattaattaagataattaaaaatgttatctaaggctgagtactccagcctggggaacaaagtgagaccctatctcaaaactaaataaataaaataattaaaatgttatctaaggctgagtacagtggctcatgcctgtaattccagcactttgggaggatcacttgagcccaggagatcaagaccagcctgggcaacagtgagacccccatctctacaaataataaaaaaattatccaggcgtggtggtatgtacctgtggtcccagctacttgggaggctgaggtgggaagatcacctgagcccaggaggtcgaggctgcagtaagctgtgacagtgccactgcactccagcctgggcaatatacagggagaccttgtctcaaaaaaaaaaaaaaaaaaaaaaaaaaagacatctaagtagaattatccagtaggcagtctctggagtctgtcttctttcatttagcataatgcatttgagatttattcatgttgttatgtgtatcagtattttgtttctttttattttttaattgagtagatggatcacagtttgtgcattaattttccagttgaggaactttggggttgtttccagactgggatgattacaaatgaatcttctataaatctttgtgtgcaggcttttgtatgaacataggtttgtatttcacttgagtaaatttcttggagtgggactgctgtgttttatggcatgtggatgtttcactttataagatacttcccagcccagcgtggtggctcacgcctgtaatcccagcccttggggaggccgaggagggtggatcacctgaggttgggagtttgagaccagcctgaccaacatgaagaaaccccatctctactgaaaatacaaaattagccgggcgtggtggcacatgcctgtaatcccagctatttgggaggctgaggcaggagaatcgctggaacctaggaggcggagattgctgtgagccgagattgcgccattgcaccttagcctgggcaacaagagcaaaactccctctcaaaaaaaaaaaaggaggggggatacttccaaagtgttttcccaagtggccattttccacttccactagcaatgtgtaagagtcccagttgctctgcatccctgccagcatgtggtattgctagtgtttccttttagtcattcttatagatgtgtagtggtatctctttgtggttttaacttgcgtttcctagtgactaatgttgggcacgttttcatagtcttatttgccatctacatatctgctttgatgaagcgtctatttaaatcttttgcccatttttttattgggttgttttcttatttgggggtttgagggttattttattttattttattttattttattttattttattttattttattttattttatttgagatagaatctcactctgttgcccaggctggagagcagtgacaccatcactactcactgcagcctcgaacctccccgagagaccttcccacctcaggctcctgagtagctaggaccataggtgtgcgccaccatgctccactaatttttgaatgttatgggccaggcacagtggctcatgcctgcagtcccagcactttgagaggctgaggcgggtggatcacttgaggtcaggagttcaagatcagcctggccaatgtggcagaaccccatctctactaaaaatacaaaacttagccaggtgtggtggcatatgcctgtaatcccagctactgaggtggctgaggcaggataatctcttgaacctggggggagaaggttgcggtgagccaagatcatgccactgcactccagcctgggcgacagagcgagaatccgtctcaaaaaaaaaaaaaagaaaaagtttatgtagagctatggtctccctatgttgcccatactggtctcgagctccagggtgcaagcaatcctcctgccttggcctcccaaagtgctggtattacaagtgtgtgagccaccacgcccagccttgagagctctttgtatattctggatataaatattttgtcagatatgtgatttgcagacattttctcccattttgtggcctgattttatacagtgtcttttttttttttttttttttttttgagacggagtctcactctgtcgcccaggctggagtgcagtggcatgatctcagctcactaaacctctgcctccccggttcaagcaattctcctgcctcagcttcctgaataacagggattacaggcatgtgccaccacacccagctaattttcgtatttttagcagagacaggatttcaccatattggctgggcattcattgaatgcccacatcgtgttgaactcctaacctcaggtgacgcacccacctcagccgccgaaagtgttgggattacaggcgtgagccactgcacccagccctggccactcttaacagtatcttttgaagagcaggtagttattcattttgatgaagtccaagtcattatttttttttatggttataggaatttttgcctcccttaagtattttctcattttcttctagaatcttatcattctagattttaagtctgtggtcaattctgaattaacttgtgtattggacggtcaggtacacgttgtagttcatttttctttttttggcacatggatgtccatgatggggttcaatgctctgggagaaaggctaccctgaaggacacctgtccagcagctatgatacgggacacactttcccaaaagtttgtagcaagcaggacacaggcctgtcttccctggtgggatctcaacctagtgtggtaataataacacttacagggaagtgttgttatgggaggatagagtgcattattctattcagaatacttacctgtgtcactatgattattaacctccagaaatgaatggctctgaatctcatccttcagagaccactttaccccttcccctggcctagcaggtaggggtttgcatggatatgccaccaagagagccctgtctccccatcttatcccattcctgcttacccactgctttgtaattctacatctaaggcacagcactgtctttaaacattcctgtcagaagagacccagaaggtagcaggtgaagccccggagacttttttttttgagacagaatctcactctgttgcccaggctggagcgcagtagtgcgatctcagctcaccgcaacctccgcctcccaggttcaagccattctgctgcctcagtctcccgagtagctgggaccacaggcatgtaccaccacacccagctaattttttgtatagccccggagactcctaaacccacctttgctttgccaagttcatggggccgtgtgctctggtgcctggcacaactccctcctttttgtctttttagcagtcagagatgtggaattgagaaggaagggagcagcactcccacagaaggggttcacaaggtctctttactccttttccggatcatcataccttggtcattactgtcagacaaagtgtatgaacagatgcgggccttgggcactatttcctggctgctgaggtttatttgcaattttcccgaactgtcagtgagtgcttggagtggggggaaaggctgacccagtgggccctgcttctctgcacatggggtacctgagagtctgtggttctgcagggggttactggggggtgggtggtcagagtgtccctctttttttgcattagtgccttttctgttcctatgggggaagaggcttaacttgtttgcttggtttgcccttggccaagtgagtttcaattggctggacacatctcagccttgttgggggaccttggcctaaacagctgggttgggtccacagcttcccactggctaacatattttagggatctggctgccccatttccctgggtgctgctttgaaaggttttcttgggcagggaaagagtgtggagctggtgtggtgaggggatacctgcaggcaaatgatttagtggtgtagaggggtggggaggttggagagggatggtggccacagtatggggaatttccttttggggtgatggggagttaaccagtttcctcttctgggcagcacatggaggaattctcaatgagtgggaaactgatgagcatcttcggcctgttcgtcatgggctgcaaccacgagatcagcatagaggcatcagaggcgttgcattacctgttcaaaatccttgtgtttcagagaagtaagcaacatgagcctgagtggccactgggctacagccgtggggacccatgaataacaagagcatataagcaccattcactgaatgcccacattgtgtcaggcacacgatgaagggcagttccttctcatgagggcaatggagtaaatatgctatgatgccccaagatgagggatccccattacaagtagatctggaaactttatctggatgagctccaaccccattgctgatgcaatgccctcttgtaagagattctaagagattctcggggaaaaggggagctaggcttgcagccacctgtggaatcaacttggatactcaatatttctcagtggtctcagccttactgctaggcctaagactgggaaaatgaacatcttttcttagggaacaaatttgggagtgccagattgagaccctctttgctcaaggaaaacaaaaaatacaaagagtcacacacgcttacagaggtgccagaaggatttgcaaatatccctaaaaggagtttcagaaactctgacttctcatggttcaacagggcatacttcttataagggcatttgctcagcacccacgggtagaacagtccacattctggcacggcgcaggaacagctgcaaggaccagactgagtccccagccacattctccctccacccattggcctggtgctggggaactcttcccattctgttgagcaaatgttatttcacccatttcactctgttgatcttctctgaggtttggaggggaaataaagaagggtgtgttcctatttccctgttaaggccctgccccttaattgttgtttttggattgaaggtgtgaaacaaaagacagagactatcctgaaggatttgcagaagcatttccatggagcatggcttgccagcctccaggatctaacactggtaaccctcactctccacagtgcatgaaatgcccagatggggagccatgacagggaagaaagagagctggggtggggagattgtagagggcctgggtggggccacagaggagtactccttcacccaggggagtgtctccaaagctcaaggtctcatggacagcaggctggaggggtaagactcattccctagctgcacttgagttgactgaggcttgaggtcactgagagagttcttttttttttgaaatagagtctttctctgtcacccaggctggagtggcacgatctcagcttactgcaacctctgactcctgggttcaaatgattctgtagcctcagcctcccgagtagctgggattacaggtgcgtgccaccacgcccagctaatttttgtattttttagtagagatggggtttcaccatgttggccaggctggtctcagactcctgacttcaggtgatccacccgcgctggcctcccaaagtgctaggattacaggcatgagccactgcacctggccaagagagttctttaaaagacgtatagtcaaccctattctcctcctacagattgtgcccttgtaccttatttgtagcctagccttaatttttttaattcagtaaagatgtattggttgtcttagccgggtgtggtggctcatgcctgtaatcccagcattttgggaggccgaggcaggtggatcacgaggtcaggagatcgagaccatcctggctaacatggtgaaaccccatctccactaaaaatacaaaaaaaaaattagccgggcatggtggtgggcgcctgtagtcccagctacttgggaggctgaggcaggggaatggcgtgaacctgggagatggagcttgcagtgagccgagatcgagtcactgcactccagcctgggcgacagggcgagactccatctcaaaaaacacaaaaagatatattggttgtcttagatatggtgtctccaggctcaatcaactcaaatcactacagtcagaaatccaggagtcatcccttgctctttcctctccctcactcttcacatccaattcaacaccaggtttgttcattctgcctcctggatagctcttgaatttgtccactctgctccagccccactgtggggcccccagcatctcttgcctgggtcactccagcagccccttactgagcatcctgtttccaactgtgcttcttgtcacatcactttctatgctacagtcagagaactgcatttctaaaatgcaaatgctgagatgtattattccctttcagactgcattgaatccccactgtcctcattctaaagtccaaacttgttcacttgacccacaagacccttcatgatctggtccctgctgtaactgtcctgcctcatcttgtcttagtctcctttttccatctggcccaggtctcccttgcaggacacagtagttaggctgaacttccttccactccaggcctttgcatattctgttccctctgcctggaactctgtccttctttttccttgggtctgaatcatggcagtaggggaaccaaacacatccttcttcacatggcagtaggaaggagaagtgctgagcaaaggagaaaacatcccttataaaaccatcagatcttgtgagagctcactcactatcacaagaacagcatgagggtaaccaccttgacacatgaggattatgggaactacaattcaagatgagatttgggtgggaatacagccaaactgtatcactgacattgcactataactgcctgtttacttgccctgacttgatggtaaattccttgagggtaaaggcattgtatgtcttagtcacagttgtcctgagctcccagcaatagaaccaggcacagagctgggcctcaatattgtttgagtgaatgagcttcacgtggatatgcaggtgcaggctcagaggcatgaggcatgtctgctgtacataatagcactcctacttgctttggaatgctgcaagctcactaaacatcagaactaatttccaatggactcacttgcttgcattccacatggaagtagaaatgccttttgcattgtcttctgtatcaagttgtcaggaccattgctccttcctggagacttcagagctggtggcactctgaggcttggcttacaccacggaatagccagatgctgaccaggggctgcctccactggcccctggttgattagtctctttggaagccagaggctttggggcagacccaagttgggatgctgacattgtggagacagctgttcttctttcttcagttcttcaagaaatacctgaaccctgagaagagagcagatatgatcatggtgagcatggaggccatgaccaacaccagcaggcgtgacatctctgcagcttccaagatgttaaagatgatcctgaagtacacgattccagagatcgggaaggtagcagctctgggcaacctaatggttcaaggtcaatttaaggattcttcctttctgttctgttttgggtcttgttctatctcctaccagtttgagtttaaagaatcacatgcttcaacccagaggagaaaaggctaaatgaggagttgtgattgtggaaaagactcttctttgggaagggttgaccatctggcttccatctccaccaggatgggaagaagaattgagtcaaagctatagcagactactaggacctgctaggaccaggaaagaccacagtcattcttcctgcttccagacagtatttgatatgttagatctataggtgccttcttgtttattcaggagggataattcaggggtgtgtgtgtatataaatataaatataatatatatccataaacttgtgacacactaacataaatagagatgaaatacagagactcctttatgagacctgggactggttctcagtaaaattaagacagcgtagggctgggcgtagtggcttacacctgtaatcctagcactttgggaggctgaggtagggggatcacttgagcctaggagtttgaaaccagcctgggcaatatagcaagaccccatctcttaaaaacattaataaaaaaattaagacagcacagtttagctgtcctttttattatagtattttaaaatatctgatggactgatggagtccctcttcttttaatggcctaacccacttctctaactcacttatgacctctccactataggtcctatgagcagttccaggatcttacattttccacttctctggcctggattgccttttgattgaatgcctcagagcagaccactgataagttgaaggggaccccaaaggtcaactactctaactccccacttgatgcttgtaatctctttttaaggttttaaatctattttgtatggaatgcttcacgaatttacatgtcatccttgtgcaggggccatgctaatcttctctgtgttattccaattttagtatctgtgaagcgagcacaatgctcgtaatctcttcgagagcaccccagaccactggacacccagacggtgctgaaagcaatcttgaggccctcgctaccttaaaccatagctcatttgtatttgtaaatgactttcttttttaaaaaaaataatttttaatttaccaaaaggatatatatttatggcatacaacatgatattttgaaatatgtatacattgtggaatggctaaaccaagctaattaacatatcgattaactcacatactttttttttgtagtgagaacattgaaaatctactgtcttagcaaatttcaagtatagaatagtcaccatgttgtacaatagatctgaacttatttctcctgtttaaatggaattttgtatcctttgaccaatatctccccaatcctcctcacctccagcccctggtaaccaccattgtactctctgcttctatgagtttgacttttttagattccacatctaagtgagatcacccagtatttgtttttctatacctggcttgttttgtttttcaaaacaaaacaggttcatgtatactgttaaatgacagggtttccttcatttttaagggtgaatagcattccattgtgtatatgccacattttctttatccatttatctgttgttggaagcttaggttctttccctatcatggctattacaaaaaacgctgcaatgaacaggggagtgcagatatctcttccagacactggcttcattttctttggctatatacccttaagtggtattggtagttttacttttagttttttgaataacctccataatgttggaattttccataatggttgtgctaatttacattctaccaacagtgtataagggtgaaccactttccttatctaaaagttctaacttacagcacactgaagtctgcatccccatagtttctagtccctggcccaagtttaccttcttgggttatgcagaattcaattaatattcaagtgttactaatgctaggtgctatatactgtgctagtttcttttacatattcttgtattgaattcttacaacatatctgttgtaagaattattttctctttagaaacgagaaggccaggtgcagtggctcacacctgtaatcccagcactttgggaggcctaggaaggaggatcgcttgagtttgggagttcaagaccagcctgggcaatatagtgagacctcatttctactaaaaatcaaaagcattagttgcgcatggtggcacacacttgtagtcccaactactagggaggttgagatgagaggatagcttgaactcacgggatggaggctgcagggagctataattgcgccactgcaccccagctaggacaccagagctagaccctgtctcgaaagaaaaacaaaacgagaaaaggctcaaagacgccatgagccttaattactgaagtttcgccagcagttactaggtaacagacactgttccaaccaattcagatgcattaactcagaactgttgatgtgggtaaaatcgtcctcatattttgcgtgaggaaatagagcgcagaggatgaaaagctttcccaagctcacacagttggcaagtggggaggtgaaattcacatccaggtagtatgactttagagttcatgcggaccactacctgttgcctccaccccacatggccagtaaacagcaaggactgactcttctctccctccataatagtcttgagaccatttggaggcagcaatcgtatgccctccggcttcctctctctaagttactcatccttagattcttccttcattcttcatgacatggtttccagacatggttctggtctcccctggctgctctctattttgtccctcttaaaatatggggtctgttccgtggtgggcaggtctgtataaagctacccttaaaatccaaggaagctgagaggtcaaagaaagaggttgatgaatccagtttctgagaaagaaactactccggaggcagaggcaggagaattgcttgaacccaggaggcggaggttgcagtgagcccagattgcgccaccgcactccagcctgggaggcagaaggaaactccgtctcaaaaaaaaaaaagacccggcgtggtggctcacgcctgttatcccagcactttggggggctgagggaggtggatcacctgaggtcaggagtttgagatcagcctgaccaacatggcaaaaccacatctctactaaagatacaaaaattagccgggcgtggtggcatgtgcctgtagtcccagctacttgggaggctgaggaaggaggatcaaaccggggggtggaggttgcagtaagctgagattgcgccactgcattccagcctgggcgaccgagccagactccgtctgaaacaaaacaaaaaacaaaacagaagccatgtcccaggaggctgcgagatgagatggtggaccccccagccatcacccaccatggcccagggcttctatacaataggagtcggacatggtgggtgtgcctctagtcccagctactgggaggctgaggtgggagaatcactggagcccaggacatcaagtctgcagtgagctatgagcatgccactaccctgtctctaagaaactaacaaatataccttagagaaggaatgtgttgggcaattaaaatcaacccctcaggaaaaagcaagaatgctacgcaaatctgccctaagggcaggatttatggtaagggttgtttcgacctaaggactggatttacagcaacaatagataaagtaagtccgggcacggtggctcacgcctgtaatcccagcactttgggaggccgaggcgagtggatcaggaggtcaggagatcgagaccatcctggccaacatagtgaaaccctgtctctactaaaaatacaaaaattagctgggcgtggtggtgagtgcctatagtcccagcaattcgggagactgaagcaggagaatctcttgaactcagaaggtggaggttgcagtgagctgagatggtgctactgcactccagcctggcgatagagcaagactctgtctaaaaaaaaaaaaaaaaaaaaatagatcaagtagaaatcttagaggtattctgggaaccgagattaatcagaagtcaatatggtgaccaaaacgaaaagaaaaggaaaaaattaaacaaaaagaaaaaaaagaagtcaatattgtaggccaggcgctgtggctcatgcctgtgaccctagcactttgggaggccgaggtgggcagactgcctgagcccaggagttcaagaccagcgtgggcaacatggtaaaatcctgtctccaataaaaacacaaaaaaaatcagccgggagaggtgatgtgcacctgtaatcccagctactcgggaggctgaggcacgataaaacccaggaggtggaggttgcagtgagctgagatctcaccactgcactccagttgcatgggcgacacagcgagactctgtctcaaaaaaaaaaaaaaaacaaaaaaaagtcaatatggtggattagcatccaacatggggttgcttcaggccccatagggtccaaaacagtccacagtcctgagggtatggcctgaccagagcagagtgcagtgggacggtgacttttttggtctgggcatgctatgtatgcatcatgtgcagctctacaggtgaagtgggtgcctagttatgtggatgctggtgatctggtgttgaatgtctggaaagaacctccttttccctcatttcaggtgctggaaatcatccagtacattcactaccacatgaacagcattacagaaaccacagcccaaaagaccattaagaagatcctgtatctgctgtcccagtactacactgaagttatcctgacagtattgaagatagaagatcagtcacaaaagtaggtgactttcgatcccacaagtacatgcccccaatagtctgtttgcttcttcttaaaacatattcaggacctgagcaggggctcacttctgtaatcccagcactttgggaggcccaggtggacagatcacctgggagtcaggagttcgagactagcctggctgacatggtgaaaccccgcctctactaaaaatacaaaaaattagccaggcgtggtggcgggtgcctgtaatcccagctattcaggaggctgagtcaggagaattgcttgaacttgggaggcagaggttgcagtgagccgagatcacgccattgaactccagcctgggcaacaagaacgaaactccatctccaaaaaaaaaaggaaaaaagtagcggctgggcacggtgactcacgcctgtaatttcagcactttgggaggccgaggtcggtggatcatctggggtcaggagttcaagaccatcctggccaatatggtgaaaccccatctctactaaaaatacaaaaattagccaggcgtggtggcgggggcctgtaatcccagctactcaggaggctgaggcaggagaatcgcttgaacctgggaggcggaggttgcagtgagccgagatcgtgccactgcactcccgcctgggagatagagtgagatgctgtctaatatatatatatagatatagatagataggtagctgttctaacaagtgtgtggtagcctctcattgtggttttaatttgcatttccctaattcaattgcaactaatgatgatgggcatcgtttcatgtctttctttgccattcatatatcttctttagtcaagtatccaaatctttaacccatttcattgttgggtcgtttgttttcttattggtgagttttgagagttctttatatattctgtatacaagtcttttgtcagatatacaattttcatgtatatctcccattttgtggattgtcttttcattctcttaagagttcaaaagtttgtaatttgatgaaatccagtgttttgtttcttatggatcatatttagagtcataggtatttctttccatgatttcttctagaagttttaacttttgtgttttatatttatatttcacttttactttttagaaagcgtgaggaatgggactaggttcagtttgttgcatatagaagtctaattgttccagcaccatttgttgcagagattatcatttctccactgaattgtctttgcacatttatcaaaaatcaattgacggctgggcgtggtggctcacgcctgtaatcctagcacttttggaagccaaggtgggcagatcacttgaggtcaggagttcgagaccagtctggccaacatggcaaaaccccatctctactaaaaatacaaaaattagccggggatggttgcttgcacctgttatcccagctacttgggaggctaaggcatgagaatcacttgaactggggaggtggaggttgcagtgagccaagatcgcgccactgcactccagccagggtgacagagtgagaccctgcctaaaaaaaaaaaaaaaaaaaaaaaaaaaaaaaatcagttgacagtatttgtgtgcctctaattatgggctgtcttctgatccattaagctatatgtcagttctttcatcaataccgtactgtctctaatagtgtagttttattttaagtattaaatcaggtaggatgagttcttcaattttattacttttttttttttttttttttttgagatagagtctgactgtcacccaggctggagtgcagtggtgcaatcatagctcactgcagcgttgaacttttgggctgaagcaatcctcccacttccacttcctgagtagctggaaccacaggcacatgccacctcacccagcctttttttttttttttttttggtagaaacggggtctcaccatgttgcatggctggtctcaaaactcctgagctcaaatgattctcccgcctcagcccaagtgctgggattacagggtgtgagcagttgcacctggcctataactctttctcaaaattgttttgactattttattttgcttttccatataattttttttttttgagacagagtctcactctgtcacccaggctggagtgcaatggcatggtcttggctcactgcaaactgcatatcccaggttcaagtgattctctcacctcagcctcccaagtagctgggaatacaggtgtgtgagcagttgcacctggcctataactctttctcaaaattgttttgactattttattttgcttttccatataatttttttttttttgagacagagtctcactctgtcacccaggctggagtgcaatggcatggtcttggctcactgcaaactgcacatcccaggttcaagtgattctctcacctcagcctcccaagtagctgggactacaggtgtgtgccaccacacccggctaatttttgtgtttttagtgaagatggggtttcactatgttggccaggctggtctcaaactcctgatctcatgatttgcctgtgtcggcctcccaaagtgctgggattacaggcatgagccgccacgcctggcctgcttttccgtataaattttataatttaaatagaatatttatttatttaaaaatatgctggtgatatttttattgggattatgttgcatctatagataagtataaggagaattgacaacttcacaatattgagtttctggtccatgaacatagcgtatctcatttatttaggtctttaatttctttcatcagtcttttgtatttttcaacacacagatcttgtgaatattttgttagttttatacctaagtatttttgtgcaattgtaaatggtacataaatcttttttaaatttttaattgtttactactgctacatagaaataacatcaatttttgtatattgactttcattgactttatatcctgcaataagtgaggtttcacttattagttcttggagctttttaatagattcactggagttttctacataaaccatcatatcatctgtaaatagaagcagtttatagtgtttctttttcttccaaatttgtgtttctttttcttgctttattacactggctgggactcctagcataatgctgagtatgggtgatgacagtggacatctttgctttattcccaatcttagaggaaaaactttcagtctttcaccattaagtatggtgctagatggtagggttttgttgttgttgatgttagatgtcctttatcaagtttagaaagtttccttctatttctagtttgttgcgagtgtttaccactaatggagattatcacaaatgttttaactacatctattgagataattgtgtggtttttcttttgtattctgttaatataataaattgcatttttgactgtggaggcagtcttgcattcccaggataaaccccatttggttgtgatgtattatctttttaacatattgctggattcgatttgctaatattttgttgaggacttttgtgtctatttggttgaggatttttttcatgggagatatttggtctgtagttttttctttcattcatttattctttctcttttttcttgtactgtcttgggtttttgtgccaagataatgctgaactcaaaagattgttttgggagtattttctttttctttatcttttttttgtttttttttgagagacagtcttgctctgtcgcccaggcaggagtgcagtgggacgatcttggctcactgcaacctccacctcccaggttccagtgattctcctgccttagcctcctgagtagctgggactacaggcatgtgccaccacacccagctaatttttgtattttttagtagacaaggttttcaccatattggccaggctgtcatcaaactcctgacatcatgatctgtctacttcggcctcccaaagtgctgggattaatggagtgagccaccgtgtccagcctattttcttattttctattttttggaggaaattgtgtaaaattggtattactttttttctaaacatttagtggaattcaatactgaaaccatctggatctagagttgtatttgttggaagttttaaaactatggattgaatttatttattagttagggtcattcagattatctattaatttgctcatcttctagtcacttaaggtggaaatgtaaattactaatttgagaactttcttcttttttaaaataagcatttttatgctatgaatgttcccctaagcatagttttacctgcatctaacaaattttgatatattgtattttcattttcatttagttcaaaaattttttctaattttccttgagtctttttctctcacccatgaattacttagaagtattgttaatttccaaatatttgtggattgtccaggtatatttctgttactgatttctagtttaaatttattaaggccagataacatactttatgggattccttttctataaaatttgctcaggtttgttttgtagcccagaatgtggtatattatggggaatgctcatgtgcacctacaaagcatgtgtattctggccaggcgcagtggctcatggctgtaatcccagaactttgggaggtcaaggtggctgcatcacctgagtccaggagttcaagaccagcctggccaacatggtgaaaacctgtctctactaaatatacaaaaattaacgagggacggtggtgcgcgcctgtatacccagctactcaggaggttgaggcaggagaatcacttgaacctagggggtggaggttgcagtgagctgagatcctaccactgcactccagcctggtgacaaagtgagagcctgtctcaaaaaaaaaaaaaaaaaagaatgtgtattctgctgttgttgcctggagtgttctgtaagttaggttatagaacaacacagtgttgttcaggacttttataaccttgctgaatttctgtctacatattctgtcaattactgagagaggagtgttgaagtctcccaatatgcttatggatttatctatttgttccttcggttttatcattttttgcttcatgtatttcattaggtgtatatacatttaagattgctacatcttcttgatgaattgactgttctaccattaattaatgtccctctttgtccctggtaatactctttgttctgaagttccctttgtctgatgttagtatggccatttttgcttttcaaacagtttgtatttgtgtggtatatctttttccattcttttaactaatatgtataattatatttaaaatgtttttttaatatagcatatggttggacttgtgtttttatctaacctaacaatctctaccttttagtttgcgtatttaaatcatttataattaaagtaattaataatatgtttggatttaagtctaccattttatgatttattttgtttttcccctttgttttttattcctgtgttcccctttcctgcattctttcaaattgtttgaatttttttaagcattctattttaacttgtctattagattttgattctttgtaccaatttttagtggattcctgggcatttatatgcctaaagttttatagtctacttacatacctaaatttccatagtctgcttagagttagtatttcacaattttgagaaaatgtagaagctttcactatacagcttcttttaccttacttttttttgagacagagtcttgtaggctggagcacagtggcacgatctcggtcactgcaacttccgcctcctgggttcaagcgattctcctgcctcagcctcccaagtagctgggattacaggcgcacgtcaccatacccagctaatttttctatttttagtagagatggggtttcactatgttggccatgctggtcttgaactccttgaacctcaagtgatccgcccgcctcagcctcccaaagtgctgggattacaggtgtaagccaccttgcccggcctaatttttgctttcgatagtcatacatatttttaaacttaagaggagaagaacggtctgttacatttactcatatatttgccattcctgttgctttatcttcattgttaaaatttcaactttcactctgatacaatttcttttctgcttgaagaacttcattagcatttaatttagagcatgtctttgagtgataaattcttagttttcttccatatgagaatgtttcaattttaccttcttttttttttttttttgaggcagagtttcgctcttgtcaccagctcttggcacccaggctggagtgcaatggcgtgatctctgctcactccaacctctgcctcctgggttcaagtgattctcctgtctcagcctcctgagtagctgggattacaggagcccaccaccatacccagctaatttttttgtatttttagtagagacggggttttgccatgttggccaggctggtctcgaactctgggcctcaagtgatctgcctgccttggcctcccaaagtgctgggattacaggcgtgagccactgtgcccagccaataaatttctgtttattataaattacccagtctatgagattttgtgatagcagcacaatacaaactgagacaatggcaaaggggctttttcagctaagaatcttgagaaagggagattattgtgaattactcaagtgggctcttaatgtaatcacaatgtgtcttgtgattgatgtatcttgttcgaacttcactgcacttcttgaatctgtaaatgtatgtctctcaccaaatttgggaagttttaggtcattatttcttcagatatttttttctgtacaagtctctttttctttttataagatttcaatgacatgaatattcgactttttaatggtgtcctataagtccctgaagctctgttaatttttttctaatttcttagttcttcagattggtataatttttattgattcatctgcaagttcatgaacccttctctctgcaatctccattttcctcttgatctcatccagtgaatttttgtttcagatattgtgtttttcagttctaaaatttccatttggtttttttaaaaaatagcttattcctcagctaagaacatgagaaaatccgtctttccacttctttctttgtttctttgcttctctctctctctctctttctttagttcttttttgagacagagtctttctctgttgccccaggtagggtgcagtggcatgatcatagcttattgcagactcaacctccgaggttaaagctatcctcccatctcagcctcctgagtagctgggatcacagggatatggcaccatacccagctaattttttaaactttttgtagagacagggtctctctatgttgcccaggctagtcttgaactcctgggctcaagtgatctcccgcctcagcctcgcaaagtgctgggattacaagtgtgatccaccactccagacctttccatttatttcagttatgtacatctttacctcatgcagcatgattaaaatgtctacttaaagtataattattattatttttagacagggtcgtgctctgttactcgggctagagtgcagtgacgtgatcatagctcactgcaacctagaactcctgggctcaagtgatcctcctgcctcagccctcaagtagctaggactacaggcatgtgccaccatgcccgctattttttaaattcattttttagagaatggatctcactatgttgctcaggctggtcttgaactcctggcctcaaggggtccttctgccttggccttccaaagtgttgggattatgggtgtgagccagtgcacccggccatctctcagagttttagctgcctgtgctgctacagctgcacaactggatctggcttcagggtgatgaaatgagaaaaaagagagagagagaaaaaaatagcgcttcccccacccctacactcagtgggccacagtgccctgtgttaggtgcttttgttgctgccccaactgcttccactgtgcagctctgcatctggactcactctcgggacagagcttgggagaggaaagagacaaagaaagaaagaaacaaagattccacccatacttctccaactcacaaggacccattttcccagtcctctggccagagagacagagttttactaagagattttgttgcctgtgcctgctgcatagttcagcactcgggtcaccttcgggtcaaagctggaagataatagagaaaaaagaattctgggaaactcactcaaatgttgtttttccagtgttgggaggtagttgctttttgtatttgtccagtgtttttagttttaactggtgcgagagctgggctggagtggacttgctctgtcctagcagattgtgtagactctcttactagggaaattaggattgcttgttgttaatttcctttatcatgagaaggaagtgtctttctagtctatatctgctgagtattttttttccactcatgtggaattgtttaataaaaggttgatatcatataattagagtgttttcttttgggtcgggggtggtttgagacagagtctcgctcggtagcccaggctggagtgcagtggtgcaatcttggttcactgcaacctctgtctcccgggttcaagcgatttgcctgcctcccgaggagttgggattacaagcctgtaccaccatgcatggctaatttttgaattttcagtagagatgagatttcatcatgttggccaggccggtctcaaactcctgacctcaggtgatctgcctgccttggcctcccgaagtgctgggattacagggtgagccactgcacccggctggacaaagttataatctgataggaagaaaaagttctggcatagtagagtgactgtggtcaacagtaaggtatcatatattacaaaacagccagaggagaggcttttgaatgctttcaacacaaagaaatggtaaaatctgctgagtttttttgaaaaataaaaattaggctttgaaataccaaatgcccttacaacatctaatgacatatttatacaaatgtatacaggtttctttctttaaccttttaatttccaagtggttagatattttgatcatctttttctagttttattggatgataactggaaaacatgatctaaatgtcttctccttttgagaatgtgttgaggggttcttttgtgtgtatagaccaggaagattaatgttatcaattttactatatgtttaatggctatttgaaataaatttatattctctactgcatgcaaagtcatctattagaccaggcttgtttatttatttattttccttttttgtatatttttaaagtacagatgggtctcaccatgtcacccaggctggtcttgagctcctgggctcaagcaatcctccctcctcggcctcccaaagtgctgggattgcaggtgtgagccacctcactcagccagaccaagcttatttaattgttttataatatctcattgtacaataactacaaacttattttacccatttttttaatgactatttgttgtttccagcttcttgctattattaacagtgctgttatgctcattcttactctaatattgtgtttgatttataggcatatttaccattttatttgctcaccatcccttgcacctcaaactttccttaggaaattatttttcttttccctaaatgggaaagagaaaacaatacctctaaaggtattatttaggagtttatcctctagcgaggctctattgatcaaaccatctatttttgtttatctacaaataaagcaaatctgcattaaatgatagatttgctgggaacttgtgggttgatgtttatttttgttccacacttggaaggtttatcccactgtcttctgctctccactgtttctgtggagaagttggctgtcagtctcattgccattctttcactgacgactcattttttctctcttgtttttgtccccagagcatgcgtgtattgtttgccagctgtgaaagtctgtcttcaccttttatctcaccttcatttcctcaatgctttctcctcctgtttcaaaaaggccatgacttcttgaggacattaagcacattttcttaaaattttatgttatttgtagcaaatgcttttcagatatgtacttttcttctgagtgtgatttttccaggtaaaaatgagaggggagacatggtaggcaaagggaaaggcatgtgcccaatgatagaggagagagagcttgtgtatggggtgaggctgggggtgctgtgcggggctggtgatcagacctggcctgaagaggggtgtggtcatgctgggtattaaggatgacaggggaaagcctggaagacagatgcagtggtctgagggtgggtgggtagtgaaagcttggacaggccagagagaagggacccacagggaggctcttctcactgatctgacacattcaagtgtggtcaacaagctttggcctcagatattttctcaaaccaggttcatagaccaagtgaacatttccagatttgtgtgagatgacagagaacagggaggtctggaggtgatggcaagatgaaagaaatagaaggaaaaagagagaggggataatgaagagagagacaagaaaggaggaagaaaccaggggagctaggggcctgggcaaaggagcctagagtcgcctcccctggaagcactgtggagcctgtggagagtgggttacctggagtgggtaactgtgtccgtgggtttctgactctgcaggggggtttgcaaaccctgggaaatcctggcatccttccccaaaggctacgaaatgatcgtggactacctgcttcagaggctgactccacactggaggccaaaggaccaggagcccagccacagaacagagatctcaccattgattgtatggaaaggccagaagaggggggccggggtggggaaggggactccctgctgtcctgttctcggctgccttgggctctttggccttgaccttttaggtatcggtgtttggtagaacagtataatggcagtcttggagttgggttgcagggagggttttccagttaactttgctttgtcagggagatagaagaactggatttcccagctgctctttaactctcaaagatggtaagagactaaaacaaccaccatgattagaagagcgctttaaaacaatgacattctagaaattgccctttatttgtctggctcacactaacttagtcttcacttgctctagcagcacgggttttactgggcaagtctgtcatggtgatgggttgtggaaagagatttcctggtgacaggacctatgagtcgaagatacgataatgcttcactctcctcctccctccaaggccaccagggccatccatgagctcctgctggaacccagtcggcagatggaggtgcagtccttcttctcctccttgttcatggccctgctgttccagatctcctttttggtggttgaaggggacgctgaaacaagccgggatcagcaacacatagctgaatggatggaccccataaggtactttggtgtttgctagtgattatgctccagggaccatcagcttagcacctttgcctgacttggtgtcagcctactgagcctgaataccctctgtacaccctcctgccagggcatttaacatgttccccatgcatcatttcaagaagtgtccctgggcttaaaaaaattatattttattattttatttatttagagacagggtcttgctattttgcccaagctggtcttgaactcctggcctcaagccatcctcttctctcagcctgctgtgttgctgggattactggtgcgagtccagctgtctggactttttagaaaagactccttctttaaacctggcctactaggctgatgcagagattctgcaccaaaatgagatcaatactgtggataaaacacacatctggatccacagacctggattgcattcctacccttctgctggctcgctgtgtcaccttgcagatgccacatctctcttggcctcagttgcctcacttgtaaaatattagcctgggtctctggaggctgtcccaccaccagcagttcatgatcctgagaaagctttgggagtcgggcaggtggccagtgagggagaggagcgcagatggtgaatgacttcgtatctgttttcggccctttctccagttctaccatggaggccctgaagaccttgattcaaagttctggatatggggactgtgtgtcttctattcagagacatggggtctgggggctgcttgtcaatcctgaaagacactatggcggagtcactctgccggccaggtgagctgcacctgggtccatggctggagggctgtccattcacttggccctctcctgcggcccaggcctcacctgaacactgtgctcttgttgataggtccgttgtcatcaataactgttggcacaaccgccccctcttcagctccatcatcaggttcctccaggacccagacctgcaagaatcacttaacggcccttgtgttcctgacagaggtgactggctcttggcgggagggggcaggtgagggtgatccctctgtgagacagccacgtccaacagacacctcctgggaaggccactgattcactgctaggaagggttgggggacatggctaatggcacttgatttggttaccttgagccgggggctttggtgcctccttgaatctcatggcagtttgactctgccctgactttacagaagaacacagctctctccttcaaccacctcagccttgagcagccttttaaaattaatccttgcttagcgtccctgattgactcaatataattcagccacctgacagaaaaaaaataggaaatttagaaaatatggaaaagtatatcaaaaattataaagccatcactaagcataatccccagaggaaaccatattcattcaggtttttgcctgtatacaggtgtgtgtgtgtgcgtgtgtgctagttgaaatcattttctactaatattctgtatcctgctctattcaaatatctgtatatgtcattacatgttctttgtaacatacatttttaaattttgttttattttattttttgagacagggtctcactctcttggccaagctggagtgcagtggtgtgatcatggctcactgcagcctccatctcctgttctcaagtgattctcccacctcagccttctgagtagcgagatctacaggcatgtagcaccgcgcttggctaattaaaaaaaaattttttttttaatatggagaagtggtctcactatacttcccaggctggtcttgaactcctgggctcaagtgatcctctcatctcggcctcccaaagtgctgggattacagttgtgagccaccatgcctggcctataaacataaatgttaatggtgatataatgtttcatcacaaagatgatctgtaatttattcgacattctgtttccaattttacacaattataaataacagtttaatgaacatctctgcgaaagtttttgcccatattacagattatttccttaactattgaatataataagtggaactattggttcaaaaaatatgaatgtcttctataacttttaacaataatgccaaattgctttccagtagagctgtaccaatttagacttccaccaacagtgtttgggagaatttcagagtttctgacccactacagctttaaatgggatccttttaaaattcaagccacctgatttttttttttaacagaggctggactacttttgaacataaccacagagatagaagataatgcattactaatactaggatgtacactgatgttatcccagtgtgtcatcgtgtgcccttatgtggattacaggacactggtgtcttgttggaaggtgtccactgctagaggctgatctgtacatgttggtatggggtgctgagatacacattcaaggatatatgtcatgttggcagaacttttgctcagggtatgggaatgagacatgtaggattcagaaccctgactggaaggggatggctcagtccagtggatctcgataatttatgaacttcatatctcagggaagctgtttaaaatgcagattcctgggccctgtccccagagacttggattcaggaagtctggggtaaggccaagaagccttttttgctggtggtggtttttttttttttttgagatggagtctctctgtcacccaggctggagtgcagtggcatgatctcggctcactgcaacttttgcttcccaggttaagcaattctcctgcctcagactcctgagtagctgggactacaggcacgcaccattacgcccagctaatttttgtatttttagtagagagggggtttcactatgttggccaggctggtctcgaactcctggtctcaagggatccgcctgcctttgtgcccaccctccagaagtcttcattttctttttttctttttttttttttttgttgagacagagtcttgttctgttgcccaggctggagtacaatggcacgaacttggctcactgcagcctccatctcctgggttcatgtgactctcctgcctcagcctcccgagaagctgggactacaggcatgtgccaccaggcccgactaatttttgtacttttaatagagacagggtttcaccatgttggccaggctggtctcgaactcctgacctcaggtgatccgcctaccttggcctcccaaagtgctgggattacagacgtgagccaccacatccagacgaagtcttaattttctaaaagtactccagtggtggctgtgccacaggaaatgcttggacccagctttgggaaacagtacaaggcacaaacccgtgtggacaggaggccaccatgagatagctgccactctctttagagcagtaattgggaaccctggctgcgtatcagtatcctccctggaggtttcaaaaatgctaatgccaagcccccaccccgcccctcactctctgtcaaatttttctatttgaatcgatctgggatggggtctaggcatcagtttgttttagaagctcccaggtttaaagggatgctctaaaatacagctaggattgagaatcactctagaagttcccccaagtgtctgatacccagctgaaacaaggggacacacgatagagcgtttgctcatctgccactctgattggggtttcgggctgataacggggaggggaggtcagcatgcttgggaagaggctggaaggagcaccccagtagcgagatgggtgaaccccattcttagcaatcagagagagaagcagtagattctaaagtggaaagccaatggggttttaggtaccagctaagtaagtaagtcaagatctgttaagtgagagaccatggctaagaaagctttctaatatttcacagcctttgtcactccctgtttgttgcttcattatctttattcatttccttgagatgatcacaagtagaaacgtttaaaacagaaaaggtcgtatgcttttcttcagtgtactcaagaaacagcagagctctgttattttaattctctctaattctgtgaaaagggtgttatttacctctattttgtagagcacgaaagtgaggctcagagaatttaagaagttacttactcaactagagggtaaattagggtggtggatctgcctgactgccaatcaaagacagatgaaaactgctgagatgttaatgaagacttctttgccaaatgtacattcatatgtgcatgcatacatgcacactaaagcaagtacatatattttaaatgtatctgattgaattttgcctttttaaatgttattttattatttaaaagatattttctatatcacaagtcatcaagcaataaatgttatttaaaataatctatatacacatataatacgaataagtaaattaaaccatgcaaactgattatttttttattttattttattttttgagatggagttttgctcttgttgcccaagttggagtgtaatggcgcaacctcagctcactgcgacctccacctcccgggttcaagcaattctcctgccacagcctcctgagtagctgggattgcaggcgcctgccaccacacccagctaattttttgtatttttagtaaagacggggtttcactgttggccaggctggtctcaaactcctgacctcaggtgatccacccgcctcagcctcccaaagtgttgggattacaggtgtgagccactatgcccagcctatttatttattatttatttttgagaaggagtattgctctgttgcccaggctggagtgcagtggcatgatcttggctcactgcaacttccaccttccgggttcaagtgattctcctttctcagcctcctgagcagctgggattacagatgcctgccaccacgcctggctaatttttgtatttttagtagagacagggttttgccatgttgaccaggctggtctcaacttctgacctcaagtggtccacaaactgagttttgaagtgcagtctttttttttctcttctacttttgccttctcccctcctaccacattacgtctacacctccacctcttcatctcccaagtatctcagatgcaagcaaccaagtacgtacccttctgcatgctcaaataatcacacacacataatagatgttgacagattgttttccaaagaagcactaacaattcacatttatctcagggaagtgtgagagaacggtgtctctatctcttccaacaacaaagcttaactctttttagatgtttgtcctcctggcaggtataaagcaggggtgtccaatcttttggcttccctgggccatattggaagaagaattgtcttgggccacgcataaaatacactaacactaatggtaggtgatgagctaaaaaaaaaaaaaatcgcgaaaacctcataatgttttaagaaagtttacaaatttgtgttgggccacattcaaagctgtccagggctgcgtggggcctgtgggccgtgcgttggacagacttggtgtaaagcagtatctcattgctgctctggtttgcatatccctggcttctactgattttgaacattccgcatataattctgtgatttggattcgcctttctgtgaattccttcccatgtcctttgcccattgtcctattgaattgtttggctttttcttgtctacaagactaatttaacttctgattttccatttgcatgactacatgtgtttttccattgcaatgttttccatcacgtgcatgctagtctatttttaaacagagtgcatgccaggctggtttatccaggtgaatgtactgatatgtgtaagtctgagccagcctacctgtgcagactcaaggtgtccatctggcatgttcattccaaagcatgtgcacttagagcaggagttctcaaccctggatgcatattcatatctccaggagaacttacactaatacttgggtgccaactcagtacaattaactcagaatcttgggggtgacgtggggtccaagaatcagcatttttaatagctttgcaagtgacactaacatgcagccaaggctgactgcctaggagtcagcatcgcttttcgatatcacccagcagagcctggagtccccagtgctgttgaatgatcattacaaggatttctttctttttcttttttctttctttcttttgttttttgttttttgttgaggcagagtttcgctcttggtgcccaggctggagtgcaatgacacgatctcagctcactgcaacctccacctcctgggttcaagcgatcctcctgcctcagcctcctgagtagctgggattacaggcatgtgccaccacacccggctaattttgtatttttagtagagatggggtttctctatggtggtcaggctggtctcgaactcccgacctcaggtgatccgtctgcctcggcctcccaaagtgctaggattacaggcgtgagccactgcgcctggccgacaatgatttcttaataattctcctttttccccctccctttaaaaaagttactattctaggggactgtctttgacttttctcttttgctttttcagcacgtcagtaaatctgactaatacgtgctttgcagtgttcttcagggtcatcctttctccattcccactaccctggcctagtccagacccttattacctgtgcttgaagcaattattttaacttttttttagagacagggagtctcgctatgttgcccaggctggtccccaactcctggctttaagtgattgtcctgcctcaacctccagagtagttgggattacaggtgtgagccgccacagttgactagagcaactccaaaagataacatgctgatctctctcctcctaggaccttctgtcaacccaacacatttcccacgcccaacatttcttgccaatgggatcctcctctggagtcgggccagcacccagttgcccttccctcaactacattacgcttagcttatccctacatttcgcccttgttttgctatacccaccttttcccgttaaacacacacatgtttacgttcccctcccatctgctcattgaagttctctttattcaagttcagctcaagttttacctttctttttttttttttttaaattttttttggagacaaagtttcgctcttgtcccccaggttggagtacaatggcatgatcttggctcactgcaacctccgcctcccgggttcaagcgattctcctgcctcaacctcccgagtagttgggattacaggtgcctgccaccatgcccagctaatttttttatttttagtagagacgggctttcaccatattggccatgctggtctcgaactcctgacctcaggtgatccgcccacctcggcctcccaaagtgctgggattacaggcatgagccaccacacctggccaagttctacctctttcacaatcttttcctagatgaatcaacacctgtttataataattttttacttgcttttaatttgtgtagtattgttattgccttgaaatgttcactaggtcgttcatgtacctaagtcttgactctccagctgaattgctaggatctttgagggcagagtgcatttcttacttttatctcctgcagtttcccttatcaaaaatgcttaatgcggctggacgtggtggctcacacctgtaatcccagcactttgggaggttaggcgggtgaatcacctgaggtcaggagttcgagaccagcctggccaacatggtgacacccccctctctacaaaaaatacaaaattagccaggtatggtgacacatgcctgtggtcccagctgctcgggaggctgaggcaggagaatcgcttgaacccgggaggtggaggttgcagtgagccgagatcgtgccactgcactccagcctgggcgacagagtgagactccatctggaaaaaaaaaaaatgcttaaggggccaggtttgtggtggctcatgcctgtaatcccagcactttgggaggctaaggcgggtggatcacctgaggtcaggagttcaagatcagactggtcaacattctgaaaccccatctcaactaaaaaatacaaaaattaggtgggcatggtggcacatgcctgtagtcccagctactcaggaggctgaggcaagagaattgcttgaacccgggaggtggaggttgcagtgagccgagatcataccactgcactccggcctgggcgacagagcaagactccatctcaaaaaaagaaaatgcttaaggaaaacttggagaatgaataaatgacttctgggatgacaggtgcaaattcatccttaaagctttggcctctctaccaattctaaacccttaagaacatttccctactagtgagtaggaacctagtccaaagtcattgaggatttttttttctccttgcccacctgtctttcttggtctcccttccccagctgcttcagtgcccagatgtggcagccttagtggatgacttcaccacctgcattctggcaaactggttcaagagtgaggagccagccacagtgaagccattgctgcagatgctagaggtctttgcgaagcatgaaaacatggtaaaatggggcaggggctaagggtgtgcgctcaggagatgtaaccaggagaaggaacatctggtgtgtccagttatagatagggtgggacacactcttgggatcaaagagagcaaatcctcatgaggccagtacagcacagacaggagttggggcttgagccattcatgatttctccctcccaggaaaggtctcctgaggaagttttttcatgggtcatttcagagaatagaccaagctaaccccaggatctcacacgtcatccaggtcccttggagattgctgtcatcatcagggatgagaagcgcagtggcgatggaaacttacagtgtagtgggaggagggggcctcctctgttttctccccttccctcatgatggacacaaggtacctccccaaatgccctcctgggcagctcactccgatggccacccagatgctgggccagtcccagctctggaatgaaaaagcagtagagtgtggctctcaattgtggggctgaattgacttgaaatgagaattccttggcttggcaggagttatttccccagctccccattccctgagccactgtctcccgcaggtgaggcggctccgaatcctccagccctatgtgctgaactgctgctactcctcgaacagcgacatcgtactggagactttgctggtgctgaagaatctcctgagccacctcacctggcagcactcctcctccttcctgacccagctcaccttcacgctggtgcccttctttgaggaggtgaaggcctctctggggtcattttctttctttaggcatctgtaaaataagggagttggccgcgtgtggtggctcacacctgtaatcccagcacattgggaggccgaggcagtggatcacatgaggccaggagttcaagatcaacctgggcaacatagtgaggcctcattctaacaacaacaacaaaacaacaacaacaacaaattagctgagtccggtggtatgcgcttgtggccccagctatttgggaggctgaggcaggaggattgcttgagcccaggaggtcaaggctgcagtgagctgtgatcgtgccatgcactccagcctgggcgacagagcgagatcctgtctcaaacaaaacaaaaaacaaaacccctcacagagttggcagaatgattcaaggtcgttcaccttgaatacgatactgttctgtagggacttgattgctcctgccctccttgtatctttctgaaggggtgagatggagcaagagaacagagcacagcaggcgggggtcagagcaggtcatttgagggagcgaatggacacaggagtgtggggttggcgggggtggagctcagggacgtgatggcttctgcttccccacgcatgcgtgtcttctctcccaggtgtcagagcatctgcggttggcagcctttgagatctatgggagtctcttgaccaaggtcaagaagaggggccttgtcttccccttgaaacaccagatcctcaacttgctagtccccctggtgctccacctgagggacgtgaataccgatgtgtctctggtgagaggccaggccttggagcctggccttcagtccccgttttcatgggaggtaaatgctaaacatgttgagtgcttaggcagggctgtggcagtactggatggtgctgaaggagtcaactagtctctgaccttgcagagttttagtgagagactagagatgaacagacgcttgcactaaagtttttttttttatttttatactttaagttttggggtacatgtgcacaacatgcaggtttgttacatacgtatacatgtgccatgttggtgtgctgcacccattaactcgtcgtttaacattaggtatatctcctaatgctatccctcccccctcccccgaccccacaacaggccccggtgtgtgatgttccccttcctgtgtccatggcttgcactaaagttttctccagcttctggctccatctggttggccactgactcccagtggaatactgtgggtgtttctcctgggaggaaagtctcatcgacgggcagcagtccctctctctgcctccctgcctgtggctccagggggcccctctccatgctgctctctgcatactctctgcctgtgaatagagacagagttccctgggtcgggaagaccccgtgggaggcagtgtggtgggcagaatagagacggcctggaactggcctacatttcggaatgaatgagtccagctttgagcccaggagacccaggaacgtgaactgcagcttgaacacttgaagactggctgacttactctgtgacaggacaccttgtttccacagagcaggctactctgccgtcactgaggcctcttaggcgcatctgaggccggctgggcaagcgattgaatggggatattatctttgcgcgggggtgtcccaccggtgaactcagccgtggtattcctgacagagccagccctgatttagaacagtgaccacccagttgggggattaagacttcggggaaatttgttttcagagagactgttttgtggggcagggaggatgggggggcggcggcgtgggaagccatgtctctggtgaataaggctctgagctggatagttccagtgctccgggtcgcagtgtcacaccacaacaattgggaaaattgttagaactgtaatttttaaacttcttattagtgggaaaagggggttgtaagtagagccaagctgcctggacccctgcctttttcctaagccctggatccctgtcgattcaccagtgagatttccatcccatcgaggctgaatgtgatgccgcttgtctccgttttttgcacccctctgtgtccctgcccagtgccactccccagctcctcatgctgagcctccttgtctcccagatctgccggtctgccctctgccacactgctgccgtgctgggctggtcaaagctgaaagcagtatttgcagagaaagatgtgtggaacattcttggagccctggtaagccagcagcttgctcactgtctgcccctatgcgagggagggtggcatccccagcggtctaggtccttttcctgcagctctggggtttgcagcagtagtggcagcgggcagcagcaacagttcaacgatgagagactcattaagcacctactttatgctcagcacctagatatggttcctgccctccccttgtttcctgtctgaattggggagctaggcacacaagtagacaatcccagaatactttgggaaaggcaaaggaggggtacccagcacagtctgggagttgaaggaaggcttcctggaggaggtgtcatcttcagaaggagaaatagaaggcagggtaacacttaggcaaagggacggaatcaagagtgcaggccaaggtgatgctgtacacaggggtgtggagcaaagcactcactctgttccagggactttgcacacattatctggtatgatttgatcctcacaaccatcctgagaaataagggcagaagggcctggtgtgtggggagctattaatataagtgccttggaatcattagagcaggggcagaaaaggcaaatgcttacaaggccatgtgggaaacactaaccagaggtcagactgggtgggcccggaggagagatgtaggccccaaggcccagcacaggcagcctcctcagcatggccagaaaccacacaccgttgtcacagcacacatttagtgacaccaactttactctcctaaagtgaaattcgtaaataatatcctctacctttgcatatttccaaaataagtaatataatgccctaacgccaaaggagaagtgaaagtaatctacaacaaaataatctgtgtgaatatatggaacacaatacagcataacacaatataataatagaaaataaatactatatgtaaatgcttgggccaagttactttttatttatttatttatttatttgagacagagtctcactctgaagcccaggttggagtgcagtggtgcgatctcagatcactgcaacctctgcctcccgggttcaagcgattctcctgtctcaggctcccgagtagctgggattacaggtgcttgccaccaggcccggctaatttttgtatttttagtagagacggggtttctttttatttttgagacggagtttcatcatgttgaccaggctggtctcaaactcctgacctcaggtgacccgcccacctcagcctcccaaagggctgggattataggtatgagccactacgccctgccagggcccagttactttagaagaaaatgatgtgcatgaatccttgcccctctccatagaatcaatgtgaatggatctgctacaaatgcagaatgttataggagttggagactcataccacaagaagggtcaccgttggtgatgggacttccaaaatgattatattaatagctccccccacaccagggaagtctgattagaccagaaagtctgatgactttctgaacaagatgaagtatagtctttgatgtctattgcagatgcattcctagaaaatccagtatgtagttgaactgtgaaaaagttctctgttatctaaaaaagccaatttctaggcatggattattataagtaggtttttgagagacataaatgtgtaatgggatattagaaataggtgtacccccactcatcattttgaaaaccataaacatcccccagttccataattccctccacacagtacagtccccagttgagaacccaccaattgtttctaggaaagtggctcagggttgttaagagaagcaggaaatcgatgccaggtgcggtggctcacgtctgtgatcccagcacttggagaggccaaggtggctggatcacctgggaacaggagtttgaaacagcctggccaacatggggaaaccctgactctactaaaaatacaaaaattatccaggcgaggtggtggacgcctgtaatcccagttactcgggaggctgaggcgggagaatcgcttgaacccaggaggcggaggttgcagtgagctgagatcgcgccactgcactacagcctgggtgatagagcaagactctgtctcaaaaaaaaaaaaaaattaaaaaagaaagcaggaaatcctgattggggtgaaatttcccccattaatgttggcaaataatttaaaatgtaaaatgctgcgtagatcaaacaaaaaaaaatatcttcaggctggctttgctcatggactgtcagtgtgcagtccggtctgggcaggagacaccaagcaggaagcaggaggctgggccacactgtgctgtggaggtttgggcccagtgaggagcaggacttgaggctgtaggcaaggggagttgttgaagcgttttaagcaagtgggtagcatggttacagagctgtgcatttcacacaaatcacccaagctacagatcagagaaacattcccaagggacggaattggagcctgtgctggagagtgtctggggagaaatgatgaagtcaagaagacaaaggcatgggcgggattagctagttgtggagattgatttgatgtgaactgtggaagtaaaagttgcctcttggcttctgacatgggtgaatgctggtgtcctggactgaggtcagaaatacagagggaggaacaggtgtggaggggaaggtggtggcttgattttgggcatgttgagcttgtaaaatctgtgagaatgctagtacatctattccattggaagttagatatgtatcactgaagcttggagaacagggctgtgtttggtgaacgctgagcataccattgggtggtagatggagattgcaaccctaagcccagacatgctctcctaaggtaattgtgtggtgggaggagtatatgagtcaacactgagattccaggagacatcagttccaaggatcccacagaggagactagaaaaggaaaccaggcagaaagtcaaaggaggacaacaagagaggagagtcatggtcacctaggaaggaccatgaccagtttcaggaagcagtcaagggtacaaaaacccaagggtttctcgggtaacttcaaaagatgggagagatgagcaggcaggctaggctcagcctccccacctccttcaacccaagcagccccacttctccttctctttctccttctccttcttttttttgtagagacagggtcttgccatgttgcccaggctggtctccaactcctgagctcaagtgatcctcctgccttggctttccaaagtgctgggattacaggcgtgggccaccacacctgcccccccaccccttctgttagtttgggatattgggtttccagttaagatttctttttgaagaaaagatcctgtcaaaagaagttgggaaaaaccatggatgtagccttctgttttaagaacttagactgcagagtgaaagaggagagttaggatcagagctaggaaggagatgcaggagatggggtttgggttagtggttgttgcaaagggaaggacacatcatcctttgaaccttcaaggatggaagtctgatgaatgcagaaggggctgcattcctaggcaggcgatggaggatatgaaaacacgtaattacatgcagcactgctaggctctgttatttttatttatttattttaaatattttattttattttattttatttatttatttatttatttatttatttatttatttatttatttattttttgagacggagtctcgctctgtcgcccaggccggactgcggactgcagtggcgcaatctcggctcactgcaacctccgcctcctgggttcaagtgattctccttcctcagcctcctgagtagctgggtctacaggcacacaccaccacacccgtctaattttttgtattttagtagacatgggtttcaccatgttgcccaggctggtgttgaactcctgagttcaggcgagctgcctgccttggccctccaaaaatgctgggattacaggtgtgagccactgtacccggcctattttaagaactttagattcgggggtgtgggtgctggcttgttacattggtatattgtgtgatgctgaggtttgtgcttctaatgttcccatccccaaggagtgaacataggccataggtagtttttcaactcttgccctgttcccttcctcctcttttttgggattctcagtgtttattgttcccatctttgtgttgatgtgactaaggctctgcttaaacagaatgctgtaggcatgatcttttgcaacctaaagcatatgactttgagattgaagatttaaactaagatagaaataaacaggatttaagcaacagggttcactctattgttgggagtaggagaaaaaaatgtatgagccaaacagtggggccaacctcttatgagtttcatgctcaaactgcgtcaaggccagggagtatgatctctgtggcatgttcagtccaggaaggcttcatgaaagaaagaagatttcaggagccggggtaggaggggatggagaaggagacggttttgacagatttttgccctcaggggatggctccagtgtaatctcaaaactgtctgagggtccctgccataatctgacaccttttcttacagctggatcaggagacaaacaaagccctctggtttctgaagcagtgtgtggctctcttcaagagcccataggttcccatccgctgggcagctgtgtggtttgcaggtatggccttttgtcttcttggagccactgtgtccttgttgtagggtcccttaaacagactgggcacccaggacatgaggacatacagaacccatgggaattatgttgggtggtgggactggaggtgggagtgcctacctgtgcctacctgctccctcccctgcaggaaactcctggtcgggttgggtggtaatcttcctacagcagaatgtgccaagtcctacgagccagcagagagacaaagggtggggcatccggggtctgggagctgctcagtgggggaagttcagagataggcgggggactgcctcagatcaccccagggaagagctcttcagggcagaggaagatccactccttcacccagccctatttgcttagaatccttcagagaagcaagggacacaagtttgactttatgggaaaagtccaaacctgaggctggtggccaagggagggaaagacaggaaaaaggagggaatagtgagtgtctgggaagggggccaagagtacttgcagccagggccccactgattccttgtggggcctctgaggtgcttttgtgtgctcctgtaggtcagattatccaaaccctagacttggaagagatcgatgaaattgaggaggcatacacaggtgagtggcagcccagtcgccccctccttgcatcttttagtggcaccggtgttggtggggaatgctcagaagttaggaaaagtgagcggatggactcacaaaaatgatcatccagacgtgtgaaaaggcaggctcatccccaaggtgcttaggttttgaggtgctggtcagagccctcctgccccatgttcactcacaccctcaccaccacggagcccattcatcagccaggagggtcccttgggtttcttgtaggagagacagttttgggctcccatgtgtggtcgagtccctggctgcagctctttttgaagtcagagaacttcacacacagctattctatgggaaagagaggacgcagggccagggaggggcagtggagaggagtgagtgggttggtaatgggtgtagggtcaggagcaggtgggcctcgcatctccctgtgctcatggcagctatgtggtcttgcttgtaatggagcattgtggactcctagaagaaactcttgctcatagtttaaaatccaccagtcccgaccccattgcccggtacatgtctgcaccacagggcctaggccctcctacccagcccactaggactttctctgtgtttcagccctacggcacatgcagagagactccaaccccacggtcagctgcctcaccacgcagactttccatatcctggaagccaagaagaagctgctactggccaagcccccaacctcctgcttctgcaggaggaggccccaaaggcactacttctgagcctgcatccttgagtctcagatgtaggcctggccattagaccctgtgacaatggggccagattcctgggtcctgcactagaaatggaggtgtatccctgcagaatctttgtaataaaaggaaaaagtatgcacctttgtgaaaatagctattatgttgtctttccagtcaattcttggccttctggggtagagccacttgtaagccgccttcttgcctatgcacatctgggttaggctgacctctccctgctctgcccctctgttcccttctcccattcagccatgggtctgaggccagagccagccatttcttttgaaccaacttcaactatgagccgagggagaagtaatgttggcacacatgaggtgttctagaatgcagttgtaagcaacagagtccactccagttggcttaagaaggaaagtgatttattaaaggattgttagtgaaaaacatcccagaagatcagagagtttgggtaccacagagccagggacagcgctgctctatagaaacaccaccatggctggcccttggcacagcccaaaccacaccccaagcatcaacactcaggcctggatacttgccctgcagtgccctgcctctgccagggcagttttgctttgttacaagcaatgataaaagatagatcttattaaaaatctattaaccggtcaagtgcattgggatgagacccactttaaagactgttctgacacccccacaagtcaccccctcactttggtcaagcataaaataatgaatacaaggtaatgaatgcatggaaagtaatggat

SEQ ID NO: 1229 - DNA, 321330 bp, Homo sapiens
gcagagaccattacagctcctggcaccttcactgcaaacaagataaagctttctttttgatcagatgtactcacaactactggtcatccctcacaaccatgagttgatcgtctgtcattgatactaggacatttaatgaaaacaaatgaagttctttgagcttcctggacagcatccatttcaagaggaagacaaacaccagcccagccattgtgggctggatggaggggtgagaccttaaaacaagcaaatgctcaatgttcatttcacttcctgaggattttattacaatatttagatacattcgagccctggagctagaagccttttctatgccatcagaattatttcttgtgatgtggccagttctcttcccgaacgtttcctaaataattcctccacctccacctcctctcccacccctcttatctaacttttggcataggtgagcagaaaagctcaaatgggaagtcagctcttagattcatggcttggcaagctggcctcacatcagaacagtagtcatgcagaaaaaccagtcagaggatgggaaaaacaagaccaaactatgcctcccatgtctgcttacgggatattagttatcttcaggaaatagttatttacaagttctgaagctcaaaacagtcaggaaaacagctgcttcaggtctctgaaggtcaaagtcacggcccagtgccaggaatgttatagcttatcttgcctttcaggataaacacagagaactaacttacttctcaggtgagtagcacttcagttacttgggtagaagagatgaacctgcccaccttgaacgttgaggccatggggaacagagacgattctaatacggattagtaaaggactgttgacagctgcaagaagagcaaagaaaccactgtgtttcatcagcagcatataactgcgtgtcccaaagccctgacccatagagcttactccccagtggatgctctagaaacatcctcatcttttgcccacagggcctatccacaacctggctctgcctcacatggccatggaactagagcaagtcctcccagatccatttttttagttaccaaagcagctttcctggtcatggagggaagaatagagacgaaactatcatcatagtccaggaatgggtgccctaggatgcttgggctccttttctaaagcagcttttgaacaattcttatctcaggaaactaaacccatggtacagtctgggtgaggcagaagacgcaagtgggaggagggacactgcaccgtgcaggcacccatggccatggctgctgcttcaagagaaaagtgtccagtctcttgggccacctaataaaggtttgggacaaattttgcccttgctgggtaagctcccagagggcagaggccatgcagatgaactcccaggcttgggcgtccctggcccagcaaccagcataggcagtagctcgagaatgcccagtgatgaactgtggtgtggcttggagtgttacagcttccagatgggtctcctggaatcaactgagagctgatgaggattagtcccagtttcaactgaagcaaaagctcagggtgccaattagtaagctcctatctcccagctttaaacccatccttctctcctctgctatgggatgctggggctgggaactgcaagcctgattcttgctttgccagatgctccctagtaggctctgccaagacaggcactcaagggagagcgcagggctggaggagggagaaaggacctgctcctttgtatttgttgtctgttcctgtgagcagcctccagcagcacttcctgcttgcttccttttcctcaggagatcacttcctgttcttgtcagcatcacctcacccacacttcgtcccccaggcagtgcaagtgcctgccaggagcagtagctgggtccaacttgcagctctctcaacatttgccaacaagcttcattgtgccctgaccctcagagatgccagcacaccccttcaggggccgtggtcccagccccacaagacccctccttcagctcagagacaccagcaccagcggctgatgtcccctcctccagggtggcctagtttcagtgctgtgggggcttttcctccatgtttctgcatattaataattccatgctcccccagccctaagggaggcagctgcttcccagttataacctccatgacaatttggagttcttgtattttttccccttttcagttaactgtaattattttaaattctctttaagaaaacaactggtgtgacttctacctcctgcctcacccatgactgatgtactcagtgtttttctctaatccaggcagtggcagggagcctggagttaacagaatgttgagactcaggtcccaattagctctgtcacttgggtaagtcagaacctccttcagatggttttacctttagagatcattttacattagattttgaatggtggccatgggcagagtgcagcctgtgtatgtgacagcctgtgtccagagcctaggtggacactcttattatgcaacctgaatttctttcggtggagcgcgtcttccccatttgcatctataatgtctgtctagcccccgaatggcccctggatccagattgttttcaaggctccttctagctctgacattcttttgtttccagccaggtgcaatgctgtcctgctcatgacctgtgcttttgctgggagcttggagaatgtctcacaaggcagtataagtgatgtaattgctcccagtcacagataaatgcaagaaataactggtcccccgtcccctgtcttggtcactctgagaagtgcagactcccgggaggtataaaacaacatgctaaagttgtgctctttggggtccttaggggctgtagcccattcctcatctgcagtggttattgccttaccagcagatttgctggaacaaatggagacttttcccttgactcgagcgtgcaacaagaggcttggccactggtggaagaacggttgtagttttctgggaaactaatagggctcctgccacctctaaccatcatcaggatccctgcctagctcatcaagattgcaccccgtgtgtaaggaagtggcatgtggagatgatgtggcatcctacttgatgtcaaaaagtagcatcacgtgcagctggaaagccctacagagtccagctcctccttcctcttgcttttaacttcaatagatttgtccctgggcaagagctactcagagagactgcctttgaaggatcttcacttccaccaaaataaacccttgctttagtatacactctgagaaagaaggcctttgaggtggaacagctgtgagcattgtcagcataaaggagaaggtgtgtgggcctggctgtttgggaaacacagaggctgcagtgaagctaggtacccctctccctgcctgagcacgacctgccacccgcatcctgctgcaacttctcctcacctgagatacgtcctcgcccctcagggcctcttgcttgtgtgggaagctgtcactggctgcaaccacggccagtggcaatctgtgccccattggtgaagatgccattgggagggactaggaggaccttttctgcttgcaccaaactgagaagttagttcactaaatgttctagtgaattaacacatgaagcacaattgtccttttgactaacagcactgagttcatacaaactggaccatgctgaaattttttggaggccctaggttaggagtattgttactgaaatgccagggttttggtctaggtcctgttgcttactgcacagaaagccaatcactgagatgagtactgccagggaagaaggctttaattgaatgcttcagcagaggaaatgggagatcagtctcaaatccattttcctgattgactaaaattagggatttatatagcagggaagaaatgtagccatgaaacagaaattagggagaggcaaggaagaggggttgttcaacaggaagcaggtgatcacttgggtagtcatgctgggtgaggggtctacgtctcatggtccagatgtggtgctctggtgaagtccagcttcttgatgccatctgggaggtctgatggttggtttcctgagaaaggaactcagataagacaaatgtaactttctcaagttttaactctgggaggatcattttctgtttattcaaagaaatcatagacatcagttctatgggaccactgggctggtttcagtatcagcctatgagccatgtgctccatagaaactgacctgcttcactgaaccacacacacttagtgtggctgagctttgtgttctattccagcaaaggggttctctgtaaacgcaaggcatggattgagcaacccatttctgatggccccacacagacacatcatattaacattaatttataggccgtcctgttgaatctaaaaacaatcttttcatttatggacggtaccgagatgattatgttgaggcccggaaggtacacagattatctgatgcccaggcatcctgggcttgaggacacaatgcttctgtgcagttgctggtctaagtcataaactgagccccacagctagcacgtagctttgtgacagctgtgtctgcatggggcttttgtcttctattcacaaagcaaggattaggtaggagcccaaagacagggcgggaactttacttgggcctgctggtgctgcagtacgtaagttggacacaccgcagctgggcatctgagggtctgaggagatggtccttctccatggcaagagcctctgaaatctcagagctccaaacgcaccaaaggtcaaagaaaaagagcagaacagccagcccctgcatggcgcaggacagcactctccgctgcgatcttgtccttccgttgttaatatttaattcagaagcttgtttctttctccctattatgtgggactttgaaggctgagtctcagctgtcatatgcccttatctctcctcccccagagatatcctgaaacagtggtagctaatgggaaaacatgattccctttacaaaattctggtcagcaacctttcaggcgcctttaatctggcctgtacctgcctctccaatcccacgctgccctgttgttctcttcatatcatagccaggatgggtgatttctgccattcaaggtcttttctcaatctggggtgatctctctggcactcaattctcatctcttaggtctcagcccaaactttgcttgccagggagactctgagcctcccagactagagcatttccctagcacatgctccccagcatccttgacttttccatcatgacatgtatcacaatttgcagtcatacagttgtgcaattattggtccatgtcttgagtggaatgggagctcccagagggaagacctgtggccatgatgcccacgctgcctaccgctgcgtgtccggcactgggccctgggccacgatatagaagacattcgtgaatgtgtgttcattgactgaatggtggattgcgggtccctgatgaggagccaactcttctctaacaaggagtaagaaggacacagccagcttgctctgcactctctgtgccatgctccttctcaactaggtggccagtggagccacaagaatggccagagttccttcccctctcccactgcaggaggaagagctggggaggcggccatgacatgaatcaacacaggtggcttcaagtagggcaagtgtcctccattccttatgaactttctcaggccaccttcaaatacccttgtcatctcactgtctttgtccctcccaactcccagcccccagcccccaagggttacagagtgagagaggggccatggggatggcaggcagggaagaatggcacacggcgtatgctcacgagatgaggacccaagctggggagcaggcttgaggtgtgcggtagaagatcctggctggcaccggtgtcttctgggcagagctgtacacacgggcaagtcttccgatgcccaactcgtccaagttcttcggataagaagtctgaaagaatactccagttcccaaaccctgaagggaatgctgcactccttgaccagaaatcctttactaaaaacaaactacacataggtgcgctgagagactgttgctctagaaggcactgaaaacccttcataaatgtaaacacggcctttcccattcacttgtaagggataagtagccagtattttaatcactctgcagctgaaggcttgcacccactgtgggtcaactcttcgtattacagtcattgaaatcaaacttcaaacaccacaccaaaaagtcatttgtgatggcaggccaccccactcctttctcatggcttctagcttgtttttaggagaaaagctaacagagtttagaaatcaaccaaagtgcaattttttttaaacccttaattaccacaaactggtatttcttattgttttctgtgattcttttctctggagattgtcccggcagctttgacagagcagttgcagcccaccctccttccttccttctgcaagagtgggaaggaacgctggagtcacaggaatagcaaaccccgaggctgttctccagtgagatgctctcaggcacaactgtaagtgctactggaaagacacaaacacttctgcaaatgttaattgtgcataagaatactggacactttgaggaaaagaattctgctttcaagcagtgatgtttaattatatttttcacattttccccacaggatttaatttctggaggaaggcttccctctttctggtgatatgtcttgatgttaccaaaccatttcctatatttaatcttgtggggctttctgcattttcatttatgcatttcccattttgtacccagtgcacttccccatctttgatgcttagcgaaagatagcttgtgcatctttttgcaaacatatccatttgtctctctctgaatggggaagaatctgccttttcggcaatggagaaggggaaaaccaagtcaatgaacttcaaattcgcagtgtttggagaggtaatccttaggaaaaaacctcattatttcattttcaaatacaagagtatatttcaaatgaggacagtcaaagaaaggatgttttgcatttagtcaattttgcaagagtcacacaggagacagctttctagaaaggcatggggtaaccttgggagatgtgccacagcctagtgcccagagttcccggatggtaagtgcacgcatgtgctatttgcaggtaacaaggatgaactcacatccttcaaccccttcagttcagtcaactgcctttttgctccttctaccattttaaagtttaacagggttctactggatcccaaattatcattctcaaggtaacaccctggtcaacattaacatcacccctctaactcaaaggtaccactacgggatcaatttgaaacaggatgcttcagaaatttgtaataatgggcaacttttgtcaatttggaaataattccctatgtgcaaagttcaaaattgtgtaccacagaatcatttcctatctaatgaactgtcatcagtaaaagcagtctcaacagaaaaaaaaccaaaaaccaaaaaacaaacaaacaaaaaaaaaaccaagaaagtcaatagccaggtcttcttgcatgtgaaaaaggaggaatacacaaggtttaatttgcgagaatgagtctctgtagattaatggtctttaattagttttcccaaaacctaaatcacctgtcatgataagctaagtaaaactaaagcagttaattttgccatctcactgtccttgtcccttccagcccctagttaattttgccatggatttattttgcctaacttttctactccccttcttttatttaacatgaaaaaagaaagacctttctgataaagtcggatctgaatcactcctataggtgtgtgtcagattatggaaggagaagggtctcctgcggcagagacgttcaactgtcaactgatgacacctcaaggcaacattttaatcaaggcaacattttaggcatttataaacgtcagtgtacttgaaaacctaatgctactgtttgaagcatgtcaggcctgaagcgctatgcacattctctttgaggggacaaggcaagcctgtggcaggctcagagtatcagtaaggagccacatccccttagcacgtggctctgcatccctgactgcgcacctgaggaaatggggtcttgtggttttgtgctgcaggagatgtgtccagaaaaaaaaaaatcttgtctttaaaagttgaatacagaacaccaacgtgaccctgcaccacagctgctccccaagggtgcctccacctctgagtctatggcatgttctagccgtgaaagcttttggctgcttctgctcagacttggacacatatgctgtctacagctctgagtagatcagggaccaaattgggcagaactagctctttctgcatagaattgtaaatagaatcggccctggggtgggataccctgtttgtgtatcttcaaatcatcccccattatgagccacagaatcttctagatgtcagtcattggggaagccagcatgacttggttactccctattcatatgccaaaattaatcacgaggttaaatgtgaatctttctaattcagcaatagcaaggtctgagtgggaactgggcggaaggttacaataccagtgatatcaacaaatttggtgcacatatttatcatgcaagcaagacctaggagtgaatgtcaaaactacttaaataaaaaattgtttaagttccttagatttgtccaaccgactgcaaaagtatttatgttcatgacacttcaatttgaattgcctaaagtggtcagcttggcgttactttgttatttgatgacttggaagtaataaaatatccatttgctaattttctttcactcttttaaattagtccaaatcaatggagtttccatttgttatcctaattctgtcatctgtcttatcttcactccagaaaggaattctgttgtttagatgtgacttttcatttgcttttcaactttccctcatgttttattcagaatcagctgcctttaaatcagattggaagtatgtacttcacgtacacatatgagggactgtaatgagtccgaatgacatggtttattcctctgctgtaaccatgagctggaatgaaactcaagagaccatccagtaccacagcttcattttcagatggacagactgaggcctagagaggcaaaacgactcccatgttatgaccggccttggccagagcttgctagtagtactcaaactccaaactcaactataattacttaaggtgaggattagaatagaaggatcttctgatttcagcacttcttacaaacacatgtctatttattcttgccaaaccttctgtgtgattttaacaaaatgcttaccaggagcctagtctccaataccggcctcaaaggccaagagatagattatctggtcagtttgaagagaaaccacttagtttactcagcaaatgagggaccatctttagggcttaagactcctcttaaataaatgacctatggttaattattatctacccagctcttatcccttaatctctagtttgaaattctctggtagtaattgctcctaaacctattcctgtaatcacaactgcagacaaaagcaggtccttctgcagcaaaaatgtcctcattttttttcacactatactatgatatttaattagtgcaatactagttttcctccttatagggataattgcacgtttatgcatatttttcaggttggagaactttgttgtgaaggcattctctagaagatggaatgcaaacatgttctgttaaccattcatttacgacttcaatcattactatcactgcatcttctgcaacacaaatgctgagttatacattatgcatatttccaagaacattagatcaatgtttaaacagactagtatgaatgatcatgttacagacttaaaataagctgagctacagggtagatgccataacttcatttaatattgatagcagctcaatttaaattttgaaaaagcaaatacatttaataaaattggtgtgaattattacatattttgatggaactactgtacagaatgtatacatatataaatctatagatagaattatatacatttgagtatataccacatacatattttttccactcacatttttctctttagtaaaacaaagcagttttactgtacacagaagtgcaatgctacattaagtcctgagtaatttaaggtatcattaataaactgctataaattctagttttccagccaaagatccaatagattctgtaacaaaaaatgtgaataatacttaaaaatatgcatttagctttgcgttcattttgtgcttagcagaaaaagctcaagaatgcacagtagccatttagatttgggagaatgttcttgaatattcaaggttaaataaatatcctaattgtagggatttatagaagttttaagtaatgttgtctacatccaatttgtcaagcatggaagactacagtcatgattggatcaaaaaatcccttttgcagaatatgaaattctgtgtaaacatcagtgtttgggttttatataaaagttctgattcaaatgagggaaaaaaagaaaaaaatacaatgaaataatttaaaatgcttttcttggaatatagccagccacatggaagaaatataaaaaatacgagtatattttggtgaaagaggaaaccagatgaaagtcatttaagggtggtctggtaagccacccactttgggaggtcccaggctggctgggctcagggaacccacgatggcccaaccacatctatcttgccacaggggacgaactttgctgcgcagtgagaaggaagcactgtgggaaaaggccacgttcaaccgcaatggaacggtaacggctgcctgtcagggccacatcagcaggcagagcatcccatccccaaactcaggcactaggtatggaaacgtgaggtggcccgggcccgctgctgcatgtctgtcttcagcaggaggaggcagacccggatcctcgcatgggggagctgccctgcatcggagcccgcttcgacgagaaggcactgctgtggtggttcctccatcacccctggctctaccccgtcccgtggctgctgtagtcaaagactcctttcttgaagaatggtgaaaactcacaaatggtatgtttcgagagagtcagtcccactttgttgatgtggaggggagatgttgcggactggagcatcacgctgaaaaagtccctgaggtatttctgtggaagagacaagagttaagaacatggtcaattgggaggtcaaggcgggtgggatcgcttgagctcaggagtttgagaccagtccaggcaacatggagaaacctcatctctacaaaaaataaagaaattagctggacagggtggtgcactgaggcaggaggatcacttgagcccaggaggtagaggctgcagtgagctgtgatggtgccactgcactcctgcctgggtgataaagcaagaccctgtctcaatcaatcaatcaatcaatcaatcaatcaatcaatcagaatacggtcaaggtactgttggatggtgtcaagaagagaaaaaatttccagaaacaacttcccacccacctggaaagtgctatcattgtcattaaaaccagcacgtgaggaatgccctccactgtcccacctatcatcagaccaaccagagaagacggagtcacaaaatacatatgcacagaagaaatatctttggctcagcactgattctgggcagcactgtctcagatctacagcagacaatgcctaggaaaatgtcaagggtgccaggcacaggggatctgcctctcagccacagtgtcactagttaatctcttatttaaaaaagtcatttcctccccgctcccagttactcattaaatagaaagatgattaaaaaaaaaaaacaaaaaaaaaaggccggccatctgtacaaggttaaatgtgctgcttactggtattttaaaattgcacagtcagtatctgttttgaatccttcttataaaataaagggaaagcaatactgaggacaagagggtcagttccaagtactgatatttacagatctttttgcatgtcctataatcatcaacaaaaaggaatccttactacaattacttgctccagacccctgctgcatgtttgttgcaacattatctgccgtttttggcactgagaaagcaaagcatatgtgagactaggctctgggaactggggataaaatcagatgtgggagctggagggatgtgttcaaggaaaagagggcacacaagaatagttaatatattttaggccaggcaaatctcatctgtaacagaaaatgggctggagggaaggggttagacccaaacctttattattgtctcagtgtgcttaaaaaacccaaacaaccctggcacagtcttaggaattacacataataattctggactctgagtaacaacaaaaaatttgtgaaagcaacatggcctaagcctggagcagtagttcccaacaagaggcagttctgccccatagagtgttcagcagtgtttggtggcagttttgagtgtcacataggggtgcacaggcagtgcacctggtggatgctggccagggatgccaaagcacaggacaaagaattatctggcccaaatgtcgacgatgccacagttgagaagagaaagtagaatttagctacctctatgaattgccaacctgaaatttccttctgaaagaagacattctactcaacgagaatttgttaattctccttcaaaatattaatgaggactactaacaacaacacttgtaaaataacttagtttctaaaaatcttctaacatccaatgttttacacttaatggaagtaaaactggtgcatgataaattgtacttttttttttttttttgagacggagtcttgctctgtctcccaggctgcagtgcagtggcgcgatctcagctcaccacaacctctgtctcctgggttcaagcaattctcctgcctcagcctcctgagtagctgggactacaggcatgtgccaccatgcccagctaatttttttgtatttttagtagagacggggtttcaccatgttggccaggctggtctcaaatgcctgacctcaaatgatccaccccccttggcctcccaaagtattgggattacaggtgtgagccactgcgcccggccagataaactgtacattctttaaatgtataacttcatgagtgctgacccatgtgaaaccaccattaaatcaagataaatatttgcatccccttcaaaagtttcctaaggcacctaactttatgttatccttacacttggcctggaatcacatcttcttctggtattacccatttcctggtaaggaagctattgccaggagaggtgagcaaggctagtaatctagagagaagacttgaaagcaagtattctcaactcaagatgttttttcttgttccatatccctaacttactggtctcatggtaccctctcaagaaacgatcctgaaattgaaattaggtattggtaagaagttatgaaaatcaactgctgaaaagtgaagatcttaatcttagtaattatttttatcagaggggcaaagagagacctgacttccacttttctgcgggaagggaccctgagaatatcaactttaaagggacttgaattgcatcaaacagggtcaccagtatatatcgtagactacactcaaccagccaatgctcgcggtgcaatgcatgtgcacaactgattgttctgggaagatcaagggtgagatgatttggaaaacgggagatgcagagcttgctgacttgtgcatggagccactgctctttcacagtttaatgcatgatagagcaaggctcgctgcacaggcctcatctcaggtagctcctgtgggctccggcttcaggtctcccacaggctgcattaacaggcaggctgatgtttacagcaaagctgacttcaagatgaactctgacagactggaaggcaatttaaatctgggagcagatgttatatcagcatttgtcataattagtacacaaagtagggtccctataaagggccaataaagcctaaagggtataataagaagagaagtaaaagttaaaaatataaatgaaaggaaaagaggaagtatttgagacacctcccttcaagagcaccaccataagaagagaacaatacaactgtcaggtaatgtctttttctttaaataaactcattagtgttgtttgacaaaaactccagatagaatgatctgatttgactaattctaaacattacagaagagttttctcttcgcaaaacaaatttctgcttaaggagaattaggcagctttcgcctcctttacatagcctgcttccttggcgcaaagaaatgatttgattaggaagcgttctttgcagcgacctcaaagtgctctaaagtctgttaagatgaggcatgacctttgttggccatgtccagagccacatgcttcaaatgggctgaacaaattctggcaaatgaaaaaaaaacaagggactggggctacagctggggacacaagacagaactagaattctagaaagttcttaaggtcacagacagtgtctcattcttctctgaagccccctatcatccctggaacactgccaagcttaggaaacgtgctgagaggaaaccttgctgattttaattagttatctttttttgaattaaagtatatgcacagaaaaccacacacaagtgtacagttgaatacagtttcacaaagttaatatatctatgccatcagcatctagatatgaattatacaacacttccagcccccaggcagccctcctcgtactccctcctccggtacaaaccttccctcaagggcaatcgctattctgatttctagcaccagagattcgaattgccagtttttgaacttcatatgagcggaatcatttgggatatactcttttgtgtctggcttccatggcttaatgccgtgtctgtgagatgcggccatgctgtgcgcatagctgtggtctgttgagtaccagcactgtgcagtacttcacatctgaacaaaaccaccgattggctttaacacagggataagcgttggtcaccgctttggtcctttagtctgaactcttcttcactaatgaaatctacttcccaatattactggtgtctgatgagtcaagtttatcactatccttccaataaagaagtttcctgtagagatttacactcaaatctaagcttagccaatgtacttgaactctgctattttatgtacatattatatatatatatatatataaaatatttaaaatatacatacttacctaacaacacacattcatattagtaatttttattgcctgtgctcacaatgttttccacagcatctgtggctgaagggagaaaattaaaatccccctgtcaaagctatcccttgttgttgaccccaaagtcaccgtagccctcccaggatgtgaaaaatcagtccaggtgtcaagctgcatctccccaggtcagcacgctttataaaagagcattgcgaaaactgaaggatattaggagtttaagtgacttatccaggtcagaagggcaaagtgggaaaaagatttgtgaaatccaatatccaatctgtttctgactttcacaggacattttctccattataaaaagaaataaaagcaggcgtatttaaatctctagcacgtcagggaccacagaaggcctgcagctcttgttcacctggtggacagtgacacacctgagtctttgctttgtcaaatgtcctgtgtcagggccactgagaacagcaaaagcacctcctagggttgcacaacattatggccctgacttggatagttggaggaggaaagtcagattaaaccaaatcttctttcaatacgattgcaaaccagaaataagatgggatggcggagccaaagggggcctaggagagggtctgtctgacagtgagtgatcatgggaaagagaagaggccgagagagacagggggccacagagagacagagggggctgtctaggggaggacaagagaaacagggctgggatggaggggaagacaaaagaggtggaaatgaaaaggaaaccaaaccagcacaacaacgttggagacgggtacccatgatttatttgtttaccaagctggcaaaaagaatttaagaataataagaaatatatcagatatctatctaggttatttactttttgtgacttggaccaatactgatgtaggtgttttcttatcaatactttcagaaaatcaaatttagatggctaatctttacggtatatttcagtgctgacatagagtacctcgatttcatgaattgcctttcttctataggttttgggcatattttgttgctcaggggcagtgagcaggggttacaggtaactgggagacatggacccccatgggtctgttccaaagaaagtgtgaccctggcacatgatgtttaaaatctccccaaaacaaacaaacacaaaatcctgtacaggactatgagcttttaaagtggaggccagaagacacgagcagaagaaggggggatgtggtgatatgagagacaccctagactcaggctcctgcctgctacccacagcacccgccatcccctgcttctcagtcaggtcccctctgctgagccacacggtctctcaccgggcaagtctgtctacaccgggcatcttagctgcttgggtcagatgcactgcctttcctaggcctgatggtgctttcgtggggaccagcaggcactggttcttcagagttaaaagttctttacaaacacggggaaggtcctgtttctctgcaaggctcacgctcttctacagggagccaaggcagctcagggaatgcttcggtatctcccttacagtgccttggtgggcactggccattctctgactgccctgtacccatttcccttcccaaacagcagcccaatccccttctgaagaaacacctttcccctctctgggaattggttaactggttgacttaaggcataggacagataagcttttcccatgatattctgggtggacaccttacagccaaagagctaatcaagctactagcgcttggagtctcctggaaccaagggtcctttgggggacacctcttccagattgtgtagctgctgttatggagcattttcaagagtttgagaaattcaggaaagctgggcagtttcaggagagcctttggtctctgtccattcccaaggctaggagcgaatgattccatctgtttactgtggtgacagtcattttctactgtttaccatcaagttaactaacaataatctcacagcgctggcagggggcagacaagggtcaggaatcagaagaaaccttccttgtagaacacaatcaagctcctccagggctagtctatgctaagatggaggtatctgcctatcacgctcttctcttaggaaaaggtcgatcctaggaggctctggagaatcacatttcagataggtcagagtatcccggtggtccatccacagctaggcctgaagctggaaggctcctgccccagaccctgatctacacatagcccaatctttaaatttccaatgccatttcaaaagacaactactaaacactatcaatcttttgaaccaaaacacaggctaatatggtctactggctgtgttaataagttgtgaaaggcaaaatgaactccctacagcaatacagagtaattcagcaagaatttagtccattatattagagctttagcatggcacctcaattagtttatgcatcaggaaaaaaaattgaaaatataatttgctgctacatgctattccatttagacattcttgaaggtcattatattactatgattcatgtgtgacctacaatacaatttcagtctgagctctgcctgaaaggaaacatgctttggagttactggaaaaatgtgggcaaaatctggcctttaggcagcttcttttgggtttttcttttgaactgtaaatcttttgggtgaaatgctggtttgctcacaggaactaaccatggatttcatagtccatcctggcaaaaacctgtgaagtcaacaaggagctgcatggtgtggcttcccccctctcttacacccattcccttttaggtctgtgaccttgaaagaaaggacaattttagaccaggggatggagggaaggaggggtggtgtccaagttcagctaacagtctgagcaagagagcaaggccaaggccagcctgtgcaaggatctgggtgggaaacagcaggatgtgaagcagaatgcagagggccttgaatatggattcagcctgcaggtacttcgtacaaagtttccggttcatgagcttatgtgagcccctaagacacccttaggagagggacaagaatggatgtcctttgtttacagaggaagtaactgagattccaaggggcagtgacttggctaaggtcaacaggtcataagaggctgacaaagtgaccagctcttcaaatgtaggagaaagccattattgcctaatttaatcccgaaggttcaagcccgtaagcctgaaatgtaacatggcctttctttggggctgtccatactatgcacatgcagcctcccagaattttccctgaatttcagtcaactgctgcgcgcgcacgtgtgtgtgtgtgtgtgtgtgtgtgtgcgcagaaaatgcaagcatgagaatttgggccttcagatgcctttgaaagacctaagcctccttatctgctggctctctgccttctattttaattatcagggagataaaattgtgaccattttatgttattaaaaagtttctgttttaatagggctcatgactataactgcagcctactgcttatttcatgtgcaatatatcacctcatccatatcattctaatgatttttccggccatctcattgttgtgaggtcctctttattttacaaaattttaacataaatctataatttaatttaaagttactgaaattactaaaattgaaatgttctttaaaaatataatggaactttatccacctttccatagtgacatattaacagagaaaggagttcagtggcattcctcattctcagaagtcattaaccacggtggcggcttaaagacaagtatcagtctagtaagacttagaggtctcatttaactcgcagtacttggaaaatgcatcatccactgatgggccctgaagatggatcaggcctgaatggagctactcagggatgtttctagacctgaaagagttcaggtcacccctggctatgtatcacgcatcgacccagtgtggtcaatatgatccatccagtcaagtcttcccaattctaaactcccataaattcaagtctaaatacctcttgttggctttttaggaatcctaaagtttggctacactgggtcaaataggctgggttccctttccaacatgctcccaaatgtgctccacactccaaggaaatcaggacagcttggtttgggtaactcatccatccagcgcagtcactgcacacgtgttctccaagaagcagtaagccaggcctgggtattgagctgaatgaaacagacacggtgcctcccctcctcccctcacaggtgcatgctggctggcaccatcctccactgctcagagtctctccttgttcccatgggtgctttgctcccatcatctagatccttctcatcttccaaggactggttcaaggtgtgctgtgtactgactcccttctcttcagacttcattcatgcacccaataagtacttactgaaagctttctacacaccagtgttgggctaggtgctgggcattcttttttttctttttctgtttctttttttttttttttttgagacagagtctcactctgtcactcaggctggagtgcagtggcatgatctcagctcactgcaacctccgcctcccaggttcaagcaatcctcctgcctcggcctcctgagtagctgggactaaaggcatgtgccaccatgcctggctaatttttgtattttttagtagagatggggtttcaccatgctggtcaggctggcctcgaacccctgacctcagctgatatgcccgcctcagcctcccaaagtgctgggattacaggcatgagccatcgcgcctgacggtgctgggcattcaacagctaatactactcagttcttgtgccaagtaacacagtcctgcctgcctgggagacaaataggtaaaggagtaattacaattaaaatatgactatgagagaactgcaatgaggtgacttgggaccccaggggaaaggaaaggctgtatgcctagtcctgggaattggttacttttatgccaagacccatagggtgatgagaatcaagcaggtgaagacattggagaaagatactggaggaagcctgttctgggcagagcaggaagcaggtaccaagcctagcagctgggaggcagggctttggggcatcaccaattgtctagcgtgactagaccaggcccacaggcacagagcattcagcagataggacagactcctgggaacaggactgctcctggacctgggctctgccagtccccatgctgggggccctacacagttgggtggtggcactgtgcgctggtggtggtatctcttctctatggtgaagtcctgccaggccttcaggaagtctcttccagctgccatacacaatcgttggtcaaatgatgcttatgatgccagaggactttcacgagtctccaaatgttaatccccaacttctactgaagtctaccacttgcccgaaggtacttgaaaccaccataaaacgtcattggaacctccagtgtgagactttcattgtgttcattgcagcaagtttggtgtgccgacacttgcataccttttcccagcctctgtcagtctaactcagggcagggcaagctttttctataaaaggatggatggtatactttgggctttgtaggcaaagaggcgaaattaaggatattatgtaggtgtttatgtaataagagagaaaattccggctccaccccatcctgttttcctggggtgggctacccagggtggaaggcgcattttgcacccagtgctgggcaggccactgtcatggtcagtttcacgctctgcctggtggtgccaatcctagtgtgcctccctctttgcacagagcctggcaatctcaactggggcagctgaccagaggcaagacaacttcccagactgagactctactgcttggtgactggcagttgccaacaagtccccagtgtgtaggcggtgaccagcacaggccctggggagcagcgagccgtggctgccagctgagtgccaggaaaacaggcagtgagcccgccaggtctccatggatcacaggtctagcaaattcaggccatgctcacagacagtatgaaaacaggtggcaaggtgggtgtgacctgagggcctatatcagttttctacagctgcacaacaaattaccacaaacgttgtggctggaagcaacacctattcattagctcatggttctgtgggtcagaagtcctgccacagtgcaggtagcctctgcttatggtctcatgggttgaaacgaaggtgttaaaaaggctgggctcctatctggaagccctggggaagaaccacttccaaactccttcaggttgttggccaaatacggcattctgtaatcacaggactggggtcctgcctgaggttcccttgctgactctcagcaaggggctgctctcagttcctaaagaccacctacattcagtggcacccagcctccaccacatttgaagccagccatcagattcccttcacgcttctgcgaaagttgtaagattccaaagacagtaacttgtgtcaaaccctggcaagcggagctggggaaggccatgaagagagggctcgcatgcttgatctgcctgatcacgggaactatcacaagacatgagtcacaccaggacagccactgggacaagaacagctagctaattacacaggaacacctgcctggcacactgttttgcaagccaatctaaaactgtaaggacctaattgtacctccaagattacaggtcctacctggcaactactgatacttgccactcagaacttgccagcccttgcaagctgccaccagcaccataagctttctttcaaaacaacttgcaaacccttctccttccccagtaagcctcaaccttttactttttttcctggacgttgccagaggccaccctggtctgcatgtatgtcccggattgcaatcctctctcttgcatattatcccaaatgaaacaatttttactttcactctctcttttttcacactgacacttcaaatctccgcttcctcttctgttaccaggcagaaaaactctgcttttatggggctcacatgattagattaagcacacagggacactctccctttcgccatgtcgtgtagcacaatcacagttcctcacgagctcaaagaggggaggattacaacggcaccggggggtcattcttagaattctccctactacagaactgtagtttgccaatccctggtctaaactgtaacccagaatataataaaacatatggcagaaaaacaggccacagcacagtagatgccacctggcagagaacacaccaactcaagagggaccacgcatgcacactggctgggaacacccacggtccaggcctgagactcagggtgagcacgcgccctcccacctcccgcactcacacccacaggcttgtgctgtgcccagtacgaagcatcccagagcagcaccatcttctggagctttctgagaggacggaagtgtctgttatctgtgctgtccattatgctagccatgtggctactgagcacttaaaatgtggctggtgagactgagaaactaaatttttaaaattttaccttgattttaccttaatcttcatcttactttaaaattaaatagcaacatgtgactggtggctactgtactggatagcacagttctacactaagattctggagtaaccatgccttcaaatgtgtgagttctgagcatagagtatgcattaatattcctgtttttaaaatttatttttaaaatgtgtaatactttactgactgaaaatgccatacacacagatatttatgagttgaaagggaacttttcattgtttgtacatgcatgtgtacatgtcttcgctacaatgaaaaggattccttccaattcacctgtgttttcccaaatctccagtgcatccaaaaaaatttattgttattagtttttttgcgtatctttctatggcattttaatgcctacataaacaagtacaaatatagacacccagccaggtgcagtggctcacatctctaatcccagcactttgggaggctgaggtaggtggatcacttgagaccaggagtttcagaccagcctgggcaacatgctgaaatcttgtctctacaaaaaatacaaaaatattaaccagatgtggtggtgcacctgtagttccagctacttggaaggctgaggtgggaggatcacctgagtccagtaggttgaggctgcagttgagccatgatcatgccactgcactccagtctgggtgagagtgagaccctgtctcaaaaaaacaaaacaaaacaaacaaaaagcaccaaacccccaaaccccacaaacacagatgcctccatttcaacttacacaagcaggtacataagcaacatactcttctgcacctcactttgttcacttaacaacttacactaaagacctctccagaagtacatagtttctcattctgaaattggttgtactagctcattattaatgaacacgtaggctgttctaatcctttgcagtcctgcaagtaggtaaactatacatggtcgataatttttcactactttagtcgaatgatgtatccccagaacttaacacagtgtctcgtacacagtaggtactcagtcaatatttgttgaatgaaataatgaagaatgaagattattacaaatagcactgtaataaacaatcttatatacaagcaagtgtatcactttacccatagggtaaattcctaaaatggaattgctgggtcgaagggtatgtgccttttaaattttgatagatattgccaaattgttttccgtgggcactgtacaatttatactctctccagcagtgttggagagtagacatccaacatttccgtctgagtactccagagtctgaaaaaatctttgaaaggtaacctagtcctttctcttatcctcataaaatcacaatgttgttgtagctgaggaatcttagctagatcctttgaactacagctgagagaggttggattagaattctagtatccttaaacatcgtcatctttctcctatacttattcatctctctgggcagaatcatatcacaattgagattcctaatgtccagaattcccagaatcatttaaaaataaccttagtctaagagtggaatccatttctgcccaatacaaacttccaactaaccagtacaaggtcaagcagaggtgaagatggtcataaacaggcagctggctgggacagtggtacgtgtgatatttgctgtactggtggccccaatgaaccacatcatgcttcgtgggattcacaccctgtgtggctctcttcgttaaacctaggtggggtttgtgacttgttttagccaatagaatgcactggcactaatgccatgggtgacttgagagccccagctgagcctagtccttagtggagtcatgatcaaaatgcaggcccataagtggcgtgtcttgataccacctggagtatataaaccatccagctgggccctgcccaaattttccagaaccaaataatgataagcaataaaatggtggttgtttttaaggtgccaagttttagggcagttcattatacaatgatagataaccaaaatatatgggtttgggaataaggtaaaatatgagggaataaatgaaattagtcaaagcagaatgaaaaaagtttctttggtttctatttataatttatgactaaacataaattaaagtccaattctacttcatgccaatctctcttccaattcttttaatatttctaatgaataattcttagcaggtatttctttgctatgagctacttttgctatactaagttttaaagtaaatacttgaaatatggcatttatttcttgatgttatagagaagtctgagagctccaagttaaaattcatcagggtgaaaatgttagtctgtgattacagaatcagaactattcattacggctattcagagaatcttctttatgagtttaatgacataagcatattatactgaattattatggtactgcatcaactggattcataaatttaatatactcagtctggttcacatattctaataaaatccagcaagctttaaaacttttataggaaatgtgcatttaaaatccatgtgatattcagtttttacagggtgacgtccttgctcagggtattaagtagtttcagtgatgacgatgacccagcctggcagcaagcttctggggaaacctcacaaatagacaatccatatcagaaaaaccaaaacctgcttttctccagagcacaagtcaaaaccatggggtggaggcgggtggaaagagaagaattgagtttatcttgcacctgtggaccagaagtgaggacatgtaaggaaggaggcaaacagcttccacataatctgacaggtgccactcaacctcacttggttgaagcagaaagtgggaggatgctgggcaaggagcccagttcccagtactcactatggatctttgacctactgatacgtttgaatctacataaatgtttggcaacaagctcaatatagatgccattaggactcaacttcttcagcactggaagaagcctaggagagccctggaggcacactatggctgtttgagctctaatgcagcaccatgagcagggatcctaggcactcagtcttatgcagctaccatgctgggcacaaagacatcaaagcactgtggtttgaagtaagccccttaactcctctgtacctcagtttcctccttgtctgattatagtattttctttttaggattagaagattaaaggagctattgtctacaaaatgcttaggacagggtccaatttagagaaccttagtaagtacagatgtatggtatgtacctcagtaagtacagtatgtactggtgataaggttattgggatcccatcataagtggaagagcatctgtatggtatgtaccttagtaaacacagtatgtactggtgataaggttactgggatcccatcataagtggaagagcatctgtatggtatgtaccttagtaaacacagtatgtactggtgataaggttactgggatcccatcataagtggaagagcatctgtatggtatgtaccttagtaaacacagtatgtactgatgataaggttattgggatcccatcataagtggaagagcatctgtatggtatgtaccttagtaaacacagtatgtactgatgataaggttattgggatcccatcataagtggaacagcatctgtatagtatgtaccttagtaaacacagtatgtactggtgataaggttattgggatcccatcataagtggaagagcatctgtatggtatgtaccttagtaaacacagtacgtactggcgatgggtttattgggatcccatcataagtggaggagtatctgttcttagtaagtacatactgcagagatgctcctccacttatgatgggatcccaataaacccacggccagttgaaaatactctaagtcgaaagtgcatttaatacacctaacctaccaaacatcatggcttagcctagtccaccttaaatgtgctcagaacacttacattagcctacaggtgggcaaaatcatctaacaaaaagtctagttagtgttgaacatcttatgtagtttattgaatactgtgctaaaagtgaaaaacagaatggctgtatgagcagtcaaagtacggtttctactgaatgtgtatcgcttttacaccatcgtaaagttgaaaaatcttaagtagaaccatcatcaagttggggaccacccagagttgatactgtctatataactttgtcctcagggaattgatatgcaaatatgttaattttcccctcttttaaatgtttggaaacacatgggcttaaaatgtggaagtgtttaatgttttctccttcaaaggaaagtaaaagcaagaatttgaaatggcttttttccaaatcacctcatatcagatactggcagaccctttaaaatcacctcatattagatagatactggcagaccctttatttaaagagttgtgttaaggccgggcgcggtggctcacgcctgtaatcccagcactttggtaggccgaggcggacggatcacgaggtcaggagatcaagaccacggtgaaaccccgtctctactaaaaatacaaaaaattagccgggcgcagtggcgggcgcctgtactcccagctactcgggaggctgaggcaggagaatggagtgaacccaggaggcggaggctgcagtgagccgagattgagccactgcactccaacctgggtgacagagccagactccgtctcaaaaacaaacaaagaaaagagttgtgttaaaacaaagaagagtaaacatgtttcaaaatggaaaatcacatttaaaaataaactgaaaatctaacccatgtcaggtaaattgattctaattgattctcccccatatcttgttttaagatacattttagatgctctgattctcaaaagtgccatttggaaaacaaaaaagatgtattattttctttgtttttaagctcatggttccttccttcactgtataaaccttcagagattcctggcatttggagatataatgactgctccaaacgaccaatttgtctgacaaaggctttcaaatgagaatcttgctgtgtggtacctcttggctataatgtacttgaattcaaattcaaagaatcaggacctaaaagactcggccatcgaggagtagttgtacattatttgatggcatcacaaagtctccccttcaggggaactccacaactggatgcatcgagaacactcaatgactctatcgtgtgcctctgcagctgtggctgaacagaatgagctatgcctctaatatgtcacctaaggtagtttgtgtactgagggcaaatctccttcggttaaaattcagctggccttggcgggctgtctgaataatactgagtctctgaattcagggcaagagggtaagcttttgagataccaggagagataacctgctgcctgtgttttgttctctggacgaggggtgcctgatgctcctgtgagactgtttgccttggagattaccctcctgccttgggagctcttcctgagtgtccagaaactgccctgtgtcccttgggggagtcagggtcaagccctaggtgtgatgaggactgtggccccgagtggtgggccctgaccccaccccatgaagaagattagctagggatttgaattatttgcaccaatgatccccttcactggagacaatgactgaggcctgaatatgtcagggaagagggaggtagggagaaaagccagatcaaaacttctcaaatgccaacatctctaactccaaaaaagaatggggtaggtgtctatttcatacagggaaatgcaaattaaaaagttcctttttcaaacagatattacctaccaaattaagaaactaagttttagaaattgggctaggagctaaaaaagaaaaagaaaaagaaaccaaaagtatatacattgaatacatgtacatccagcacagtactttgcttgtaaaatagtcgttgaacaaatgatgcaatgaatagctataggcaatgctgataggcctcgataaacaatgagaagcatgggttttctttccctaggaccttaattcgaaaaatttcataggtttacaatatcttctttcttctgtgtaagggaagtttgttaaattactctagagaagaaagtctatcaaatcttaatttgtgcttcaaagccacactctagaaactcttaaaagtatcctggtcatctcgttacttaaggtctgagaagttgctgtagacaaaaaatgaagaatggtgttgattaggcagctgattaaacatgcgcttccttggacacatgtgtctggctgtgttaaacaccaaatgagcctgaaaactatgtaagcatcagtctttcagtcatcaaaacttttaggacgagtgactttttttagctgcaatgctgcaataggacacaggagttaaaacaaagtactggcaaaacctggatagaaagatgcccctgatcaaagggaaatctcgtcatctaggggatcctgaaggaagctatgtggccatatagtctaaaaaatactgggctaattgagaataagttgacacccagtttctgccacaaggacattgcctttcaaagtaagaaatgtcagtatgtattgactaagctattacttaaatatgcccagattcctccaaataagtaaactgcatataaatacaattttgtgaactggaagataagcactataaggatgaggaaaggtgaacatatactaagtagcataaataccgcacaccctggagatattaagggcagaagcagacttcctgttgctcacagcatttattcagagagctctgaaatacaagccccggggtctactggggctgtgtttccagctagctaaagaaaaatccactgagaaaaaggcaatggcttcattttctacctttttcaactttgattaccaaatgatttcttgattccaacatgagtttaattttacttataaataatatgaagcaggtgatctcaattagaaagcagattaggcaaagtcttacctttttttaaaaaaatgtttttggttgcctggaatgaaaagtatatatgtaaatgtaaatgcattgcaggggattgctggtaacaaaaataagtatatctaaaaatggatggtagctttacatgggcaaacgataaaggtaaaaagttgtgtggaattggaacaaactgatgttctcatccattccccctctaaatactgtctcaaaggattgcaccatatgctgtgattcattaacattatgaaacataactgacacatatagaagaaaaaagtgttgtcaggggaaaaaatagctagctgaattctaaaataaagatgcagtttacacgggcaacaaaagacagcatgaggttcactcgcaaagaccacagtgagcaccttttatctgaaaaaaagcacaaggtatttggaaaacaagtctgaaaaagagggagttaggggaattgatgcatttgcaagaaagcctactgcaaagtgggcaaggcttcatgaaagaggaaggatgattcctgaatgttgatacaaacaatgagcagagaacttagtgggcatgagacagacagtggttcttaaaatacatggatgtgcaagaagaattttaaacacgtcttttaggctgttgcaacaaagggactgaatggagagcaactaaactgacatcaatggaaataaataaaattgactatttcaggaagcaagaagttaggccttcaggttgataacagtactaaaagatgcaaaagtagcaaatgcaatgttaaaacaagcaaagaaagaatcaggtggaccacatagtgcagtgcttctcaaataatatgcagaagggaatcagttgtttgattgacagagatagacgagacagaaagacaaagcaagacaacgacagagatagaaaatacaggagacagaaaaatgaaaggaccagaccacgaggttcaacactgaacaaatggaattccagaaacaacaggaaaaacaacaacaacaaaaccttaagaaaggaaatcattaaggcaatttcccagaaatgaaggatatggcagaaatcgatagaacccatgggtcagaagaatcgacgaactgtttaccagagtagagttctataggttcagaacattgagaacagagagaaggccctataaaggctgctctatgggtttttggtaggggaggaggaagggataggtcacatacaaaagatcaagaatcaaaatggttttgaactgcttagcagcagcactggagttagaagacaatggagaaacccctttgaaattctgaatgaaaatggtttccaactaacattttatatctagccagtgagtgggtacatgaaggcattttcagacatgtttctagaaacttacctctcatacatcctttctcaggaagctactagagaggtgtttcattaaagtgagggagtaaatcaagaaagggaagacatgggtacaggaagcaggcgaaacaattcaagggagagccaaggatgatggagaaggacaattgtggggtggaagggagctgcggtgtggctcagtctgactagaacaggcaagagggttccaggggaggtttctgcaaggaggctgtatttatgaaacacctggtgctctgaatgtttgagaagagaatcatacaattgagcaataatgtgaagttgaattagagatgagtactgtaaactaagcaaacaagctgagctcaccacagtcctgactcagtgcatgggaggaccaggcagggagggcgagtgtccctgaatatatgaggagaggggctgcggggggtgcatgctggggagccatcatccatagtgggacgttaacagcacctaaaattttttaaaaagtcaagaagaaggaatataggaatgcaattttagtttggaagcaaatacaaaaatggaagaaaataccaaaatgaaagagttgctgctggggaaggggaaatggagggcatgaataggggacaggatactgctctccagaaaagcctaatcaaactgtatgagcattgattttaaaaatgtcactaaaattgcatatacacacaaaacagcaataagtgtaaacacatacacacacaaacacatgcacagaaaaacagtcagagaagatacatgcccaaccaccccatgagagcagttacctcctagcactcagcttggtttgagatcctctgaaagcagagcctgaggcagtattgaggagtaatggtgatgctggaagcagaagcatgggggtaggaaagtgagtgagagaaaaagagaaaagccaacaaaggggtgttgctgagcaggtccccactgtgggtgactcagtcctgctggggaccctttgagagacacagagcacgtgcttctgaatcgttcccatgcaggacgggaggcaggcccacttatccacagactttcatcctctcttgtttgagaatgatctccagggccttgcctgctcccagcctttgggactgcctgggtcagggtccatgggggctgccttggcttcagaaaagggtgagggagaaaagctaacagacctggtggggtgcagacacccacaccggaaaagcccaccatggctatggctaatatcacaggtagggcaacagcacagcgtatgtcagcctgtgggatggaactggggctgttggtgagtaagggggactccagctttagccataaatgggcacccttcacgcccatttatcatgagggtgcctctgttagccaccctcatgagctaggacaacgcagggagccatcttttgctcctggcctcagctgctttgtttccacctggttgttaccactttgtccttagcgtccaattttctgatgaggactttttgattcacagcaagcttgctcattattttccaaaggataaacaagcagttttaggaaattaaaatgcaagtttaactgcagccttgggaggtaagaacccaggtaaacatgactaatacaccaaacctaagcaaatccattatcaaaaagattccaaagcatctagagaagataaagagcagcccataagctcccagcttgcccagggtcatagtgcatatcccccgggccagaccatggtgtctccatggggagcaggccacggtggctgctggcctgaggtctgtggagctctgggctatgctgcaatccttccaggaacttcttttatgtttttacaacagtgaattaatattgtattctactgcataacaattctatctagataaatctatatactatatacaatattgaattatatctataattgatatctatacacatctataatctatatagctataatccatattagtataactatatgactatttaaagttatacttataattatatataatctactgacacttaaatctatatatttatataattatatcttattatactatgttttatattatttcataattaataatatatcattatacatctcttctcccaagaaacattaggcagatattggctgtatttaaaataattcaattaagcggctctaaatgacaatccggtcacctgatggtggcaggaagggactatgaaccttactcatgggccatccatttatttacacacaggacgaggagtgtactgaagaagaggagaaaaagcaggttctggcagaaatgagcagctacagctgaataatcaatacaccatcggtgaaaagtaatgatactatggtacatatgattcaaaatggtcacgaatttcaaaactattttcataactcaggcatcactggaaggtagtcaatgttttttctaccaccagtcagagcatcttgagtacggctattcttttcccccatttttagctgtatttctatctgacgcttctcccaggggcccaagagctaattaagagcttcagtttcaaagacctttccttctcacccctgttgtgccacagcatctatgtgaactgtaaagggcagcaaaatgagaaaatattaaaagggtatttaattaagcaaagtaaacagtgaggtcaatagcaactggaagctaacatctgtcttcgaacaaggcaggcaagccaccttcaggtacaggcaacagaggagtgagtttatgcaggatgctccttttgtctacgccacttgtgatatctacttctgcttcagaggcgatgagacatttaataaaagaaaacaaatagtgatgccttgctttatctaggtggagaggagaaacaaccctccagctgtttagcactgtgatgttcaggcttcattttgcttttaaaattaacccaggaaaatgaaaaacgttctacactgaactccaaataaacagcatacacagctctaagtctgccatcttgagtcgttctgtgctactttcttctgatgctatttccatagacaggaaagagttggagaatccctgttatgtatttgccaagcctcaaacaccttgtaaatgagcgtgggagctggggagatgacagatgttaccagtctaatggggctgcacatgaggtgggattgtaattgggattgatattagaatatctaaagctcaacaaatggaaaaattaccaacacagccgtatctggggtgaataaaaatggcttccgtgatggtcaattttatgtgttagattggctgggccatggtgtcactagatatttggtcaacattatttgggatgtgtttatgagggtgtttttggatgagattaatgtttgaatcagtagaacgagtaaagcagattgctttcctactgtgagtgggggcctcatccaatcaggtgaaggcctgaacagaacaaactccagagagtaagagggaattaaatcctgtcttaccgcctgaagctggaacttcagtcttttcctgcctttggactcaaactgaaccatcagttcttcttgggacttgagcctgctggctttcagcctggaacttacacggtcatctctcctggttctggggccttcccactcagattgaaactacaccatcggctttcctgggtctccagcttgccaaatgcagatcttgagacttctcagcctccaaaatcacatgatcacatgaatcaggtctctccccatcattgcttattgcttgctggttctgtttctcaggagaactctaacagagcttccaaaccacaatttgtgaagtggtaaaaaaagcactacttcaataccatgggttatgtgtggaagtgtaaaactcacaaatatatttaacactatatttcactgtctaagttaagattaatgtccaggccaggcatggtggctcacgcctgtaatcccagcacttggggaggctgaggcgggcacatcacgaggtcaggagatcaagaccattctggctggctaacacggtgaaaccctatctctactaaaaatgcaaaaaattagctgggcgtggtggcgggcacctgtagtcccagcttcttgggaggctgaggcaggagaatggcgtgaacccaggaggcggagcttgcagtgagcctagatcgcactgttgcactccagcctgggcgacagagtgagactccatctcagaaaaaaaaaaaaaaaaaaagattaatgtcctgggttttgggtgtccataccaatttcatcactggtccccaggtctcattcagttgaacgacaagccatactgattctatctcatgtgtatgtctctaacctaccagtttttctcatcccagctgccagtgcacctagtttaggccacaatcatgtctccctggaagatgggaataccctagtcactgctcttcctgcccccaggctcccctgctcccaccattctctccacagtgataaagcctcattcctccacttcactgctgacaacattccattggctcctggtcctctggatcaggtccaaagtcatggagatggcttgtggaatctggcttttccttccttgtctaccctcaaccaccaatctcacctttccacagtagatccagattcctgagtcccaccctagtcctggtgaatcagaatatactggaacaaggctgcagaatctgtatttttcaaaaagctgctcaagataatttcaaagattaggccagataggtttgagaaccacagctttgggactcacatcctctgaccttaacaaaagaagtccatgactatccctgcagttatgacagtctcctgtaatgatgtgtctctgctccattagaattgtgagctccttgaagacgcaagctatacgactgactgcatgcaaaacttgttattggtttattcagggattcaaattcttcctggcttagacttggaaggatgtatgtgtccaggaatttatctatttcttctaggttttctagtttatttgtgtagaggtgtttatagtattctctgatggtagtttgtatttatgtgggatcagtggtgatatcccctatatcaggttcagtgcagtcatgggaagcagtcctgagcatgaacggtgactgtcacagtcactgaatggctttaataaagacagcaaagaccctaaaagaaagaccatcagacatcaagtgcttcctgtacaatgcaattagaagtatagtcccacctataaagtgttcttgcaaaaaaaaatcaaacctgaacttaatcaagcctctggttttcagaagatgcagggttagaggagcacggtgaacaatgccacggagttgcactcagcgaaacccagaacatgaggaattcaacaggtaaatgacatgctgtcctcatcaaataaatggtgagtaataaaaaaaaaaaaagagagaaaaacctacagattgtaagaaaccagaaagacgtatcaaccaatgctatgtgtaaatatgttggtcatgattgaaacatacatgttgtaagacagaaaactggtatggcttcaacactgactgaatatttgtttatgttgagagatgaatttggagcgtgtgtgtctgtatttgatgatagtattgtggttacatttaaaaattaaagtcttgctttcttaagagatatagcttaaaatatttatagatgaaataatatgatgcctgatatttgctttaaaataatcccatgtgtgcgtgtgtgtgtgtatgtgtgtgtgcatataaataagattggccccatgatgactgtatgttgaagtggggtgatggagagggtacattggggttcattacattattcattctggttttctacatattgtcataaaatgaaaaaagagaaaacacaggccattagtttctacatcacagtatctgagattccctttaatccaatgaggcttggaaagtttgagatggttgtattaccctttgcatggtagaaattggctagtataacagagttggattatttgattttaagaactcatttaacatctgatattaacacatccaacactcttaggtaaaggcaatttgctcttttgaaccagaaagggttgcaaagaattgccacagaaggtcactctgtaccaaagagaactttggctatgtccttaaatgaagacattcacatttccatgaaaaattctaatcacattttggtattaaattaatgtcctcaagtacttctggctctgcacacaaactaaatagaagattctgtcaacttttctgtctgacagaactaaggagaatttagtttcagtactgtagaaagttaagagggggaggcaggaacaacctttattagatttcttaagtgacccttgaataaaaaacttttacaatttatactaacagttaaatctaataataggtcacttagaatatcgcaaataatactacaagatagaagaacatgaagaccctcaaccaaacaccggtgtgaaaaagtctttgctgtagtatatgaaaattataggggaaaaggatctttacaactgtttgtccaattacatcagtgttccatgcggcctctcacctacttaatggttacatgtgattacgacatatttccttcttggcttctgtgttcaaacattttaacacggaaagggaatcccactaggtctaattttcagacttgggaaggcaatgattgattcatatagacagacgttgaacttgagtttgggaagaacaagtgaataaatatggtgcttgataaaagatacaacagtgactctcaaattttagagtaatgagtgagccacttctaataaaatataaattatcatatgctaagcagtggaaaatacatatgaaaaacataacttgtttggaagatgtgttccttttaataacaatttaaattatactctcaagaaaaaatgattaatagtgtcaaatctacccatctgtccatccacccagccactgttcttctcttccctcttcttctttttctttcttttttatttttatttttttaagcaaagcactaagggcacagtggaaaaataagaggttggaggaaggatagaagtgaaagagcaattaagagagaaaaggaggaaaggactattataaatacataactaccacatgatgatttatttttgaacatgtaccttttaaaaaatagattttacttcttagttttagaggttgttagaaaaactgagtgtagtatacaaatttcccatagaacactttaccccccaaatatgcagagcctcccccgctatcaaaatcccacaccagagtggcatatttgttaggactgatgaatctacattggggtatcattatcacccaaagtctataacttacattagggttcactcttgttgtactttctatggggtttgaaaaatgtataatggcatgtatctaccattatatatcatacagagtagctttactgccttaaaaatcctttattctctgcctattcatctctcccctccctcaaatccctggcaaccactgatccttttattgtcttattagttgtgccttttccaaaatgccatatagttagaatcatacaccatataatcttttcaaattgtcttcttctacttagtaatatgcattcaatgttctgccaaaatctcttcatggcttgaaagctcgtttctttttagtgctacataacattctattgtttggatgtaccacagtttatttatccatttacctaccaaaggatatctaagttatatccacactttggcaattatgattaacactactataaacatttatgtgcagatctttgagagggcacgtttcaacttctttgggtcaatgccaaggagtgagagggctggatcatacggttaagagtatgtttaattttgtaagaaatcgccaaaactgtgcaaagtggctatactatttttcattctcaccagcaatgaatgacagttcttattgtacaacctcaccagcatttggtgctgtttatgttccagcttttggccattctatcaggcgtatggtggtatcttgttttcatttccaatttcctaatgacatatgttattgagcctcttttcatatgcttatttgccttctgtatatcttctttggtgagatgtctgtccaagtcttttgcccatttttttcttttttttgagacagagtctcactctgttgcccaggctggagtgcagtgatgctatcgtggctcactgcaacctcctgggttcaagcaactctcctgcctcagcctcccaagtagctgggattacaggcatgcaccactacacccggctaatttttgtatttttagtagagatggggtttcaccatgttggccaggctggtctcgaactcctgacctcatgtgatctgcctgcctcggcctctcaaagtgttgggattacaggcgtgagccaccatgcttggcctcttttgcctatttttaatgaggttgtttgtgttcttattgttgagttttaagagttctttgtatacttggaattacacccctttatcagacatgccttttgcaaatattttttctcagtctgtagattcccttctcatcctcctgacggtgtcttttgcagagcagaagttttaaactttagtgaagtctatcttatttattttatgaatcatgtcactggtgttgtatctaaaaagttatttccacatccaaagtcatctaggttttctcctatgtcatctcctaggaattttatagctttgtgttttacttctaggcctataatccagtttagtttttgtgaatggcataaggtctgtgtctagattggtttttttgcatgtggatatccaattgttccatttattgaaaagactatttgttgaaaagactatctttacttcattttattgcctttgctcctttgcaaaagataattaattatatctatttctgggctctctgttctgttccattatctgtctattctttcaccagtacaacgctgtcttgattactgcagctttgtattaagtattggagtttggtagtgtcagtcttcctaatttgatttggagtgagttgaatctatagaccaacttgcaaagaactgacatcctaacagtgttgagtcttcctacccatgaacatggaatacctcttcattagtttgtctttgatttccttcatcagaattttgtagttttactcatatagagcttgtacatattttgttagatttataaacaagtatttagttttgggggatgctaaagtaaatggtattacgttattaatttccaattccatttgtttgttgctggtatatagaatagctattgatgtttatatattaaccttgtattctacaagcttgctacaatcatgtatcaattccaggagtttttttctttgttaattctttcaaattatctacataaacaatcacatcatctgtgaataacacagctttatgtcttactttccaatcagtatatattttttcttgtcttattgcataagctaggatttcaaatgtttacttgtaaaattatactgtaagtcactacaacacagctgcaaagtagcaacagcttaaaaaaacaataatcatttctagtgtttgctatgtatcaggaacctatccaaatattttatatgaattatttcattaaccattacaactatataagatgggtaatattatttccattttatgcgtaataaaactgattcacagagaagtaacttgtccaagattactcagtcattacgtagcagagcagtaattcacaaccagatctaatggttctatagtgtatgcttttaactttattgtatatcaactgaggacatattacagactatattttctattaggtactttttacataccattctcatttgatcccctcaacaatcctgaaaactagttgttcttatccttgttttgcactgagaataatgatgctcagaggggttaaataacttgcccagtggcattttgcaatgtggtagagcaagcactcaaacccatgtttacaaatgtgctctcattttgaatttttttgtatttttttgtcagaacaaatatctgctatttgctgttcaacacggttttaactggacactgaacaaatatttactgaggacatattaacgggcagatactgttctaggtgaatgaagcatctggaatcctgtcttcacaaactcagcctctcataaaacataaaatactttgtaacaaaaccaaccaatcaacaagcaaaaaactttccaacaactgctaaaatgctgtgaccaagaaataacaggggaaatctggtggatggcattagggccaggactgcttctactcggtgggcagggcatgcctctctgaggagaatacatttgagctgagggaagtattccaagccctgagatgttttggccgactaaaaacacgatcagtaaagaaatgaagatcctgatttccagcttagagtttaacctgggagcccaaagatggagaacaacttcggctcatagggtgttttgattccctgagtggttagccatcatctcaatactgaatgtcatttggggaataagaaggagaaaaatggcagagtacaactgtttgatgacatgcagggagtcctcccttttctcccctagacttccatctgagtttagaagttgttattattcttgagaatagttgtcttaattttgctttcctcttacaccaattactgctcatgaaaaccaaagtgagatttttcccacataccctccaattggagactctcgctcattggtgcattcataaagcactaacacatatacataggatttctgttgtataaaatgatttgacaggcaattagcctcaggattgcagcatcttcagcttctctgactccaagagccaccaacatggaaaagcccccacactccagttcagtttccttgaatactccaacagccactaaacataacacctttcaaaaatgctttgctgctgatgatagtggtaatggactaataacagaaaacagctcctgctaatgtaaataaccagataaccagaagaaaaaaaataaaaacctaaatgaggaagaaaacagtttttcctatgaggtatttatttaatctctatgtttgataatggttctattattatatgttttgtaagatcagcagagaatagatgaaaagaacattaaatgtagaactgcctaatatctttccaataggtaaatgactgagaaaactcagaaatcctaggatttttacttcttgatatttactttgaaaccaaaaaggctcaatctataaaaatgtctaaaccaaataattctattattgaaaatttgaggtttgagagtaaaataaaactaaagtagaatgagaaagtgtttttagtcaggaaaaactaggctgtgtgttgcaggcaccataagccagaaaggtgactgctggccgtggagtggtggtggtggtgatatatcaatactgacagccattactaatacctgtatttggcagataagtcatttgaactaccgagactttattttggaaacagttcttcacttagttaacatctcccattagacaggacaatgcctataaactctgggcatccctttactgcgagaaaaataaaagaaaagcagttaggaaccggcctggcattctcacagctaagctgtattgttctcccgtggaccacaaacaatttcaaagaatatcaacgccagacaaggttactctgtgaccatgaaggatcaagcccaaaaactaaaaataaaaaaaaagaccactccataatagtgtcagatcaaagacaaaaacatgaacactgtgatcaaatataatcaaatatttcctcttctgggctaatatagtgctttttatcaaccatactttttattgatatgctatagttgtacatattttggggctatatgtgatgttgatacctgtacaaaatgtgtaatttcagggtaactggaatatccatcaactcatttttctttactttgtgttagaaacattgcaattcatatcttctagctattttgaaatatacaataagtgataattaactataatagccacactgtattatcaaatgctagaacttattccttctaattgtatttttgtacccattaaccaacttctcttcacccaccttcatccccttctcagtctctggtaaccaccattctactctctatccccatgagatacacgttttttgctcccacatatgagtgagaacatgcaatatttgtctttctgttcctggcttattgcacttaacataatgacctccagttccattcatattgctgcaaatcctttttaaggctgaataatattccattgtgtatatataccatattttctttatccattcacccattaatggatgcttaggttgattccatatcttggcttatcaatcatgttttaaacctcactctgttcttcctgctttctggataagaattattaatacactcaatcagagaattgcccccagcatccaatccagaacaaagccctgctttcctgcattcttccccaaattacctaatacaagtccaaattcttaataacttccttttaataccttcttactgagaagcttgcatggttcctgtggttcacatggttcttccttgttgtggtaaatcaataaatctaacatcgctttaaaatacatcccagatgtattcctgggattttttggctgaaactcattgatacttatctatttctttgacaggcagaagtccagggcatacaccaagtcagccggggacttcacagtgggcagtcttgcagtcaatgacctggtagacatgccaagagaactaagtagctgtaaataacactgtgtcaatctggaagataatgatcctatgcctctaatctttatcgttttggacaacagctccaccatgattaaatctttcagaaagtcatttttatttttcagattacaatcttacaggttgaaagacagactggtattacagcaagagttccggtatcttccaggaatcatcaagaataagaatagtgacacgattttagtgtctctgctgtcattgactttgcaagtaaatgtaacaaactgagatactgctattgttacatttcacgattgctggggagtggtgctcttttgccttcccctggctcttaaaacagctctgaaatgcaccataaggctccatcattttccttgtcatcattatcaccatcaccaccaccacaatcatctctatcatctctatcatcacaggaccaacgaacattttcgagtgtttttctttgtaccagattccgtgttgtatatgcaatcacatttaattctcagtacaactctaggaaaatggtattattatcctcattgttcagagaaggaaactgaaacagtgacattaaataattccaaaggagcagaatcagtactcaaaactaggatgatctgctccaaggtccacactcttagctatcacatttctttcgatctatcttaatgctcaagctaaagagatgaaaatggggacagaagaggtagatttcagctgctggctgctccagttttctaggcagttttgaagaaaatttcctaggatggctcagcttcttacttccaaaagtgattgtattattctggaaacttttgtggttttagaggatttcatttttttcattaattatagttactccttgaaatgacagattattaaaatgattagtagaaatatttccaagtagataataatgttctctgaaattaataacccaaaatgcacctttcatcaatgaacaaaaataaaacagaaaactcattaacttggggctaatttgggcagattttctgataattcagtgaaggtgaagcatgtgtgaagtataatgggagattaggaattgaattagacatcaattctgccaacttcaagtattgaagagcacagcagggaagatgtgagacataaacatagcttttgatacatgtaaaaagtgacaggagtcttagagaagtagaggtgaggtttcatgaatgttccaaagcagtgctactcaaagtgtggtccatgtttcagacacttttactgcaatttaactaattttatgtctgttgaatctacatataataaagaaaagaattgtgcttctattttgtatgtcctttttatttatttttttcttgtaattaattgtcattcattgtgccaaagtactggtaagtgatggaattaagtacctggtcctttaccactggcagttcgagaaatagaatattctagaaccatatggttcagcttcagatgtttcaggcccgtggttaagaaatactatataccacatttattagaactcaatttgatatccatttggatatacatatttatatactatgtatgtgtgtatattatacatgtatattttatataatacgtacaatatttaaagccataaaaatgtctttaaagatattctaagcttatatttttcagtaattcacataaaatatccttttttatactttaatgaatttgacatactcttaaatctgcacaagaacaatgtgacatctcataaataaacaaagctgtaagctacagagattcagaaacttttattactcacaaagtgaatatttgaagtcaacaatcacaataaacatctttccttaaacaacgaaaacaagattataaataaaagccatcgttactgccatggttagttaagagatgaggaaaggggcttgtgttattaactagtttcttcagttctagaacactgcttggcacagagtaggtgctcaataattgctgaataactggaatggcatttaagaataaataattagacagtggatcttagttaacactgtagtgataacactgggaggtgacttttttcaacagcaatggcctttctttacaggaagaaccaactccattccaaacttagagtatgctgattaaaagaaggggtttgttctaaaagacaactgagtatgaactgtggctttgccacttactacctttgtgaccctctttctcctccccaagacataggccttcacctgtaagatgaagataatggcagaactcaccaagttggttgtgaggaatgtatgacaggatatcataagcattttccactcatgcttggccttaataaacagcaagcaaatgtgggaaagcaggcactatgtgaagcatatgaaattgctgatactccaccatttctggtctacaacacaatggcagtttctaatggcttgacctaagttacgctatctcactgaaaatacattaagaagcaacttttgctcaaactaacacatcagagactgggtacattcttttcctgttacctccactgctctatctgccaacacatgtctcccaggcagctgtcagggctaccggaaggaatgtctggagcctgggaagcatgtcacatatgaggagtgttgttagcagaagcctctgactgactgagggcagagtctgcccacaacatgcacagttacactgaactggttgagctgggccaggatggcagtgtagggagatctacccacattagaaatcttcaaagattctatagttctttttgaacaaaaatgctgggagcatttgagcatgagatgtaaagcaattattagccagattctgaaaaaactggctccagctacaaactaaagttggctaggtatcagtggagcagatagaagtttggcaatgagatgagcccttatgacccaatttatactcctctacttactatcttaccatcatcacattcttactcttgcctttatgtggtgcagtatgttaaatgttacaatttccagcccctacactatcaccacccaccaccagacacataaccaatgctccttgctccaaggtaaaaaaattaatctccaaaacatctgacgacagtgagaaatttctgttcctatccatcatttctaaaaataaatattttaacagacttaacttttataacttgagagtgccaaaatggtgtttatgtctttaacatgaaaacattttacactttttgctaataaactcaaacacaaggtccaaatcttagaaatatcttaatggaagatcaaaacacaactgaatccctacttaaaacactattttatacagctatatcatggtgaggttcagaaagttgcatttctggatattaataatcagttggataacttcttttaagcagacatcacatttatcagctagtgcagatgtgtcctacttgaatccatatgtgtttatgtatttatatatatgactaggtaaagtttcatataggaatttaaacatacacacttagaggaaaggaaatatctcatttgtctttgtattctatgtaacacctaccactgtctccagcatgtagtaaggaattaaatgaatgtttgttgagttaaatgggaagttcagggaaaataactaagttgattttcatatgaaaatagtcgcagggaattaactcgagaagctcagattaactttctattaaagtgaaggttacttatacttgctccttgaaaagaagataatattctaagatttaacagtcaacattaggtgaaatgcattaaatttcaaaagtaagtgcttatttccataaggtgtggaagctgttctctagaggataatgccacagataaataacagtcacagccaagggaaggaagggttccttgcctaggcagagacattaacataaaactctgctcatcaacagctgatggtttagaagggttcagtgatgaagcagcagatgccaaaaggacaaacacaggttccacctgaaagcattaacaatgaaagagtgccctgaactttgctctaagtcaggaagttggaatggaaaaccaagggtacccagtgctgtgctcacaaatgcatggcacacaaaatgcccaatctgtcatggcacagctgtgcaccatgtgagtttaacaagagccctgagtagccagggatgacaacaatctattttctgttggcatataaaaacaagtttataaaccatcattctccatgtttccattaaaggcaggtctagttaatgaaggcagggaagagttaggtaaagaaaatcatccctagttctactgtaattttttaattttttttgtatgatacaatcaaacctttgagaaaacttggtcaagcagactcaccgcaataatcttttccttgaacacaaattcttcagttgggtatcaggatcatgccattctaggttgaattacttcttcagatgtgtaactctgtagtctaactcaaatgcctctaagcatggctgtatcccgaaactcctcttttctcagagtggttctatattcaatatctcaaaactctaaaatgctcctcatagacaacaacctcccagtcttcaatttctcctttgctcccacttctctccttctgctctcacgggaacctccagcctctagatatttccctaatccttgttcagtggcattaagtgcatgccatgggcagccaattttaactggctgtcaccagcaatgagaatacctactttttatacagcacttcacaatccagaaagggctctctcaggactttccttatttgactttatttccagtaggtcttactattattactcttaaaagaagtagcaaagggctgggcgcagtggctcacgcctgtgatgctagcacattgagagatggaggcgggaggatggcttgaggtcaagagctcgagaccagcttggccaacatggtgaaaccccgtctctactaaaaatataaaaattagctgggcatggtggtgcacgcctgtaatctcagctactcaaaggctgaggcagcagaatcgcttgaatctgaggggtggaggttgcagtgagctgagactgtgccactgaactccagcctgggcaacagagcgagactccgtctcaaacaaaacaaaaacaaaaacaaaaacaaatgaagtagtaaggggaactctgagagtctccctgaaagcttgctaacactaggtcgtcatcagctatttgcacttctgtcccttgtctgcctcaatggttcacaatggcaagagagtggccaagaagcaaggactagccatgatcatgttttcaccattcttaaagaaaacaactggtccctgccttagtgaaaagactcagcctcattagcatctccaaccaaataagcaactatatcccaaaaaagaaatacaaactagataaagcagtcaacaatgtgcattggcagtgaggcagtcagaaaaacaacacttgtgttaaaccagagttctacatgtagttggcttggaagattaagttaaaataagtcaaatgaaacctacccatgactaaaataggtatgtgtctttttgcttccaactctcctgaaaaagcaacaatgatgtaatactataaattttcagttaattaattccaagtttttgcagcaagctttgtactctcatcctgtatcacataccatctgtctatggtgaatatttagttctcactcacatcctgcttcctaacccttagaataaatgcatcttcttaaaaataagaaaaatgttccgctagaccagaggaagataaggacttgtattttaaacaagctgatatcatatcttcataatctactgctgccatctcctgtgttaatgaggcagcatcttcacacttgtgaagaaatttaatagtatttaacagaaacaattcttaccggtcagatggtacattttctacatacacagaggaaaaacagcttaattctgttacctctaagtgacttcgtctctcagcaatcacacgttcatccttatttccaaatagtttctttggaggaaattcaagggcagcaagctgaaatagacattttaaaagacatgcattaatagcatacctgttaattgttgggctattattaatctattatttgaaatctcttccatggggtgaaaagaaagaggctgaaagtttaaagatggtgggtcctgccttgctttatcaccaactgtgtgaccttcaacagataaagcaaccttgggtcacattccccagtggtcaaatgagaagacaggacaatgggaactccatggaagaatgaatctgattctcaacattctgtctcagatgacatatcagactctgtgccaggtggtattttatactttttgttttttaaaacacatgtttgttcttctttcagtcctcccaccctttttttttttttactagaatccaattagttttgtgttgagataagaatttgaaaattcaacctacacactacctgaacattttataaaatcgttttcagactattgctaaggttctctaaatattcagtattgccttttcagttaccaccgtgaatgaagactgcccatgtgaaaagaggacttctctttccatcttttcaccttgtttcctaaaaatgaaggttcagattttgtttagcctgatcttagcatttcatagtatttctcttatgcttttcctcttgaatgtacaaaaattataaacaataagttttactacagattcccaggcaagataggattctataatctgatgagaatccaactagccagtgttgccttggctgaataaatgctaagtagcaataattgctgcagttgcagaattcactatttccttcctttctcaatttgtcaggaccagacaaattgaagccaatgaagcattaccaagaaaaaatgagcatttctcccacaatgtagggcacaatatgtcacaaaattccaattttatgcctatgcaaatcactaagttgatttaaatttatattgccacagtgggagtcaagaattaaagactagcatctgtatatataatacttttaaaacatagtattaaagtataatatacatacagaaaagtgcacatatcacaagggaagaactggatgtattttcaaaatctgcacacactgtgtaaccagcactcgcatcaagaagcagaacactgccagcacccccagagctgcacttgctcccttccaggcactccctctcacccctacaaaagttaacgcaggcctgacactatgacaatagcatcgcttggtttttcctacttttgaacttcatgcaaaagatgtcatacagtatgaactcttttgtgtctacctccttttgttcagcatcatgtttgtgagatccaaccatgttgttatgcgtagcaatagtttgctcattttcactgcagtacagtattccaccatgtgaacattccataatgtatttgttcattatcttgctgttgggctttttgttagtttccagtttgtggttactagaattgtgctgctatgatcactttcctatagatcttctgataaacatatgtacgtatttctgatagtcatactcttacgtgttgcaaatgctgggttatagagtgtgtgtgtgttcagctgtatttgaaactatcaaatggtttccaaaacagttttagtaactgacactcctatcagaagtgactgagagatgtggttgctccagatcttcaccagcacttggtacagtggtcgtccttcttagcaatgctggtgggtcatgtctactgtggttcatatttgcatttctctgatgactgatgttgtcaaacaactcttcacctgctcattgacatctggttagtcatttttaggcagtgtctgttcaactcttttgtccatttttaaattcgttgtctgccttttcctcaagtaagaataattctcccttttcactctcttaaaggtgtctttgatgactttatagcctgtcttaaaagttgattgaagttgggcagatgtttgtctcattccccctagtgttctttctaccaaagcagagaaaccttggagtgggttgaaggtaacaccaagggatgggtttccccatctctgtttctcaccaatgtttagttggctgacatccaactttaaaatcagttcaaggtaaagtgaaagaccatgggcactgaggcaagacagacccagtctgaatcctggcttgaccactaaccagcttactagctacgtttctctgagcccgagtattctctgctgaaataaaaccacagaaaatgaaaccaaactttaaaaggattccgtgaagatttagtgactggattttagctatattaatagctgttagagatctgctaattactgagcaagtggcacgcccacattcccttgtggcctctctgcatccactgggaagccgtagtgacatggcttcaaggagcaaagggttttccggaacctggactcagtggcacaaacacactccccccatgttgcagctcagagaagacaggtacaagaagagctcatcttctggctccctccagcttccatctcctccagtacaaacgtgcctcccgcttcccccgatgctgtggtgctgaaagcttggcaagcatgctttcacagttggttgttttgtcattttcttatgtggctgatgaggtgatgtggtttctgtcaggggaaatttatagtcacactcacatgctcaatcagaagtcgtgcaataaaaggactttaggcagtggaagcggggagggagcaagcattcacatctcctgctagtcaacagtggcgttccctctccagacccagatggaggaagcattctgtgctattaatattcagcctgtgaaataactatgtgtaaattatgtgcaacactgttgttcagattttaggaggaaaaggccaattctaagtgactttcaggcctataatcacaggaccatgatactcaactaactgtctgactttagagttgaagacacccaagcccagagctaagtgacttggaaaggctcagagtcatgggggcaaagtcaggactgactccaggcctctcgggataaagctgtaaggagcgtctgcagtgcatgaaagatactgttgcaaagtctttggggatctagggtaaagatgaaaaagagtgattcctcctaagtgtatgtaaccagaaacatgaacataccactccaaggcagtcatcaacagttccaacaagagttgtcaacgggaccctgctgaggacctgcacccttgcccagggtcagcagagcagtggagaacagcaggaagcaggatggggctggagctccccagaagtccattccaggacatacaaagttagttagcaactatcatcttacccctctccaagtaaaaactaagaataatggtagctatccttacaataaagtacaggtaggatggagaaaaggaacagctgcaaaagttccaatgtggctcatgatagaaatgtgagctaatgggcccaggtcctacaggtggggctggggcatgaacaagccaaagaagaaagccaaggccataatgtaaagtataggaaaaacatgcccccattaatataatgatatttccatcggaaacagcttcaactgcaacgtgagtgaatcccttccctctgatatagtagaaaccacctccatgtctcctctttagagaatcctaacagtgccacttaggccttgctatctataagctcaggttggacaagatgaaattgccagttctgtaagttaaaaactgttgagtatcagcaatttcatctatctaaatcctgcataaaacttcgacacttaagtgactgctagggtcgcttcattttccatcagctgcgttatctgccaagtaaaatatctcatttgatagttgctgatcagcgatacctaagccaatccatttcaaaagaatatttttcttaaggcactcaaaagtaaaacaaaaactagaagtatcttatattttaaaatatactacattaaagtagtgaaagcattgggatagcagggcaggtggcacaggaggccatttggagaacaataatagctaacatagaagatattagagtcacattcctaagtccatcttccaaaaagaaaaaaagagcatcatctttacttggatgggcttcctcagctcaaataaaggagtctctgaaaaatgagggccctgatgctgacctgctgaatgactggaatgaagaaggtggggagcaggggcaggaattaccactccattcgtaaaataataatatagctaaacctcttaccacgggttagatggccagagtacagaagagggctggacttttttttctctccacaagtgcaaagctattgcctcatttatttcaaaatagatcaacaaaagcaattctctgtaggtttcatttctgaagtgtaaatgatttgaactgcctaaatagttttaaaaaatggacaatttaccaagatcaaaagaaacactggtcaggacaaataactgtgcctggaagaccaaagaaaacaaccgaacaccaaaaaatctcttccattttgctgaaagtgctgttttctgaaatgtaacacttccaacaaattaagaatataagaaaggttcagagaagatgtgattctgaattgtctctgacctctctactcatgtcccccacacaccaacatcttttatttgatttctcacgttaaataaaaagtttaaaattaaatcagaaatattatctgaacattttcattccctctcaagtactttatatttacacattttcatttttattgcctcatttttctaacagaacagatattctagttttgattttcatgagaagtactgtcaggaacagtgaatgacaatctgtaggtggagagactcctcttggatttcctctgtagcctctgacaaaggagatacagtgtcctatatttaaagaaattaaagttcctgaagttctatatattcctctcaacaactacattctacagcgtctcaggtaagtatttctgaattacataaaaatgttcaagatacttgggattcagtaatggaagaaaaagaatttctttctttctgtaagatttcattttcgtaaagaacaagcatcatcatttccccttacaacttttttggagagagtctcatgttgaaaagcgtgactgcaccaaaaataatctttctgcaaaaccataaaaattggtgaaaccattctggttaaagatggtggagcaatgactcgatttgttcctctcaccttcttcaaaagcactgctaccaccgcaaacactgtctctgaactgggaaaccgccacagctcaaactgtcggccaggcagcagcatccagaagaccatcacagagagaagagatgacgggagacaagggtggcctgccaccctcaccctcacctgcattctgcctatgctaaatatggggatgagaaaaagatcaggatgcaattccactcaaggaggaaggcgagcaggggctgtgagaggaggagcctggggaagtccctgtctccagagacagaggcaggagacgccagagagcaagcgtttggctttatcgcccacagccagcaactccacagcccccatgaaccagaaaacaagagaagatgtgtctcaaagtgaaggaaaaaattggtgaaaacagtttcaggacaattctaagtggtctgcgcatgccatagctgccctcctcctccccagcttctgcccctccttgctcccacaaagtactggtgttttcccacaacaattagtccacttcccttaaagatgagaaataattagaaggaaccaaaactgaaactatgtgtaaaaagggtgaggtgaggtgacattgaatgaaacataagcaaaaggcagctcaagaggatacaccgtaagtgggatcagccaaagctacccaggaggaattcagagaataaatagtcacgtaggaaccataaaatccatctctaaatagagcccaaagaagtaaataatacacacattgaaagaagagaaaataagggtaataaagaggaagcaaagcgagccagttcttggagaaacggctgattccaggatggggcagggaatacacacgacaagcctgaagcaacctatggcgccagaaagcacaaagtgcttgaaaacaaaaacacaagacgcggtgtctcaaaggaacacagacatcaagtgaaagagctcccagtggccaaagctgagacaatttgaaaaagaaaattaaaaagtattggtggataacccaaaatagaataactgaataaataaataaatgggggattcagattcactttgaaaaataaaataaagtattggtgggtaacccaaaatacaatgacagaattaaataaataaatgggtaactcaactatcaattcagaataattccaaataatttatgtagatgtttcaccctcaagaaagtagcccattatttccccactcctgaaatgtgtgctatgcatagtgacttccttccaaataatacagtgtggaaaggaagaaaaacaagcaactctacagtagagaaacttcagccacgtgatcaagtatcaacagtggtaagacatactgatagtatatatccttgagatgatatgataaaaatggcatttttacctctgcggtctccctcccaaaaatgcataacaagtcttcctcaagagtgtcaaggtcactgaaaacaaggcaagtataagaaactgtcacagtgaagaggggcctatggagacgtaatgactaaatataatggggtgtcctgggtgggatcctggaacagaaaaaggccattaggtaaaaactaagaaaatatcaataaagtatagacattagttaataataatgtaccagtattggctcactagttatgacaaatgtactatactaatggcagatgttaatactaggggaaactgagtatggtatataagaactctgtactatcttcagatttttttctattaatctaaaagtattctaaaataggacttctggtttctgatcctacacacgaggagctgaaaagttactcctgtcctcatgacaagaaaaaagctgaaaaataaatgaagatcaacaactctttttagatccagtggagaagtgagatcacagggcaaactactgccctcagactgcagagacagacaggtggacacagagaatcataactcagcctggcactgaggcctgctgctagagccagtattggtagaaacactatgaacagtaattccagaatctctggaggctcaaatatagactagtgtgattgttaaaatctctgaggggggccagtcttgaggaaggtctccacgcttttgagcgttttacttccaggagccccaccaggttctcactgtgaagttggattctagttttcaaatgatgtgttctcactgtgacattaggggattgagcaggggaaggaaaaagtaaccatttttaaatattcccagagctctctgttctccttcacaaggctcgctcttaagagaaagtgttttaccagaacctaactaccttaggttttgccagagcctaaccgaccagggctaaatgaaacactcaacgcaggctcatgaaaagactgcaaactaccctaggactatagaaggcttcctctcaccataccttaccatcacatcatggggctgctgtgtaacagggattacagctgaaataactgtaagcctcagaccctattttaaaagactccaggaaagcccaaagacaacaatggaagacaaaaacaagggcactacaggaaattttagcctctgacaccacatcgacatcaaccaataaacctagcctatatcttagccagataaacataaaacctcgcactaaaaatcaatctacctcaattccttttacccaatatatagtgtctagctttcaacaaaatattacaaggcaaattaaaaggcaaaaacacagtctaaagctattctaaaatgaaaaaaaaaactttaaaaaaatcagtgcctctgcaccctccttccttccacaaaaaaatgtgagccagcaggacttaagaaagaggtggaagaaacaaaaacacgatgggaatgaaagccccagtagaaggaacaagtgcagaacaagcacaataaaaacagattagcacgcagcacacagagcggagaaaataacaacacaaaataaaatgtgataaaagaaatgtgacccaaaaagtttatatctaaccaaagggtctttcaagtgccacaaatacacattctgaagcagataagaactcagataaaacacatcaaggtgcatctttcaaaaacatactgaatgaccaaaaatatccaaccacaagatagcacaatgtaaagatctcagaatataacttaaaaaatttgggaggtgggagaaaataaagttaattttatctctgttagaagagtcacttagtaatttataaaatggaaacacatcatttgaaaactagtgaccttaacatttcaatttaaaaaataatcttagagtcacatatattttagagacaatatatcatgtggtgaagaaaatttaatttgaagttcagcaatttcttcagttttcattttctttcacttctgttcaagtaaaattaaatgtaatgtttatacttaaaaataccatatctagaataaacacaatgtcgtaaagttatttcactcttttccctattcttcgattttaatttcttttttgtcaatctacatctccatcctcttatctgtgcctattcatttagatacttaaaataatgttcattaaatggtaacattaatcatatttatagaatcattttgggataatctgttcctttttttcttatatttccttgtattatgtaaaatttttataaatgaacatgcatcatttttatagaaacagtaaaaagtgattattctttttacaaatttaatggaagagttaaattaacaccatatgtctttttcttttaataacctaagatttggggcaactggatttcaagtctcagcttagcaaatagctggttgtataatctggagcaatgtataaaaacttctctagttcctagtttcatcatcgtgaaaatgaagaaattgaaccaagatgtttaagtttcatttcagttctgaaattctataactcagatgctgatgattaaaatctccctacacagcgttagaagtaacactttagataccatggagatattttacctattatcttggctatactgcttttgaggaaggtatcttacttcctatgaaatcttcacagtattctcatttgaagtaaggctcagatgtgcagaaggaaaatggggcctgatataataatgaaacatattattttttcaagaggttgtagaacagaaaaaggacagacacaaacagaaatgcagtattcatgagaaaacccttaaaatggcatcttttcctgttatagctattatccttacagcaggagtgggaaatgatgcaaagatatttgagctcttatgggaaaactgtgtattaaagttaaaaatgatgactgaggtcaaataaattggatatttgtgacagatatgataggcctagagaatgctgaaggagagcttaacaacagccctatggcctactttgtctcattatgaaatttggttatgtagagtaaaacacaggaaacaaacaaatgaggattacaatagcatatttcttaggcctaagaaaagcataatggcaagcttgttttgcaattcggtgaataaaatatattcaaaagacaaaagacaaaattcctatggaaccaaaaaagagcccacacagccaaagcaagactaagtcactaaaaaatgaaatcaataatttgaggcctaccgatttccaatgaaatttgtctttcccttcttcagtgcttgtgaagtctaaaaacccaagtaattagctttattttggatgttcaaccaccaagcctctacatttttggttgaaaaatagatctatatgaagaattttcaaaagagtaagctaagacaattagtatttacttaaatcttataagctattttataatataaattattttataattattcgtgaatcccagggttgggaattatgaaagcgttgagtatcatccatctagcaagttagctagctatatgtatatgtatgcatattagaaatatagtcagcattctctctgctgatactgtaatatttcttaatgatctcagagtgaaattttcatctataagttgatttttctctttctgattcccggtgaactgacacagcccaattttcttctaagagttatcaggctcaaatcctgacttcaatgtttattacattataataagataggtcagccagtctgctgccatcaagaagacatgtaatggaaaaatgtaatggaaaagtttcctgtttttgaaagccttttctcttggcaaagttcacattttagttgagccagaccctgtattaagtgcaggtggtcttggaggcaacagacagtataagccattttgataaatggcatcgctattactttggatataaataatggcagccctaaaatatagaaaagaaattaaaatgggtaataaaaagccttgcctatcttttatgatttttaacaactgagcagctaaaactgggttataaatcactgaaaggaaattgagaactaataaagttgtggagtctttactaataaaaggaaaacatttgacttctgttaacacctgataaaagtgtactctgttgtcattcctcatttactagtcattttctttactcctgtgatatttggctatctaacttttacccaatttttaaagattagaagaaaaaatacaacatagcactcgaattggtcaaatctgctataacctgtcttttgcaagtaaacccacctacatggtaactagcagcttttgaaacatctgcaccctaaaggtttgtggctgtaaatttaagccattctagcttttgagaaatgcaaataataaaagctcatcaaaaggctccataattctcacatctgactagatggaagcatttctgactactccaaattaatagcagctcccaaggccttataagaagagctgtcactgagaaatatactcacaaacaaataagcaattctcttccaagtttgatttgttaaaggcataaagcagcaactcttcaggacaacctagctggattatgaagggagtgatgagctacctttagactcctgatagggtaacttaagcccataccacacaatatttatgaacatctcttctgaccctagaccagagtctgcaacatactagaccctcctgaagtatcagctgactgaaggaacagacagaattcattgttggtggtcaatatgaagcagccagtgattaaagtcagaatatatccctaacagaagctgctgtcctgttgtcaccaaaaagctaaaacttagagtcatcctagatataaaatcaaatttggaaacatagttagcactacaccatctttcagttatatttggtataaatattgtaacttttccacatgaagtctcattttccccaaagcccggtgtcagtttcattcaggcatgacccagtgaacgtaaacttgaggacattcatatgtgccacaaacattttttaaagtgaaagatacttcagatctgtgaatattaaatatttcatttttaagaacaaatatgcagatgaagtaactaaagtgtattttccatttcttactacgatttgaattgttgcagagacagacatgacaggaacctgtcattgttatcatccatggagacttgctatgtaacagatttttacagggagcaggctttcttttctttggtctcatctagagaattctgtgaattttcccttttaaagtgaacatggccatggagagggaggttcagacaaagagcatgggaccaggaattaggagacatgaaccttgccccatgtcctaaatcttggtgtgaccttaacaaaactctccataggtatttgattcctcatatctaaaatgaaaactggactattcagtcattaagatccctcagggtgctggcatttcacaatgtgcaaacagttccaagctcattgctgtggaagtttccttgtttattgcagaggaaagagtaataaagtccacatctttggtgatcaaagagacaattaacatttcttctccactgtctaggtttgaatgagtctgtcattaattttgacaagaatatttgtcactggaaatcatcttttagatctggtgctttacactaatgaaaaatcaacccgcagctgaattctatcagacattcaaagaagaaatggtatccatcctattgaaactattccaaaagatagagaaagagggaatccaccctaaagcattctttaaaaccagtatcaccctaataccaaaaccaggaaagaacataacaactaaaaaagaaaactacaggccaatatccctgatgaacatagatgcaaaaatcctcaacaaaatactagctaaccaaatccaacagcgtatcaaaaagataatccaccacgatcaagtgggtttcataccagggatgcagagaaggtttaacatacccaagtcaataaatgtgacacaccacataaacaggattgaaaacaaaaatcccatgatcatctcaagagatgcagaaaagggatttgacaaaatccagcatcgctttatgattaaaaccctcaggaaaatcggcatagaagggacacaccttaagttagtaaaagccatctatgacaaacccacatccaacaatatactgaacagagaaaaggtgaaagcattcccactgagaactggagcaagacaagggggatgcacactttcaccaattctattcagcatagtactagaagtcctagccagagcaatcagacaagagaaagaaagaaagggcatccaaatcagaaacaggaagtcaaactgtcactgttcacgagatataattgtatgcctagaaaaccctgaagactcatccaaaaagctcctagatctgataaatgaattcagtaaagtttcaggatacaaaatgaatgtatacaaatcactagtgctgctatataccaacagcaaccaagcggagaatcaaatcaagaaatcaaccccttttacaatagctgaaaaaaaaaaaaaacttagaaatgtgaataggaagtgaaagacctctacaaggaaaactacaaaacactgctgaaagaaattatagatgacacaaacaaatggaaacacatcccatgctcataaatgggtagaatcaatattgtgaaaatgaccatactgacaaaagcaatctacaaattcaatgcaattcccatcaaaataccatcatcatttttcacagaactagaaaagaaaaaaaaccctaaaattcctatggaaccaaaaaagagcccacatagccaaagcaagactagcaaaaagaacaaatctagaggtgtcactttacccaacttcaaactatactataaggctacagtcaccaaaacagcatgttactggtataaaaataggcacatagaccaacacaacagaatagagaacccagaaataaacccaaatacttacagccaactgatctttgacaaagcaaataaaaacataaagtggggacaggacaccttattcaacaaatggggctgggataattggcaagccacaggtagaagaatgaaactggatcatcagctctcatcctatatgcaaatcaactcaggatgaatcaaagacttaaatagaagacctgaaaccataaaaattctagaagataacattggaagaactcttctggacattggtttaggcaaagccttcatgaccaagaacccaaaagcaaatgcaacaaaaaaaaaaagataaatagatgggacttaattaaactaaaaagcttctgcacagcaaaagaaataatcagcagaataaacagacagcccatagagtgggagaaaatctttgcaaactatgtattcgacaaaggaataatatccagaatctataaggagctcaaagaaatcagcaaaaaaaaaagaaaaagaaaaaaaaacccaaataatcccatcaaaaagtgggctaaggacatgaatagacaattctcaaaagaagatacacaaatggccaacaaacttatgaaaaaatgctcaacatcactaattatcagttaaatgcaaatcaaacccacaatgcgataccaccttactcctgcaaggatggccataatttaaaaaatcaaaaaaataaaagatgttggcatggatgtggtaaaaagggaacacttttacacttgctggtgggaatgtaaactagtacaaccactatagaaaacagtatggagattccttaaagaactaaaagtagatctgccatttgatccagcaagcctactactgggtatcgacccagaggaaaagaagtcattatatgaaaaagacacttgcacacacatgtttatagcagcacaacacttcaaaattgcaaaaacatggaatcagcccaaatgcccatcaaccaagtggataaagaaaatgttatatatatatatataacatatatatgtgtgtatgtgtatgtgtatgcatatatgtgtgtgtatatatatacacacacacatatatatgtatgtatatgtatacatgtacacacacacacacacacacacacacacacacaccatggaatactactcagccataaaaagaaacaagataatggcatttgcagcaacctggatggaattggagaccattatcctaagtgaagtacctcaggaatgaaaaaccaaacatcgtatgttctcactcataagtgggagctaaactatgaggaaacatgatacaatggacttcggggactcaggggaaagggtgggaggggggattagggataatagactacacattgggtacagtttacactgctcaagtgatgggtataccaaaatctcagaaatcgccactaaccactaatgaacttatccatgtaaccaaacacacctgtttcccaaacatttattgaaataaaaaaaaaatcaactaatgctcccaagatagatgcaaaagaggacagccaatgtcttaatcagtggtccagagaacatcctatggaggatttgctcccaattacacactcctgagccccaagtcagatttactgaataagaaattcctagtttggggcctgagtctgcatattttggaaaagcttcccaggtaatttggatgctcattgcgcctccactcatccttgaaagcagtgatttaaatgctagttatctaccagttgaagagaatggtgtgatagaaaccacacagtgaactacctgggcctctgataatgtacaaggtcaggaagctggctgtattctatttttgtctgcatagctgtttgctatttagaaattcaaggaggctgagggcttggtgcaactgaatttatctaaggcttactgggtgctctctgtggctgcagttggtagcattataatttgggtggtgagcagatttgcaatttttatattaaacttgaaatgctagtaataaaactgttataatgcatttgaataatagatggtcaatagttgtccaagacaaatacaaggccaacagccaaattcttttcatttctttctttggtgctgctcagaaaataaagaaggtgagaaatggttcatcagcactaactgaaagtccatctacaaattaaataacctcttgcctagtcgttttcttccctcccactagtatttactgggtacccagagaatgccagatgtgagtgaacaattgctctaacacagcaattttccatttttatggaaggctctcaaaatatttttctctcagctttgtggggagaagggaactccctagggatgtggctgattgaggctgattgtgtttgaaacttggggactctaatgactcactgcgataacttagttatgatgaagacaagcaacatgaactgttccatgtagcttatactctcatgatgcacaggcatcccctagcacttgttttgattgtacattttaatacatgaaatgtctcattttcaaaattcattctcttgcctctaagcgcagcagcacaaactggcttcagaatcatttagccaagaatatcatcaaaagaccctcaatgattgattccagtacttcatctgtttcacagtgagatttacgtccttgaaaagtaaggttcctgacttagtccgttcgggctgctataacaaaataccttagactgggtaatttataaacaacagaaatttactgctcacagttctggaggctgtgaagtccaagatcagggtgtaagcagattcagtacctgctgaggtcttgttctccacagatggccccttctgtgttctcacatggcaggaggtgggggcaagctccctcaggtactaatcccatttatgagggtctcatgacctagtcacctcccaaaggccccatctcttaataccaacaaattgtaggttaaatttcaacacaatttaggaggaacacaaacattcagtccatagcagtgctcattaggctctagcatttgaaaagaaagacaccctgttaaatgcatgaaaataaagtctttttaaaaaaatcagacaggagttggcatctgtgaatctcttggaagcagtaactctcctgatgacctctgaccttccagcctcatgtcatccaactttattaaaataccagaccagtcatccaaaaagctagggggatactagctcttcactactcatgctaatggatgaaaaagagatgtggttttaaaagtttttttctcttcagcttgatgagctatgtttctgttttgctggactcttggattgtgacctggatctataataggtaagcttcatgaacaccagacagaaacagtaactctatctccttctcatagaaacaaaaagagaacacttcatgggggctttgtttctgagaatgtaacttgattgatatttaaaagccttacactgattttaatagagtcaaaaatacatagttttcatacagaaaaagcactacagaaattattcgcatgataaaatttcaaagatctgctctctggaagatgctgcataatacttcatagttgctttcaataacacattgtatctgaggctctcacaatcttctacaaactagctgtggcattatcactttacagacgtgaactggaaaacacaggtttaatttgattaagattccatacaaggtcaatgaaggggaacagaaaatgaatgccagaaggagctattatcttgcataatacatgtcaatagatgaagaggacaacttaattcaaaacaaaagaggaaacccatttgaaatccagaagaaactgctaagattaaagaaaatgaataaataaaaatacaacaacaatttaaaaaaccctgagtaatgcagcacctccagtgaagaactcagcctactcatacagtgaatctgaaaacagaatggcaataatgttcgtatatgattgaagatcacatgcagcaaatctgtccttcttcagtattacaaagtacaaaaaatttaggttttttattcatataatctgtcatcatacaattaaaacaaggactaaattttcctttggtttttgcttttcccctgctctcaaccccaacttcccagaattttatggaacccagtgtcttcttgtctgctcaattcctaagttctgtttgtattaaccttaggttacttctattttattcacagacttatcttatatctaataatcaacaactccttaccgctttaattggctcaccacccaaatgtatataaagtattcctgaggggtcttcagttgacaagcacatcattctccttaaggagacattaaggtaaataattaaccaaatgaatgtgagtgaacagggggattagaaggcttagctgaatgatggttaaggaattcttaaactttctcactagggtgatggctttcaggactctcagtctacctaacttagtgcattctttactgatcttggtttttcagaaagtctttaagaacatttaagcaattatcagatttcttcacaaagaaagtctaacacatgaaccagaagacatataggtatgttcaagaatgtttacagagaagtagtcacaacagcaataattgggaaactacccaaatattcatcaacaggattctggaaacctgataaggtgacatgccaagtttgttatgagacaatgttgctcatgcttatggtaaaaatgacacccctgactccctgcctcaataagttgcatctggacaggcagaaatgacagctgtctggtgggaagccatagctttaggattctctgagtgagatgactggtaactcagcaggctgttgggactctagaaattctgcctatggagttgttataagagacactggctcccttctggcacgggattctaggccagagtggttctcacacatgcccatgtggggctcaactctgtacgttagctatcacctggagaagtgaggcaagaacagctctcagacagccgagtggactgctccagagactgcttggggggcttctccaagcccttgtgccctgctggcaagcagtgattcttgtcctgtgtccttcccagggaaactgacgctgagcatgggctatgggagttgtgagtctgaatgcatagctggacccaggaggacttcctggtgagtgttgcaaatcattcctactgagggttagattaagaagaactttcacattccatgtatatattgttgaataatgtcaatcttttataatgaacatgtaatttattattggggaaaaaagattaccaaaagaaaacaaatctccatcaagagacctgtcacaccaaactgttaaaagtatatcccccaggagaccacggctaaactccagatgaaatgtgaatgggcaggatatcattttagacaaagttccaaaagactataggctaactaaaactaaagtgttaaggtgacagaagagtctatcttggcaagcatattcctaattctgtatattttgaattccagtgtgcttttcgatacttcttagcttgattaaaattttggagccttgtatggctaggtaaatttaatatgtgtcatttaaaaatatactatcatcaaacattttgttacccttgcaattaagagagccagaatagtcttctacttccacagaaataatgagcccaatctggtgaaggagcgaagtaaataaaatatgttcccacttggctataaaatagtcacccatgagaggaaattttcaggatccttttgtatcaaccctttggctttcctgaaagagttaggtctttagcaaatcaagtgatttctaggatgttgtcaggccaaatagtccacttggaggagcagattagcattatttacagagatggtaataatataagcactaatgagggcaataataattgacaaatacgtaataaacattgatctcaagtctcaacaaatacttagcaagtattgactatgtgaagctgagctgcataagagtaaaaagaactttacaggaaaagagacagctgatattcaacttaattttaagctttatcttaaaaatgttaaatggacaatgctgttgtgagtgaaataagatttagatctagaatgacaggctactgtgtttttagaaataattcttttttcccatttttatattattgttggtttagaaacagaaagtagagtgcaatggcctgggactggcttctgctcatcaattgtttgatacaaggcaagttatttacatctcccactcttcagtatctgtctctgtaaaacaaggagggtaacagcccccacacttcccagtgatgtccgagaaccacatgagatgcacagcacagcacctggcccacggtcagcaccttgtaagtgttggagttatggctatggacacaaacaacagcatggcacacctcggggtctgtacctttcaacatgtggtgtttgttttaggagcttactacaaggtttcaaatcaccactctcatagtctgttttccttcaaatacatgaacacacgtgtttgtgggttctcctttatatataacattcttttgtccttatgtgagagtaattataagccacaaaattaaacacaacatggagaaccaatttccattcttagctaacattgagatcctgagcctgtcttcaggaaaagaggcttctgcgagcagaagtcgcctatgaatagaaatggtctgaagactgaaacttagctagaaattgaagcagaaataaaagcactttacttagtgtaaaagaaataaaaaaatttttcttaattattcctgatccaaacaataacttgtatttttaagagaaggttcataatatctttctcctttaaactttaggcttatatccttcatctctcttgatagttctaattgggtgtttaaaagtatcctcaaattaatgtctaaaaagaattctggatttgagctctctagcaccccaaccatccatactcggtatggccattaaaatgaccttttaagtgtataaataaaaccactttgttaccaggcttaatactgtccagtggcttcccatgcactaggaatacagttcaaggctccacatgatagagtcccttcctacctctttgcccacattcctctaccatcctcaccacttttccaggcctttttgttcttggaacaaaccaaacttggttctactgcagggcctttgcacttgctcttcccgtgagttacaatgtacccacctccagattttcacggctggctctttctcagcattcagatctcagcacaaattccactctttcagaaaggtgtgcctggtctgccccacctaaagtagtccactacccagctctcatgccacactatcacaaggcctggttttattcactttacacaagctgaaattgccttatttatttgttcactgtttattctctctacttcatgagaagagggaatgcagctgtcttgttcacaatgtgttcaccatgcagagttgctcaatacagatgagtgaattaatgaatgacaccaacttgattttcttcatttgaaggttttttaaaacatgtttgtaatacaccctttttcctctggaaaatactctcatgtatgtgataatctgtgttcattcattttgcctggtaccaagtaacttcttcgactcactggttcatgtcattcttaaccttgggtatgttttcttctattatatctttaaagattgtttctgttatgttcattctggagttttctttaaaaacacagattagagttgtatattggtgctctgaaaactcttttaaatatctctcagctaatgtatcaactagaatgccaccttgtcaggagcccaaccctgaaacaaccttgtactaaagtgtgcccaacaccttctgccccaccattctttattgctaattttcatataaggcatgtaactcactttaaatggtaactgcaacactgcatgcttactcttaaagtgctagctattattttctccttgtttactgtctgccccatatttaagatatatagaagaagaaatttttgttcttgtctgtcacagtcttactggaatccagaaaaatgtgcctacacagaatgggttgaagtaatcaaataatcaatataaaataaatacatcctggaatgaatgtgtgtgtgtgtatataaagtctgagtgcttttatttcatggaaattgcttttgctaggtattgctttgggaattcagtgagtttaattaaatacgcaaaatccgtccgttattaaaatactgatgtagtaacttaaaaccaagtggttaatgagctgcaaagctcactttaaaaacaagctgctctgtacatttcatatgtacacaatacttcttttaattgtcaatattgatttcagccacgaaaattaaactgcagaaacaaacttaataacttgattttgatgttattactgttacaagaagcctcttgggaacaaattcccacttgaagtttcctaaatttttaataaaagactagagagtgtgacagcttagtaacagaatttcagagatagcttaagatatggtttggatgtgtgttccttccaaatctcatgttgaaatatgatccccaatgttggaggtggggcctagtaggaggtgttggatcttgagggcagattcctcacaaacagcttgatggtatcccatggtaatgagtaccttgagatctgattgtgaaaaagagtctaggaccccctcctttctctcttgctccctgtctccccatgtgacacactgggtccccttcatattccaccatgattggaagcttcctgaggccctcaccagaagtgcttcatgtacagcctgtagaactgtaagtcaaataaacctcttttcttcataaattacccagtctctggtaatcctttatagcaatgcaaacaaactaacacagcttaattctacctgagctcaagattcttctatacaccagggaactattttatttacaaaaagctatttctctttgtattttatatcagattttaaaaagggtggaagccatgagaatgttaaggaaacattatttaatgtgaaccaaattagtgaaccaaatttctaactatattttaaaatgtcataaaaaaccataaaaatagtgctcaaaaccaataattggtgaaagcaggctagttagacaatgactgttgattgatctgcagtcagttcaacacaaaattcccagaaagctggacctagataatgcttcctttagttgaagtaaaatcatcttcatcatcatcattacttggaaaacacacattccttctaggaatactttgcttaaaattacttgagaaacctgtgtttgttcaaaaaggaaaagacgactaatgtattaataccctctggatatttgatctgatgcatgaaatgctttctggtctctagataattctgcattttctatctacctttccctctacgttcaatggcaaaataactgttatgacttgacttctcattaagtataagactaagcatgaatgtagtctttcttttttaaagaaaaaagtgtaaatctatatgaagaagttattttaattttaataggtctcataattgagaagttataaattgattaaaatatgtatttaaaatttaccataaaatttatgagaaggatggagttcacttactgtcattgtaatatcactttcaaaatcttctgttaagaaaatgtttaaattgtgtagaacagaaatggaacaaagaagaaaaaatttaaagttatctttgataaatgggttattgaagtaagacttagtgacactaataagctagtatctgaaagagagagacagagagagagataacattgctaatgcaatcagctcatttactttataaaatgaatgctcttaatcggagataataatttcataacttacctctgcatactttaacttcaatgttttatgcatttctcgaaaacgactgtaacgcctgaatacagtccatgtctcatctaggacagtaatctattaaccaggaaaaccaaaatgaataagcattaagaagcaaaagtcactaaaatttttcaaaagaatttaaaaattaaatttaaaaaaagtgattagcatgtaaaatttctctagaactgaaaacattaatctagctgcataaatacaacttagaaataataaatgtactttacttaaacatgcagctttggctctcagatcttgttacaggcagcttgtctatgtaaagtgaagggcagatggtcatctcttaattggttataaaaagtgtccctttttatagaaacacttttaaagaagaggaggtggaagaggaaaaaaatctcactgcctctcagtcattgttagtataataacacaacagtatattttgctttttttcagagggagaataatcaattcagcctttaataggctagctggagtggaaactctgttgcacatcagctcacatatgaaaggtcacagtgacaagaagaggcaggtagaccacatcagcctttacaatcacacctaaagcacaggccaatgaatctccaattcctttctccacttcccacctttcttctgcgctctagacccacatacccaacttggcacatctttcttcccatgtcacccaggaacctccaattcaatttgtccaaaaccatactcaacatattccctccagtcccagctctggtattctccatttcaaagcattctaccaccacctacccagcaatgccagccagagatgctgaagtcatccctgacctcccttctcttcctatccctgcattcaagcaagtgctaagtcttgctccttttgccttctaaacatttcttagaactttatccttccatcctttgccatcagcaccatttgactttaggcctttgggtctcctgtggactctgcaagagcatctcccaactgtccaccccacatctgccctctccaatctcttttctgcatgactgaaaacagatcttttagaactcaaatctaaccatttgatttgggaggtgaccctccttaaggcgagcttcatgctgctcatagaaaaagacctacatttttaacctgcccacagcagcctgtctgcaggcctctcctgctaggtgtcttcactcctgctgcatccctgaatgcgcatattctctgccacctcagggcctttgcacgggccatgctcctttatgggaacttaacttgcacataagggaaatgctcttctcaagcacaataattcagcctgattctcccgcaggtaaatcatagggccatcagtagaaagtagaaacaagaaagagagaagacacaggtgggcagctttgtaaggaggagtgagtctgagtcccagccattctttcattcgctcacttcccaaaagtggcaaatgagatgatctagggtgtatgaggatgtacatttttaaatttttcatcattctggttctgtactcattttttacaataacttttcaattgtggcaggtttcttatgagtttccttgaaaaagacatttccataagaaaacaaaagtgaatgtatttacagaaaatcattacaaacaagagtggaggtgctctgcagtagtaagcatttaaagctggcaagcacgtcacttgagcttgggaaaccctgctcctggctgtgagctggttggccttcctctctggcttgctcctcctcagcagaccccactgaggcactgagagcaaggccagcacaatcagtgaggatgtgggggcttcctccggcccacagcccaacaatccacagtcttggctggacacaaaccaggtggcaaagacaaaactggagcacaagtgggccctgctgccttccaacagggcatgctgcagcctgtttgcacagaaaagcccaggaagttaatggaaccacttcatgacctgtgagtagtaagatgcaggatgtttcacaggtgagactatactatactgggactcaagattcctcagaaagccacctccaaaagcctaggtttctcacattcctcagactgatgttcctggctctccttccttctcctgaaatgcttccactgcacttcttgggctcatgggcaatcatcagcaaaatcccccaggacctcagcctcttctggaacatccctttcatctttgctgtaactgaaacccggctctcccgtgaggaagcacttccgtggcaatgctctccagccgggactgtcttctccccccacactcttcatcctaccgtgctgggatggcggtcgatactcttgttcttcactccaacttccaaataactgctcctgtatcctctctgaactctctactctgtgagcatagtgctttcagaccctgctgctctaccctcctccttgcaggcagccattcaccctggttgcttccccaattccttgaaggtttagagtctactcactgtcatctgcttcagccctattgatctcctgcatgattcttggtaatttcattaatcacccagatgatccctccaacaccctgacctctaatgtccttttacctctgccctggtttcttcctcactcaacttgaaaaccatgagaaatcctcataagcacaaaacctcaaatctgtcccactcttgaaattctctggacaaaaataactcactactcttgttaaaaccaactgtctgctcactccctgcctgcacctgcccagcagaatggggctgaggaataacacgccaccaaacagactgatctcattttaaagtcacaattgccaccatcaagtggcaattgatgacacccaccaatcatgccacgttttccaattctgtgcactcttccattctcttacaaaatgattactcctctttgtcctcaagtctttaacacctctctccatcctctcagctgacaaccttaagtccttaaaacaaaattccagggaataatgggaagaaattgatgacatcaaaaatttttcaggaattttgttttaatggaaaggacagaagtggagtggcagacggaagggaaaggcaagtcgaaatgggagtttaagatgagagaaataatggtgcgtttaaatgctcatggagtaatatgacagaaaggaggctgtgttggtgcaggagaggagaaaattgttaattgcggtgtctttcagaaatctactcaccattccacccagactactcttaccaaggttagcaatggcttctgtattgctaaatccactggtcaatttttggttttgatcgtactcagtctatgggaaggatctgacgtagctgtctgatagcgttctcctccttcaaacatctttttcatttatttcagcttccactgctacacttttatcttagttttcttttcatctgggatttctcatctccctgacttctaaacatcgagtcctccagggctcaatcttgaacatgttttattttctacctgcactcactgctttggtgacctcatcccatctcacggcataaatttacatgtggatgactccctggatgcctgtacctctctcctgaacccagactcgtatatccgactggctacttgacaagctggcctactcagatgtctaatacgcatctcacacttatcatggctgcacttaccaaaattaatctcattcaaacctgctccctttccccatctcagtaaatgacaatgctattcttctccctgttccatgcaaaaactctggcatcatccatgatgtttgtctttcctgttcacatctcacatccagtcagtcggtgaatcccttcttgccaagcttccaaaatagaatgagaaaatggccatttctcactatctccactgttcatatgttggtcaccatcttctcttgcctggattatttttaacagcctcctagttggtctccttgcttatagtcttgcctccttccttcatttttttctcaacacaggagcctaagtgatcttgttaaacattaagtgtgatggggccatttctttgctcatatgaagcatcctcataacatgtcccatctcactcagggtatgagttcgagttcttccagtgatctacaaggatttctacaatctgtctcctccctggctcttccacaaccactttcttccttgctcatctagggtatacccaagatgctacacagcaagtatggccttagagactttgcatatgcttttcctctttctggaatgttcatttcccacattttcacatgactagctccctcatttccttcaagtctttgctcaaaagtcactttcttagtgatttccctgttggatatcctatctaaaattgcatcctctttcccattcaacactgcttactcttcttccctaaattatttttctccttagcacttctgattacctaacatggtctggatttactaatatatcttgtttcttgcctctcttccccactagaatgtaagctctaaggagagctaagatttttacctgttggtcactgcaccttagaacagaacttgacacatcacaggcattctgaagagttggaaaggggagcccccagatggacttgtcttcaatatactctgcctcttagtgacaatgaatcagcaatggcttttttaaatctctctgtgcaggcctcaaacaaaatcaggataaaggaactggacactcagcttgtggggctttagcctatggtgttttcctctttgttgctttcacagctaattaatgttgcaccattttttgaaatctctgaatagtgaaatggtacttcgaacctgcctcacaattttgggtatcattcttctttcccacagtggccccagtggtccttataagtgatatcaacttctctaatgaactgcatacaccaaatgctggggagaacatgatgatatagctaagtgatttcctaggcaatagatataaaaggcatttgggcacaagatgacaagacagcaagaagaagataaaatccccgtctaagaatgttcccccaaaagcatccaatacacccccttctgccttaataccaccctccacccttgagtgcttataatagaaggtgggatgctaccattgtgtgtgtgtggagctgggaggagaaagaaagatggcccaatgtggaaagaacttagcctgcccaaagctaccttttctatgtacagttaaatccacacttaacatcggcaatagttcctggaaactaactttaggcaaaacaacatacagccaaaccacattttctcatcaacgctgtaaaaaaatgatgttgaatgaaatgatgtcatttgaggacctgctatagttggtttgcttaaagttgcagtttccaagaacctaacaatgatgttataaacttactgtattcctctgaattgagcttagtgaggtcagtgaaggtatcagaggagtctttttgtgactcttctggtgactccaggaatcctaccattaatgacagagaggggactctctggaaccattaaccctgtgtatataatacggtctcaaaaatgatgaacaatgaaaatcattactggcatattctgggtagtgatttttgcctcttaccttacttgatattttaataaactcacatacagacctcaatgacttctgccctcgatatttcagtttactgtctaaaccagtggttagcagcatcagctgcactggggcacttgttagaaatgcatgttctgaggtctcacccacagctccttcatcagaaactctgggctggggcccagcagtctgttctgaccaaccctccagggaactgtgatgcaggttaaggtccgagcagcctgactataaaccactggtcatgttgtcacttcaaaatcagatgtctcactaccctcccaggccaaagcccttagtgcggcatttagggactttcctaggcaatcccagctctcagtgaactaaaaatctcacaccccagacaacgtgtgaataaagaaatatagtatattcgtaggtcttctgaagggtcttctgaacggcctcctcaaccacacacccctttctgtacctggagagctcctgctcagcccccagggtagtgtccaaaccatgatttttccttgggcagcagccccattcccactcctttctccctggaagaatcatttattccatcccctccatgatcccttagcatttggttcacaccatgattagaacacacagcacaggatattaattacataattaatgttgcactaattcatttatgtaactaatactaattatatatctctctacttaggagattttaagccttctaagggtataagctatttgtctttggtagtaactggggtggggtggggtgggtggactctcattgcagagatacacatttactgagctcctaccacgtgcctggtaccatattagatgccagtagttttctgagagacatacttgccattattttacttttcaaattaggtaagagttcaggcttgacctcaattggtaaaacagaaagcatggcctactggagtcttggttgctgttattctgttctggtggtttcattaaggttcacatgaatcaaagattattgaattagttacaatagtatgactgtaaaaaaaaactgcagagaatatggtgcactctcaatatatttgtaacacgagttcatagtaaggcatgagagatttaaaaattcttcactcttgagattttcacctgaattcaggctaaatatggggatgagcaaggctcaagcttcccactttatataacacatttgaatatccccttgtttatcaacacgcaaacaagatgaagatgatgagtatcaccagcaatcacatcagaaatggtagacaaggcaactgcatgtatgatcacggcacagaaaaagcgttaaatcctttcccttgaatggaaagactccatgcccagagctgaggatctgctcatgggaagcttgagaaaaaatagacagaaaggcaaaattaagagacaaaattaaagcccttttctgtcccaaattaaaattgggcatgaaatggggtgctgatgcagaggggaggaacagaagatcagtacaacaaataagtcagaccaaaacactgaattattttatttaatgttgagaatgcaagatatcattactgcatatatttgaggagcaaattcattacttctctccctctgagtggtttcactgatacaaatccttctttcctgggccataaaatgatcaagcgcaacttaaacgccataaacatgtcctcaagatggactgcatttacttataaacaattctcaattgagtgcttcccacaaatttatgttatatacttattttgctggtttaaggattgccagtgttaagatctgtcatcagtagatatttggttatgtatatctagcagtgtaaagaggagaatcaacagtttttcattcaaggaatcatactccaaccagctgcctttacagttacttgaagagtcctcttcagcaatattttttaaagcaacatatgcgggagctacctcaagcatatttttaaaaaaatctttgtaattagtaactgtttagaagaaatagtctaatagcaacctaatatatactaaaaaaagttctgtctgatttttgcaaaataaagcttaggcagtgacataactatgaacatgtttgagcaaacaagaaatatattcctaaagaacatgcctgtatataatagtaacaagcattaatggataaggtttaattaaaatctccttacatactatagaaaatgaaaactaatttatactctcccagctggtgggcctcacagaggaagagacaagatgctccatggagtatggaaataaactattggtacttctattttttttttaatcttattctttctagatctctacttctgaaagtgtatcctaataaatactatgtacagttagtaaatgttacactatctatacagataaaaatcaatatagtgggtgtgcctgctcaataacttttccagcgataactatgtgtgatttgaaaagtttaggctctgtgactctaagctgtggctggtaagagatgcatgcaggaagacctcaatgtttccaagagagcagggtctaattcattaactaattctactgaaagtcttatgcagcaacataactatgagtgtgtctgagaaaacatgaaatatattccaaatgtatgaatctgtatagtaacaagcattagtatattagatttaattaaaatctcttagacaactgttgcaaatggtactaagccagaagtagtaaaagaagccaacaccccattaatcacatcaatatcccagagagatcacaggctgccatctgattgctcctcgatgtgatctgcctctgccatccccaaatctttctgaggacagacagtgccggtgctttctgatttctgtgggcatgcacaccccataggtgctgactctgcctggctatcttcactgtgacctcttcgtggtctcctagcttatctcctttctcttggatcaattacagaggccggactccaggttagtcctcctgacactgggagaccagcacctccaaatccctgactctctaagccttcttgtgggtcccatcagaacagtcccccaaactgagtgcctatggtgtcagcctgctctcctgggtgctgtcctgcacgctgaagacagccccctaggagggtagaatgaatttacactacaggtatgccattttagctcagcagtcactcctacttggaaatccttccaaattccattctctgcgatgagtatttcaaaatgttctagatttttccatccttataatgaactcggtttactgagatgattagagtcacctaagatcaactccctgagtatccttttagcacatttcaaaatgatgctgttgctacattcatttcccttccttcaaaacctcttcatcctcacttaattttcctgattcacttctacctgagaggagagcccctctccaaggttagcctccttctgcactgcttcctattaccaagtcatcacttgtccttttctacccttgggcctctgtctttgttgttcccattgcccagaacacctcctctctcgtctgcactcactgaaatccacccatcggtctcaagcaagcaaaaatgtacatctgccttgacgtcctccgattatgcctccatgagcccattggctccatgctgctcaatttttctcacgtgtttctcttcccacacttaattgtctcctgaatggatgaactagttattcatcttttctgttccttggtatcctgatgcttctactatggtctttaaaaaaattatattacaggtaccaaatatttgttaagcaataaaagaaataatggagacagtggcactcacagcctcttttcaatatacacttttctgaaacattttctaattactttttcatcctgaagtgtgggcaacagtgtgacctgcattatagtccttttctgacttacctgtaactgtttaaaggttttagaaagtaggcattacgggacgtaagagggcaaattgtaaaacaaagaaagagaaaatctcatttaccaaattccctttagagagaacattgatttagaaaacatactgtgataaaacaattttagggtaggtaggtatgaggctcctaaaagacacgttaagaaacaacagatagtctctaaactgcctttaggagggtgggtcctgttaacctacacagtttagggataaaggctgagccagtaggctggagctgaactcctaggcttagtaaggtggcagcacttggagctcccaggaatagctaggcaggaggaacggaaaggctggtgctcttgggagaacacaatagtctaatggggtattttaagttatttgctctgagatgtatctgcaatgtatcccctcctctggctccattagggacactttgggaacgttcaccggcttctccttctggggagcccaaaggagggcagagctctgcagccaggtgggagtaaagaaagagagacttggtcagcagccatccagggacacaaggcaagggaacagttgccatctggaccatgtccgcaactgtgtaacagttcctaatccaagcaggcttccccctccagtgcagtgggccctgtgaacctgaagcttgaccaactgcagaaattctgttcaaaggtacttgagggaagaagctgggcctctgcaggaagagcctggttctaaagacagcacattgcacaaggaaagggcagtccaatgccagtcctcgatctgcccgtctgtgggtaacacaaatgggaggtgtatggagcttggagagtgaagattcctgaaagcaggggagccgctcaaataggagattctacagccattcgattcaggaaaatctcagacacatttctatgcaaatgcatcaccgacaagtacagaaggtgcctcagagcctcaggcttgtgaacctggtccaaacctggtgtgctaggaagcaatgagcctagtgattgactcccaaattacactcacactcgaggcagctatgaagtgctactaagtccaacagggctttcaggctggcccaaatcctgccttttgcaataaccagaaataatgacttcccgatgctttaacttcagcatcttcaaaacaggctgtaataccgcttatttcagtatacttacctcacagggtagtttgaaggtaaatttaataaaatgtgtgaaggccctgagaatctgggagatgggggcctttaagtacaagattgtcactgataaagtgcttccccctctgccaacacctctgtgaagcaggtgaggtatacggggacttattctactttaacacggtgggaaattgcgagaatgacagtctaagcaattttcctttaaattacccagatattcagaggcaaaccaaggaatgtaaagtctccaccagtcatcatgagataataaaataatgaaaagctctgaattaactctgacttggatcctgactttagcccagcaacttattagtcgtgtgattttggataaattactcaattctttcaggtcccgatttcttcatctgtaaaatgcattcatgattcctaacctgcagatgaactaaaaaaaatgcgaagagactagacacagtgcttggacactcaacagatggtgactcctggcactgtgactccgttcttaaaaaggcgttatattattcattactgaaaggtaagcgtatccatgggtagcaactgcaaaagggaaagttcaaacgattttgtgattttaaaacaaattttattctaggaagagatgcaaaactcccaaaattctgaaaccaaggaaggaggaatactaatataatcttataataaaaaaataggaatttgagtgaaatggaaattgaaggcatgaccataaaataataactgcttttcttctgtgcttgtaactcaatctcatttcttcttagtcacttcttacacaggaagcatttactttgtgaagataaatatggctgtccaaggaagggcaatataaaagatcagttggtttgtgtgaaaaccgggaaagaaaaaaaaattttttttcacttttcagtagaagactgaaagtttgcaaagagatgggatgggtgataaattttttaaaaatcctaggataaaatgtgattcttcaagtcttagtgtagttactttcacttgctatttatgttttaaaatagtacagaacctgaagatttaaatctaggtggacatggcataagcaacactccatttgtctcggccgtgctaatacacgtgcagggagataatccatcagttgctaataagcacagattcagacgccaacactctacactttctgaacatctatattctatcaagtagggagtatttccaaaagatgtatctgtacagagtttatctaatagactggaatggctcttatttctgttctgccaaataaagagaaatttcttggactgcaaatgtgattgcttgaactcccaaactgcaatttttctaggcatttcttcttcatgcttcctggcaggccaatctaccatcaaattcttcaggtttaccaaagccttaacaacagccccaatttacaaagtacccatgacttggtcagcattcaaggcaaaaagttaaaacatacacaaaaataacagtagattttgaaaacaggcaaggatttgaaaacgaccattatctctagggcaatactaaaatatagcctcaacttataaatgtgtagaaagtagtgatatttggaaggtacattaaaatgagtaagtaagggaacaagtatggctcagtgcacttagacctgacatgaacattaggtatcttgatctactaactagctgtgtggccttgggcaagtcattcataatttcctaattggtgaaatacaaatactacccccattttggtacattctccaaatttgtggaaatgtctagcaaaatgccttgggtaaagaaggtgcttgatagatgttagcttctttccttgaagagctgcaattgcctacagagatcagtcaagaacgaagggcagtgcggtccagtgcatggatgttcagcgagagcaggagtctaccatactatctgagaacatccaattgtgctatagaggatggatgcagctaattagtgttaaatacagccagtaaataagcaagaagcttatgaggtataggcaaatctcataggatctgtcaaaacagatctaggatagtaagcaagtagcctgtgaggtacaacaaaattcctaaggtgtgcaagctgtgttaaatacaggccacaggttgataaactgtaagacatgccaaagatagaataattttaaaaaaccaaacatgatggaacagatgagaatgttacttagggacggaaagggagggaaatgctgcctcatgatatgcaccctctgggatgacagctaagtctcccctgaactgaccagccttgatgacaaccagcctggtcccatcctggtaccatatgtgctctactggagaagtacaggtgaaacccaggactgctcacagcaggtggctggctgggtgtgcctgtgcctgcttcctttcatggagaaggtgcactggctctgggcaccctttgtctgccatggcccctcgtctaaaacttcactctggtccttttaagcacatagtaagtacgaaaggctgagatgacagagaggggacagatgaactagttgtgaccaggggtcagatagaacacccggcccacctgctagcccaccatcagggtgccacctacccctccttcctctacatctctgtgtgcttttgaatgctctgtgagcctttctgtacggtgcagttggactctgagcatccctggaggccaccatgtcatcaaggtgattttctccatgacaggaaatcccaaggtctatggccaagtggagggcacacacctgccctaagaggagctgctgttttgccctacgagtgctgccttgcaggaatgttggccctagttcctgcttttactgacttttcacaggatcttggcaaatctgggtttctatgtcaggtctcccaagttttaaatactgacaattcatgcaaaatttaaaaaatctgttcaggccaacaaaaccccatatcctccaccaccagtttgcacctgctgcctcgggttaatattgttccacgactttgtcagtccctggccccacggtgcctgccatgtggttcttcagttgtaaaaacaagatccaatttgaactgctgccctgcagttctgcaatttagcatgtctcacttcagggtcttttaagttcagggaggactcagcagatgagatctcttggccctaagtgtctagggccagactgactgaaattagaagggggagctcacagacctaagttcacacaatggaaaggagaatggctgccactgactggggtacttgataattattagcagatggtcgacaagttttccctggaacacttccgtgaggttatacatcctcgttatcattcattactcatgttttctctgcttctccctccttctcaggccactgatcaggagtcagagcagaatgagacaagaggagactgttactatggcacctaaacaaaacccagatgattaaaatcaggaaagcttttgtcctggacatcatgtgtgtgacctaagttgtctgtgtgtagttctgcatttcttgggtctctaagtggacaaaagtgatactggtcaatggggctgatgccctgcagccatgtgagaaaaggcgggcacctcggagcgtagccggaatgcagaaggctccttagaggagatgacaatgggacacgtgcttctaagagcaaggggctggagggtgcccggcagccaggacaatgtccagagggtgggcagggggcatagaggtctacctctctgttaaggaaagccaagacaaaacagatgtaccctgcgggtgctgaactcagcccagagccaggacatgggtatactggagcgctggagggtggtgctgagaaggcgggagggaaggtggggaggagggaagatgggaggctttggcatgcttggactcggacacaatcaagaagctcgacttgcccacactctccctgcatgactaagagccaccagccacatcacgaggatgagcaaggggcagaatggctcatcagtgactgactccatcagtgcggatggagcatgaggagctgggtgggggcgggggggaagtttacaaagggcacacggtcactcagtcatcaccgaagcgccagacaggctgtgcctaatgagagcacctgtggccaggctagcatgcatcacactgctgggtgatccactgggtgactggtaccagtcaggcacggggtgggcactgggggggggtctgtgtcatacaagactgacaagggccctgggagcttgtacccacaggggaagatcagcaaacaagacaatgactgaaaataaccagactgaaagcaacacgactgtgagctgtgaccttggttgtgaaagaaggggagtacccctggtgacaggatggagaacagggcagggggcactactgcagatgaccactcagaaaaaagatgagacaacaaactcttctgccgattacttccagattttacaagaatagaaactctcgggaaacaaaatattaaaaaataaacacaccagtgttggcttatttctttatgttaccgtgttgacatgtaagttaaaatgcaagggatttcaaacaatgctggaaacaccagcttatttctatgacatgagtgtgatagtctctgctcgtcttaaccatcaatttcccaggcccgtgttttgtgctatgctgaaatgtgatttcaaaattaaattttacccactctggtcctaactaactgaaaatggcaagcataatgcagcgtaactgatgccacgtgtcagtgactgagaggcatgcgaagcggggttgtaagatgactgctgtcatccggttaatggcattacttgtggcaggtgcagctgagcgcaggcacaaattttgcagcttcattctgctgaccagcaggtgacacacagcaattttcagcctagaacgtgctgttctcagagagaagccagactggcactgcttcagctttccccaccccatctctatctctgccaccagtcagcaggacatgcatctgcagacacagtcccagacggatgtgctactaggacccgcaggaaggtacagcttcaagggtaacaggaattgatactctgacccagggtctcctgggaggagtaaaacaaagtggggagaggggcgacaccaaaatgataaccttttgtatcatcaggtaagaatattaaaacaaacaccaacaggaaagaaatgaatacacaaattgtgacatatccatacagtgggatgctattaatataaagaaacaaattactgttatactcagctacatgggtaaatctccaaaacattacattaaaggaatgcagccaggtacagaagataaatgccgttggatcccctctccatggtttgctagagcagacacgactaatctgtaggtgcagagggcagatcagtgcttgccttggtgccagaacatgggcactgactgcaaacggccaccagaaacttctggagggcctgcaaagttccaagtcctgaccagagggctagttacacgggtgtatacatatgtcaacactcatccaactacacttaaaatgtgtgctttcactgtatataaattacgcctcaacagagttaatcttaaaaaactaaatgagatcaaacaacaaaaacctgtctacttatatatcctcagttatttcataaaagagttgtttttaatgcccccaaataaagcaggtatagaagacagtccttttgaattaaatagattttggtttaatgaaaaactctattattctcattttaaagaccagtggtggaaacctcctcatggcccagcaggggtcagaagatgagcatctgggaacccccgttgactttctgccctcccttgaaatcacacgccctgtgtcgtccctggaacattcccttaacaggctcctgactacttcacgtggcaatgggcagaccaaattggagctcccacactggggattaaaatgaaaatggccaggaagaagcaatgatttcaatgactaatgagtcctacctaaaaaaaggttggcagaagagcgcaggaagcagagcgggtgaggagggcgaggggaagatgacaaaggagaacctgggcagctacacccctggcgtgttgtctccctcctggggcccctcaggcctcaacaccaagtgggccctggtgtggtcacacaaatcagctgggaccctaaataagctggcagtgacaccagcaagctatacagcaaacaggggtcttataccagggggtgtcagaccctgccctgctggtcacagagggcacagcgtctcactgtgtgtactcaggaccatcatgcgggataacgaaaaacaaaaactgattttttaaaagagaagcagcaaagatttttctaaattataaagtgtaataatatatctatgtatgtacattgatgttaaatctcccttcaaaaaagcttaaaactgaagagaatagtctcttttaaaaataatactttttaccttagcctccttaaatagccactggttcaccaagagaagaatttagtagtagccaaaatattaccatatattaccataagcatgactatttgttctagaaaacagggcctacgcatgaaatgtccaaatgactgagagaaaaggtcagcaatctaaattttaaattccaaatgctgagggcaagcaaacaaccaaaaagaaaaaaaatcccaacaaaatccaaaactctcataaaaacataattgtacatcaaaagtcattaaggggacctcacagtaaactctcactcatcccatttttatttttatttctttttaataacaaacacttatccaacacttagtatgtggcaggcactgtttcaagcactttacacatacaaactcatccactcctcataccaacccaatgaggggggggtttatgattcccatttgacaggtgaggcacagtgaggctgtgtgacctgctgaggttgcctggagatggcaggatatgaggattgtgggggcagggggagggtatgctatttagcagctacctctttgcctggatcgaggctgtttttgttgttttgttctggggaaggcctgtatattcacatcatgtctgtttctcatactaccccatgacaaggtatccatatggggtggaaggcttccacacacctacctgtcaaggtatcaggaggccctgcctaaacggagaactagacattctccaagttggtgctaacacattcctggtgctcataattatagcacctagggacgaacagaaaaaggaagcggaacaatgacacgcttcagaacttgctttgagaaatgcaaagaaagcagagctctgtggatttggattttatgtatcctgaagtgatcacctagattccataaggcctcatagaattttctgtatttggtttctctaacttgcatgggcagtagcatcttcacaattttggccaaatctgcacaccacctgattattatttgcttgtaatttttatttaaatcaatgcagtttttaaaatattaaatatctttttatctgagttctatacatgaaattgatttaacagttatattttattaacacatttatctgttaaagtaaaataaatccgtgtaccaactaaaatcattgcatgtacctcactgctgttgagttctatgtgctggggaattctaattctgaactaatggaagccagtcttcactctctaattaaaaaacacagtcatgatgcaaacacaacttccgaaattgtttttatattcatgtataatcacatatatgtacaaatggaattctacacacacacacacacacacacacacacacacacaatttagaatggttgagaacaaatgaaaaagaaattgaccaggagatagatattaggtcaggggcagtgggaagtagtggatcaaggacatagcgtaacatttaaataagaacccacataattggataagcaaagttaagaataacagcaaaggctgggcgcggtggctcatgcctgtaatcctagcactttgggaggccaaggcaggtggatcacgagctcaggaggtggagaccatcctggctaacacagtgcaaaccctgtctctactaaaaacacaaaaagtcagccggacgtggtggcacatgcctgtaatcccagctactcgggaagctgaggtaggagaatctcttgaacccgggaggcggaggttgcagtgagctgagatcgcgccactgcactccagcctgggcaacagagtgagactccatctcaaaaaaaaaagagtaacagcaacaacacacaggcatcatgctttctcaatgaaaacctcaaatatataaactgatgccctgtttttttttttcttttctaacggaaaacttagtatatagaaataaaatcctaaaagtctggttagctagaaaagaagttatttacatcatttcctcaggaaggttgaaagaatgtgacatctgaaaagagggattcctcagagcccagggctgccctgagatgcatcaggggtggggacaggcaggggagacggctggctctaggctccttcctccctccccactctgtgtgtgcccagcagctctaggcttccctgccttttacggtgtccttccacataagatattctttgaacaaaggagtttcacagataaaataaaatctggagaccactggtactttccaatttcctcattgtatcagtggggaaactgaggatcagatgacttatggctgctcagcaaattgcagcggggtcacagtctacagaactcagtgtccagattcatggtctggtgttgatctgaacaaaaccacctacagcctccaagaacacccttatgcatgcacacactggtgatcctagtggacttcattacatcaatacccttgctgatccttgaagaaaaagaagtgtgatttatcattactttcttgagaagaggatggtggccagcaacattatttaataaagtgttatgagtcaatgaaagcaaattagcaaaaagatgaagtcattatttagaaaaccatgacgtaaggaaacaggcacatctcttcctgaaaagttgtataaatcaagaaacacttgaaacaaatgaggagggcttcctaattcataatagaaacaacaatgaaaatagcagtagtaatagcagcaatagctacaatttactgtttataccagccacaagatgcacactttatacgcactgatattcctgtgacataaatattattagtctcatttttatagatgagaaaaattaagactaagcccatggggagggtgaccaactgtcctggtttgctcaggactgtggggtttcccaaggtgtgaaactttaagggcagacattaggaaagtcttgggcaacctggatggttggtcaccctacccgtagggtgtgggtgataggaattccatttctgtctgccttactaacaccttctatgaggtaccttccttccatgtgttacagtcaagagttttacagactggtttaaagaagggcaagaccaaatattttacaaacaggatattcacatgcagcttcatcccccttttgaaaaaataaagacagataaagcactgcatagtctccaacctccattctccagaagagtcaagaagacactcaccttgacctcaaactcgaagtgtgcatcctttccttgcccgcagaggacgtagcgtgggatactaattttaattgggtccttcaggtcatctggatttgcgcccaaagagcgagaaaccatccgctatcaaaggcatgtcagacagggagaacaaagagaaaccagaatcactccactgcaaatatcctgctcgggtaggagggagaaaatgtgtttcaagtagagaaaagagcatcaaaccagtagggtttatttagaaaaatgatggtttcctttgaaagagaaaagctaagcctctctcataacaaaaagaccattattttaggtataccgttccaaggagttagggcaaaagcactatgaagtgtttggctttgaagttccttccaatttataagaacaagtaaaaacagggacaaattatattatcctgacttcttaaaaaaaatcagtgtaaaccagattgccttctgaaaagtcttgaccatctgacaaacttttttcttcacacactatcagacagctatacttataaagctgcaaaagctagagattttattcaaatttacttcatttttaacttttaggcatttttataagccagtgtagtgtggaaagctctttaaaccacaattaaaacaaatctcaagtattttctttaggccccatttgattactcaacttggctctgacaaatatttatggcctgggcagtgggggactagtggggtctgaggaagaggcattatgaaaaaaataaatcttccaaatgaagttgtcttaagtgtgaatcggaagaaatctctgaacaatccttattgtttgcattaagctgggggctttagaaaacatatgtttttgaagtaatagcaataacaaaataattagaatcataattatagttagcatttattggatactcattatatgccaaggactacattaaccagtttacatgaattggctcaattaatcttcacaatcccccctacgaggtattaaccattattcaccctatttatcagatgagaggcccaagactgagggttgagctcacttgatggaggtatggggtagagtcaagatttaaactcaggccaatctagagcccactttcatcacactactctagattgcaatcatgaaattgtacaataattacatccatctgagatacattgagctaatgaacacttcacacatatgtaggttttaagatgctgagaattccatggttatgcaatggaacccacttatgtgactataaagaaaacagggggcaataagctccctttctcccagacagaaagggttctcagccaggtgtaacttgagagtgtcaacttagctgtgtgcatgaaagcttggacttccagaggacacaaggacatataatttgtttcagattgctgcttttaatctagctgactatgtgtgcattttggcatgaagtttccgaagcctgttataggatcttaatttttctctgcatggctagtcacccaaagcaagaagaattaattgtttatcataatggtacaccgatttagctatccctgatatcaaaaaccatcaagaggctgggcacagtggctcacacctgtaatcccagcaccctgggaggccaaggcaggttgatcaagaggtcaggagatcgagaccatcctggctaacatggtgcaggcctgtctgaactaaaaatacaaaaaagtagtcgggagtggtggcatgcgcctgtagtcccagctacttgggaggctgaggcaggagaatcactcgaacccgggaggcagaggttgcagtgagctgagatcacgccactgcactccagcctgggcgacagagcgagactccatctcaaaggaaaaaaaaaattatatgggcttctgtcacttgaggcacatggcagtcacacatacacctgtgagggagatgatctgaaaggcaaacttcatgtttttcagttttgcctagggatacctccatttacatacttgaaccttttaggatcacgtgaatgatcgggttctcaaaaaagtgtggacgacagtatccacaagcataacatactctaactttatctgcttccctgacctagtcacagaaaatggacatgggattccaggtgatgttcacttcaagactcagaaggaaggataagatgtggaatccaatcctagttctgggacttggtcttggagtaagtctcttgcccgctcttcacctcagttcccctatggaaatgggcatggtatttattagattccaactacatgggagggacccaactatgaacgcaatggtaccccaccctgtgggacttaaggtctgaggcagactcttacaagtgaactggtaatcacagcaggattagaaagttgtgatgggggaatggagtgagaacaactatgaatatgtatcttgtcatccaaatgtcaggaattttactgaggaagaactatggtcaaaattgcctaggcatgttctgtcagctaagcaatggagacttacctttgactttctaaatgccttttcttttaggcacccctaagatatataatgaaacattgctattttactgggtaccacctatgtgccacacagagggtcaggccttgggaatacaatataacttttacaaagtatttgtaatttctaagacctttagtttttctcaactgcacatgtttggaacaaacttttgatgtttctactctagatggattatattctaaaggtagatttgggaccttaactttctcttttcataagtcagtttttaaaatgaggtaagactgtaactgacggtctgggtattttatgactggtgatacggtttggatatttgtccccatccaaatctcatgaggagttgtaataatcttggtgttggaggtaggccccgtgggaggtgtttgggtcacacgggtggatcccttatggcttggtgcagtctttgtgataatgagtgagttctcaccagatctggtcatttgaaagcatgtggcacctccctcacactctttctcttgctcctgctcccactgtgtgagatacctgcttccccttcaccttccaccatgattgtaatcttcctgaggcttccccagaataagaagccagtgctatactttctacacagcctgcagaaccatgagccaattaaacctcttttcttgtaaattacccagtcttgggtatttatagcaaggcaagaacagactaatacaactgcagagttctccatttctaagaatgtaccagggtaaaaccaatccctaataaaaggaaagctgcttgaggctcaggatcatagattctttacaaaaaaaaaaaaaaaaaaaaccctgcctttgacaatttcactgggcaagtgatttgagtaaggaccaggtatttgagaatgagtagatcttataatattacgtagcctacctcaatctagggcagcctttgacacactagcaactgcctggactaatatatggcccttggctggatataagagctactgtcccaaacgggaccagacagtgaagcataacaggatcctttgcagagaagaaagatatttctctcttcattacatatcatactggggatgagaaatactgccagagtccccactatcatccttggctacagtttacttcaatcttactgatttcatatgaactaaatattaatgagtgtacagaaatgaacagctacagaaatgaacaactaaaatataaggtagggatctgagcaaatgcataaataaatttaaaaatcaaaatgtgttcccatcaaatcatcactgtggtgtgatttgtaaacattattttatgaagtcaatttcatgagaaatgtggaattctcagggtacagtgtaaaaaattcttgacactctcctaaactatgtttatactggacaggaagtaaagttaacataaatgtctcttaaatttatttttgatttgaaagtggctatattttgagtatgttgaggtttatactagacatgcaaatgtttgctgtatcccattatatcccattatttatgggagcttttatatttcgatggcattatttattttggaatccatcacagtttccctatatgtggcaaaaaagattcttagactctgaagggaaagttgatggcattgtagtaggaggtgtgaggaacacctctctgcaagcagaactggtgtggatgagtacagaaatagtataagcaattttaaatgtgccatggagtgatcctatttagaaataaaaagtcaagaaaaagtagataattggtaacttgaattacatatctgtacataagaagtatctttaaaagttaaatacaaaaaatattttttctgatagcttttaatgaaataatgctctgtgtcaacaaatacgctatttttccattcttggtgaaacactgtagtccagtccttagctgaaagaaataggcagaacataaggtacattgtaaatattcagttcaaagtcttcttttactactcaggctatttccttcaaaaggaacaaattgaggaaatgaacaggaagcggcacttacatccactcagatctctgcgggctctcagagaacatgaaacggtccaggtcctcagggagtcattaacagttgtccctaaacattctaattatgtaccagacggtcaaattcagtatacacatcatgacaaggtctggcctaaggactgccatctaatctccagaagcccatagccaagctttgcttctgaaatacaggcaaacctggctttttattagatttaacaaaattacaaattctcctgtccctgttccaaccatagcacatatttctaatccttccttttttcaactacacatactatactgatagttctaattagagctattatgtctcaagtacctattatgccccaacaatttgaaaatggagatttggggaaagagacgacgaagatttggggaaagagacaatgaagatttgttatagcctcaaacatcagccaggttgtaagaaacagggaacaaagataacatgcaggaacaagcacaaatgatgtatatggtaaataaccagacaggttcctatccatttccagtagagaagcctgcctttgctatgaggggatcttgtcttaattaacactacactgtcttcgaaggcttggcaaatacatctgatttggattttgccaagacgtggccatatatgctacagatacatcctgtccatccctgtgaaggatgggacttaacaatagcctggtgtggagaaacagtgctaaccttatctcatttctaaagtgagtctggaagactcacatcaggaaacaaatacaagttttgatatatatcctgagggataagttacccagaagatggcaaactgttggacattggtacttgtagaatatcttaagtttagcggcctttggataactccaaaaggtttagttgacatttccaatccatgattctcaccagaatcaattatttcttctacatagatctgagccgaccaacattgtttcaaggtttggaaatattgaatattggatgaatgtttcaacttgaaactattaaaagtgtcactatttttctctagatcaccaaagatcattgtattaagtggtcatcatctttgaacaatgtatcaattaacggctgattttaaaaagattaaatatggggtctattatacctgactgataatgtcgcaacaactgctaagtggctctcactattaagcatgaatgcagacaggttaggaccctcagggaaaagtggatattctcccttctattataattgtacaatgtcattgattaatcatgaaaagtaccactgatgttcactcactgattttttgctgagccctggctttgggtcaaaccatgctgaatgctaaggcccaggagaaaataaaaggcagggatgcacttccagccaaagaagcaaaagtaaacatacaaacttatgtgcatcaaattcacgctatgactgtgtctaagctttcttttacagagctaaaaaagcagagcgcaaagagaagtaagatccatgcaaggaaataaaaggaattgaaaagaaacttgtaaggcaatccttgaaaacaacaactcatacagacagaattattaatgtctagaattccaagaaaacaaatttacaggtcagttaagaatcaacttagcaatacttggaaatatatatttctagcatagtcattcctataaaaaaatcaataaaaaattttaccaatgtcaagaataacagtgactatgaaatggctttggcactgtggacaaatatatatattctagagtagaaaagtctagatttaagtcccaattctcaacctagtaatcctttttgagtctaaatttccaaatctgaaatggagttccacgtgaattcctacattccagtaggatcaccataaatatcaaaaggaacaaaatatgagcaagaagtcctacattgtaaaccacaatataaacagtgactgggattgctgtcacccctataacccactacaccttcagcaacaaaagattttaaccagatagtaaaaggcaggaggagtgacttataatagaatctctttccttctcatcaactagtttattcaattccatccctcataaagaaggcattagcatactacaacactgcatccttaacaagagatttgatggtgatggtttgaaaaatgtactgtttaagaaacagtggagagacggaagggtgttggaggtaaaggagaaaaatcagaggaggcagatatatgagaagtgtcttctctgaagggttgtgtataatgcagattacaaaatacacttgttttattctgcaacagagggtgccacggatgaacagactctgcagatggagatcacaataagggagattacggaaagaatagtgtaacagtaagagcagctcccaatgaaaaaactgcttcagaggtagaaggcaatcagcccatccatggaggtactcaaattgaatatgtaacttaaaaggtcctagggcatactcttcccggtaccttaatgtttccattagggagaagtcctacaagttttatctgagtcttatctgtaatagagctttgggaaccttgacataatacatccatggaaaattaattgccggtcctaattcttctctccctatagtagtagtacatatcctgagtctcaccatggcctcttgatggacggagggtacttccttgccccttgatttggggcttggtcatgtgacttgtgttggccaatgagatgttagcagacacaggcaaaggcttgcaggactgcccttctgtgtttctgtcatcaccacgatggctactgccccttctgaataggtcccaaaatgatatgtgtggagcagaccgaccctggttgagcaacagatgacctgcagcgtacagcacagccactccaatctacttgcaaagcagcagaataaaataaaaactttttttaatgtgccactgaaatttgggggggttgtttgttatttggcaattgcagactgatataacatctgtcacaatagatattctaaggaatgaggcagagttgtctaagctacatactggaaattgtgtaactaaattaacaaaatgacctcattagaaactggtctatccaataagccgggttgatcatcaaaggagcattaataaaagtggctctaatctatttatcatacaaagctttaaatcatctgggaaagagaatgtaagcaaaaattactgtaattactactgctggaaggcttaagtactctcttccaaagggatgcatgcacatttttaaagtaatgagaacagggagacacactgttttgaaatgtttttcaacaaagactaaataaattcatcctgccaaccacaagtctgtaaaacaggcagctgtgcacaaaatggattttaatcaaattcagatgaaatcactatttcaaaagtattcaaagagctattgtctagaatgtattaagaagtcccacaatataaatgtttatgcctatattataacaatgcagaatgccacataaccaagatgtatgcgtctatttttttctgattcagaaactcattacagccgagatgtcgttatagcaggctgaatactcagactctcatagttgctccactctaggggtgctgtaggcttagaactcctgaagaaacgagcagagggagctcctaggattgaagccacagcagagggagctactaggattgaaatcacagtggataatggcaccaacaatactccactggcttccacaggcatcacgacaaccttaatacttacttcacagagagtaaatcaaactctcacacagaggaactatattttatctcgaggtacaaagtatgcttaggtgagagaagtgacatgctgaatctgaatgctgcaagctgcttctattatgtggtacaatctgaacatgatcctcattgtggccttcttagatcataaagcagactgcagaagttataatgagtgatatgatttttatacgatgctcgtatctgctgcatgttccatctctgagaaatcctaaaggccatgatttacaacatggtggaattatgcttctgtacctgtgcgaataagcacatctgtctaatatttaacactctttgttaaaattatgtacagtttatttatcactcccttcttcctgaccatggcatccctctgctggcatcttaaaatttattccctctgcccttcataatcattaattgtttttctttctttcttttttaacttggacaagactactgcagtataactctttttcttatcaagaaaatatgagaaaatactggatggaacaacttgaaaaaaggaatgcaaaatatattagttttaaaaagttaaaaaaataaaaataaattaggagaaatattattaagatattagaaaactatcatggtacattttaggagtgtttgttcatgagggaagatgacctaccaaccaagataatgacaaattagtgactatttttaatgatgtcctcatcaaagagttaaaagcctttaggtataaggtaataaggtatttatgtgtgggggtagggggtgctttggaaatgaaaaacatgagaatccaattgcctcaaaaaaccaaatgcctccactggtcagaagcacacatggctgcagccaccagtctgtggatcgtaacacattctccaattccctgtcttttcctgttcatgtctgcaacactaggtagaggaaaataggtgggaatgtagacccagtgtgggtagcttgtcatttcctccgtcaggggaaagagggaagatgagcagttcctggccaaaggaagatggtaagtttctgtgtgtgttaagctttgacaccatctccgtcattggttaggaacagaaatgaagaaggcactacaacatttatgttgcacttatccaaatatttgaccagaatagaaaatgccccttccatgccacgagaatcactgactcactcagctgcatccaacgtccactgagagctactgtgggctaaagatggtttggctgagagtggatggagggtgggctgagcaagacagaagcacgtctccttccttctgagaactctagatttaggagaacacacacctgagaggggagaacagtggcagagcacctagggtcaggtgaaattaaaaacaaatacaaaatatgtaacctgataggatttttggacagagggggacagagaggaaagggttgatcagaggagctagagaccctgaagagcacagtttgcagcctcttacctaggaggaggcagctgactactgggtggagcttcatggagagagaagctccaccctgggcagatgcagcagggaactcgcctgagaagggaggccagcaaactgaccagctggggccagtaggagacctcaatcaaaggttataagtggtggctgggtgagatgccagaggaaggtacctctaaggggactatatatttgacaagacagcagaaagaagccacgagagaaagtgagactctgagataaagagacttacaggatagagagacaaaagttctgagaaagaactggaatatggtggtggtgagggatacgggttaggtggaatagccacaaatacaccaagtgaggagctgaaatcgcaagagttaaaagggaatcatcaagaagtatgaaaggaggaaggtaaaggcaattaagtgaggaagaagacactgcagggcatgcatcactgtctcgattccgcataccatggtgatgggaggacactttcaatccccgggtcctcataggaagcttgatgcatcactaatgtgctctgctacataattatcctaatcacagctgaaaccaaggatgtcaatgaaggtcactgctagactgggcactttttcaggcagcacagattagcctgctggaatccagtaggcacagacagattccaagccaccacactataaatcgacacgaaaacaaacaatcagaaatgctttaatcacctcacaaataatgaagcaggcacaaatttacaagcctgagtttcaagaaaatgaagcaaggtgatgataaagatattttattggggctctgctattagctgtttttattttattgtagatatttaaaatatttacattttcaattttagaggtctgcatttttccagttccaattcaattagctacacggagatattcatattgccttgactgttttcacaatgcttattttattaatgatctcaaaaaacatgtagtgcatctttaaaagtctcctccttagagtcttgtcaaatgtgagattagccaaagagcctcatcttgagaattgaaagtaagtttccagacctcaggtgcgacattctgactgccttgaagatacaatggggtggtgaacaactggacatttggggcttcctgaaggtgctcaggtggactatttctggaacccactgaaggtttgagtttctgtaagaagactagttctactgttgacacatttttcttttctggaacaacaacacacctgaattcacttaaagcatggcatttgatcacatcaaattgtgcacccggaggaggtatgtttcgagatcgaatgcgtggataaaaaacacagtcttccttcaccagtgcaatgtgggtgttcagaaggactagcgactggcactggtcatggccagagtcacccatgactttcactgttgtgtagagcagtaactgaacttctgccagggaagggacattgacttccatatttccatgaagaaagtaaatcatgtcaaccaaggtagtctggaatttggatgacacctgaactccatttggcaaaactaaatcagggatttctgttttccaatcaagagaaagctgaaccagatcttgctggagcaagggatgattagcgcaggcagcggcatcaggctctggcatcaggacacacaggaggtcacgacacagctgttgagagaggtatttgttgtaactgaatacagtgagcagaagaccctctgcagagctcaggaatcgaacactctgtccaccaaagccaatctgaatctcctgtagaccagagagaggtagagcatgaaaaatgctcattgagccgagattatctgacaggaccaaagcatataaagttgactgaagcaggagcaaacacgctggttgagggtcaggtgctgtgcaggcagcaacagcaagccagtaaatgcctttgacttccttcatgttgcccaaaggttctggtagagaacaagtcacatgcctaagaaggtcttttaaagggcactcttgcagtttcagcatttggtccgggaattgcacaaggctctgcttaaatgcagagctctttctagcatcttcatattcaaggcgaaaaactgagcttggcgaggaacctggtaaacctgtagctgcaaagacagaggcccggtaaggcgccgcaccctctgctggcctcaggctccctgcagcttcgctctcgctgctgccaacccgagcttccggagaatgagattctgttgactgcatgtcagtcttcaagggcatgtgtggggctaagtgcttcagaaatggcaggcttctgacgaatgttgttacctgggaggggagccccctcggggcacacagattccccacaagcctggcttggctgatcacctttgtgccagcctgaagcaggtgactgctggtatctttataaaggtctgagaacttgtggtaaaaatatcccagtccattgtttccttctgttctgatatttaccagtgactccgatgagctcatttttttagcatccaactcttcctcaccttgctgctcactataaaactcagacgccagtacgctctgcggggcactgcaggatgctctctcctcatgggaaatgccttcagacagaaccaagcagagcaccttgccttgcctggcctgcttgcctccgctatttatagacacttcttgggacgtatgttgcagcaaagtccaactggacttgactctcaagccatgtttatctttatgagtcatcagctcactgaaattttctgactgactctgaaaatcttctgcatcatcggtgttactttcgttaagaaaagagattttaggtagattaaaacattttggttcaaaatggccagcatgctcaggatgaccatatttgttttcactgtcctggaatacctcgggtactgaggactgatccctctgctggtgagttctctcttgtgatgctgaggaagttgttttagggcctgagacgctccacagcatgggatgatcccagtggtcgttctgatccacctccctcctctcctctttaatgaggctggaagtgtcagtggcatctctgggcagaagcgggtcaagataccatgctgggcaaaactgccttttctgttcaaggtgtcaaaaaaagttgaaatggggatgtggtatctctttctgtgattcttttgcacatgatgattcttgtcattggtttcattgggtagattaattcagaggttaaataaaaagtctaagccatttgtattgatacatgattaaagaatcgattatctgattcatacatagaacatcaattttccatattatatatatattataaatcactgagaattttgatagaaatactttgtatggggttgatccacagtacccacgtcttgatctaatatttcattttccctacaataaattccaagccctctgattcaatgtttagaaggtcaaatttagttatgaaaataagtccatgatcatatgtccaaaatgcaatcaaggcaaacttaatgaaaatcagatggcaaggccaaaagaaatgcccaagtgttctaacccaggttacatttctctctccttttggtttgtttcatggggatcaaatgttcccatgaacattaacagtaattatcattactcttatctacaagtcatcaccatggaaggactactgtgcacctgctatgtgccaggtactatggacacaaagaaatgaaagccagtgtcttgctctgtagaggagggaaatggctatccagggaaagatcacatcattactggatgactggcaggagggtgtggctgcggccaaagtcagctcagcctctgtgaacatccacctcttgctgtctgttcagtaatgtatggacaccatctggaaaatttccatcacctactattttttgggggttgattttttaaaatttaggaatatatgggagagacatgcctctcagtggaggagaataccagtgaaaccttacaaattgcatgcccaaataaaccttggtttgacaatccaccagagaaacaagttaatcaatcaagagtatttcctttatactactaccaactcacagtctataaaatggacaggaggagtactgagtttcatttccaaaccccatatctgattctgattatataattctgccttttaaatgcagaccaagggaaaatatactattacaaatgaaaaactgggcaaagctccaccacagctacatgccattcaaataaagtcaaagcagtttcaaactacaggattccgtttaattttaagtccatataatagcttgccttccctattagccattaatcttgccgggacctcaaaattctaattatgcaactagacattaagaaaatgtaatcacatgagcatgccataatttaaggcgaccctatcaatctgaaaaatcattacctacctcatattttagtttacgttgaatggtgccattgtgaagtttctcattatcctgaaaagaaaagaaaaagccctctatattaaattatagcaagttcacggggcgggggactgattcgattacaagtatttatgggaatggaaatctaaataaacatacttgtcattcaacaatgacaacccttctatataatttacatccccaagataaacatgactctattgatccatctgccatcagagaactgaaacacttactcctaatcttaaaattctaagaataatattaaaaacaagatctccttagggcatttcttaatttgcaggatagaaatgcattgtctttatttcagtatagacttgtcacaaatatgtatcttctaaaagtcaaaattctatttatattttggataatttacaaaataaataactacggaaattggaagtattttggaagaaaacagaagaatgttgcatgtagaattaaaaagtattttagactttataatcacttaaaagttgtcataattacaaaattataaaataaagttactcctgaattcctgaattaatactatttataaactgttacactctgcccaagcaatatttaatatttttttctagaacattccacatctgaattttctcactggaaaacaaaagaccccaccactaccaccaaaaacttatcttcaaggtcatcttgaaagacaaatgggctgagtgtggtggctcacacctgtaatcccagcactttgggaagccgagatgggcagatcacttgaggtcaggagtttgagacaagcctggctaacatggtggtagaaaccctgtttctactaaaaatacaaaaattagccaggtgtggtggcaggcgcctatagtcccagctacttgggaggctgaggcatgagagttgtttgaactgggaggtggaggttgcagtgagccaagatggtgccactgcactccagcttaggtgacagaacaagactcagtctcaaaaaaaaaaaaaaaaaggaaaaaagaaagatgaacgaacttgttacttcgtgttacttggctccttcagcttaccttcatcgtgtctgcagatgtactgcagccttcactaatcacacgatgcaaatcctgaaggcgtctttggacttcttcttcaatgtaagcattgatcctgtaacacaatggagatggagtagatctgacacttctaaccacacaggacattctgagatcctctctttactacgcccttcacaacagggagcaatctccttctaaataccaaacctaacaacaacttgagaacttcaacatttttatttttttcaagaaatctggtgctacatgttcactatctgggttttgcccaaatgaggtagaactgaacaagtaatagaatattgggaatggaaaggagactaagtgatcccatccacgtccttagtggaatgcccgctgcaggatggaagaaaatcagtcactggcttcagaaggctctgcggtctctaatctgatgccaagacagaatatttcattcagagccttgggttcctcatacagaaaaggataatacagatgatagttatttctcacatctcaaggtcatgtatgaggattaccaaaaaagaaaaaaataataagcaagaaatggacatgctctctacaaatcttcctcattcagattgaacagcgtctagcacacttgtattcccggtctgtctcgtctctccaaatgggttctctgtacctggccagcaagaccacatcgtaaaggtctctaccttccaaaatgcctaggacaggcccaaaacagagatgaagccaaacaccactgacttttgaagcagtgtcaacttattatctgatatctcataaaatgtaggtgaagttgtatgaagcaaaactatcagccttgaccacctcagtggattttggtctaatctctggtcattccacctcaatgtttttaggtcattccacctggaggaaacagagagactagagaattttatcttcatcgaaaatctttgtaatggcagagactgcccaaatggaagtcattctgttctagactcccctcctccaattctacaggtactgattagatgcattattattatttttgagacagagtctcgctcttgtctctcagcctggagggctgtggtatgatcttggctcactgcaacctccgcctcctgggttcaagtgagtctcctgcctcagcctcccaggtagctgggattacaggcacccgccaccacacccggctaattttcatatttttagtagagacagggtttcactatgttggtcaggctggtcttgaactcctgacctcaggtgatctgcctggctcggcctctcgaagtgctgggattataggcgtcagccaccatgcccggccggatggattattttaaattaaatggtttccatgtttatatcttatcacattcactaaataaataagtaaatctgcataaacacatgcataatcctgcaatcatttctatactactgaccacagagaaaagattttctaaaatgctaggcaaagagattaaaattttaggtaaaagagcccaaataaagcacaatgtttctgtttcaatattgaaaacaaaattgtgtgctactgaacatgagtgaaggccatttacaatttatcacccctgatagtcacttaaatttgaaagtaaccctgtgagatatgaggctcatgccattctgagtacattttgatatccaaatatatatctcctaatatctagggttcaagactgtccgatttcaaatgctcccatgtttaaatggagtgaagaagggtaatcattgttttcttacaggcaaagaataattaagctgatttttctaagggctctaagccacagagcaatacacaatgccacctaagttgaaaatcacttaactaaagtaacatcagatacagatttattatactcacaatcattctgaatatactagtagtttttataacaaacttcatctatttgtaatccatgacacataaattaactgtcaacacaaggtccttcttcttggtacagttaattctaggtcttcgtttttgtcaacctggccttgcctcactttgtgctggatgagctgctttccctgcaacttttcattccgccctctcactcaaaccacacttgacccttgaacaacacaggtttgaacagcacatgtccacttacatgtcagttttttccaataaatacagctggacctccctattagtggttccacatccacaactatacaaagattgaaaatacatggagggcaactttttctaaccgcaggttccagagggctaacaggtggacttgaggatgtgtggattttgtatcaaagagccatcctgaaaccaatcctctgcagatatcaagggacaactgtacctgcaacaagattccttggatctggctagccaggtctcaagtccttgattttcttgaaatgaccccttaccctaccactggcaggccaatggcagatgaaggcagagcacatctcaagcacgtgtattacttgttgcccttaatagagccctccagatacaaagtagttcaacagagaaacaatgagtccttgagtcacatcaaatgagaagcctggaatcactttcatgtccagtacctggcatccatgaggggaaccaggtgtgatttttcagcactgactggcaagctggaagaagccaccttcccttccagggtcccatgatgatctttttgaacaccatcgacctcataaatcttctgtttcagctgctggatttcatattctaacctacacagataggagccacataattcattcattaatagtatttcccgagcatccttactgtgtgagacattgctttagatagcatgggggaacaagatctgtcctctgtgtgcaaagaactttaccttctagtagaaaaggtgccacatacccataagacaagacataaagtgccatgggccacaagaagggtccaggacgagcactgcaggcatccagaaggtagagtaattttgactaccaagagcaaagatctctccactgtgctccaagcaagtcctagaggtaggtgtataggattctgaggcctctaactgctgcttcaaaaagagttggttgtggactacacatcagggttctggtaaatacttacgtttgatgaaaaagatctatgttttaaagagttttaaaaaccaccaatctaggagaaatttcatagccatggcagttctaagttgagtctccagaggccagtgggaatgttgtcatttggagatgacggcagaagattatctaagtgcagaaagcaatacgagcaatggggcaagggcatgaaaaccaggcatccactttgggctaaggcagagggcatgggaaggggaagcagaaaagacaggcctaggaaagtaggttgagttccatgagaaactaaaataaaccataaaattaacctccagtgataagtgatacatctatatgaggtcaaatgtgtgtaaggtcattctcccaccggcccaggcatacttgaatccagccccatcaggccagagggccaaccttgccagtgaatttggccccaggaagcaggagactgcagtccactcactgtgtgagcttggggaagttatttaaacacgggtctcaatttcttcatggatcaaatgagagcgtcaactaatctccctcaattccttcagctctaaaaatcagagattctggcttcagatgccaacacaccatgatgctgtcaaccctctggtgtcaccagcagcaatttgactgctctatcttgaacatgaaagccaagttctgaattttcagaaatggatcacagggtcatgagggtaagcactcatgggacccacacgaggctgtgcccagtttaactcagccctttctgggtttattgattagcaagtacttctagagcatcaatttgtggaacacacagtattttcaaaagacaagacataagcaaaaaaaaaaaaatgatgtcagaggcctggtggtggccaaataattggggagcaatattaatagggtatcatcaatggccaaaaaaaaaaaaaaatgagctggatgtaggcaggcaattagcaatgtttacagttaagaaaactcctgctggggttgttaagaattgtccttcagcacagggccaatggccagtggaaaagactccacagagcaaagaagggtttgagaggtatcctgaagtctgagtgagatttatatggatggcaagggacaagctggccttcccgtgtggcagatacatggtcagaagactagagggctaagtggatcagagatgggtgatgagattgagatctgacttgcaactctgccactttctaactgtgtgacactcatccccagtggttatacaaccactgcaggcttcagcttcctcatgtgtaaactgtagacgatggcaccctttattggaagagtaaatgacaatgcacacacagcatttaaagcaggatctgaggtacacagagttattcttcatggttttcatcatgactattatcatcgtcattgttaaaggactctgacaagaaaacaggattaagtgtgagtattaacaacttgcctctgttatccctgctatggtgatgggaggtatttctagttgggttacctgatccatgtcaatggggcagctggaatgagcaggtggtaggaaaaaaggcaggaaaatggattaaacctggttcataaagcactgagaaggcaatgggagagccaagttcaggacactgttgtccagtctggtcccacatgaatttaatatttcacacttgtggaattttacgaggggccaagtcaggctgcacggtgaatcctggcttagccgtgagaaccctgggagaaaatgaagcacaacagaaattcccatagaaagctgcgggggtatcgcagtcagagcagagagcccggaatccgtcggcctgaattaggacttagctaagtctatttcatcaaaactcatgaagctaacagccccctttacttggcttctgaaggaacactcccattgtgtaatcacttccgtggaaactgcaatactgtgtctgctattatacagtattaatactaaatggccaggtgacaaaagccaaggacatcaagctaaaagctcatgctgcattcttattgcacactacaggctacaaattgagagtgtgccctccactactttaaagttcctggggctggatctttgtctagcaatttcatttacataacatacctgcaatcatttttttaaacctccaacctatttctctgaaataacagcattagggtttttgattgttattttgttgctgttttgcctgagggaactaccagacagcgatggtaaatgtaatccatagcataagccaatcatttgaatggaggttgtcctgaacttttcaggcaatgtgatgggtgaagctacagtaacacttctgagtaggtcttccttgttatcagcaaccagccccatgcatcagctaaatgccaaggtggggtctcctggccagtacactggacttctgttgaagcccccttaggaggtgctgtgggtggggggagtactgcggagagggcaaggtttcatctctccaatctgagcttcagttaagatctcaactgagcagggagtggtggctcatgactataatcccggcactttaggaggctcaggtgggagaactgcttgaacctaggagtttgagaccagactgggcaacacagggaaaccccatctctaaaaaaataaaatacataaaataaataaataaataaataaatagccaggcatggtagtatgcacctggggtcccagccacttgggtggctggggcaggaggattgcttgagcccaggagtttgaggctgcagtgagctatgatcacactactgcactccagcctggacccagagcaagaccctgtgatctcatccatcctcttcttgtacaagtggtgacactgaggcccagtgatgaaagatcctgcccaaggtaggaacatgctaccatcttgataggaaggggctgaaccaggccataaattcctcttgcaagtctccaaattgggtgatgtttgcatcacccaggtggctgttggcctttctgtgagtcttgccatcaagtcttcaaggctccagaaaaggtgtcctcaaattcacataatatgcattttgagaacttatggtctggtaagtatggtgacagaaaataggtgaaggaagataaatattcttaccttacaagacaagagtgctaatttcctagttttatttttcacaacaacaaaaatactatcagtaaatcaccaaacatgttctaatatcccactgtgttcagaattatctggagttttgtttgttggttcggttgactgttttataatgcagagtcctgaggccttctcttaaatactgtgactcaataggggtgggagaagtattgattttttcattcccaacatgttgcagaaatcagtagcctgtatgcaaaccatgaacccagggatgatacttatttcaacaagtgctggtcatggagaagatgtgaaatcattagtaagaaagggcagggaagtagagatggaaagaggtgagggaggagggaagaaaatagggagagaaggaaagagacagggagcaagtcagagaggggcaaggagggaaggaagaaaggggagggagaggaaagagagagggcaaaggaagagaaaggaggaggaaatagatgcaatggaagggagaggagggaactgaaggggaagaagaaaggggaaagagagggagacaggcaagggagataagaaagaaggagaaatcaaagtggaaactttctagtcttgcatttatcaaaatattaaaacacgcacattccataggacagtgggataatgtacatgggctttgcttttgtttgtgtgtttttcaactctaggctaacaattctaaaagaaggacactaaggagaaatacaagaagtttaggagtacttttctcagttctggcaaatataagcatttgcctatgtattaaagaatatgaaggctaaaagaataagttaaaaaaaaaaaaggataaacacaacatgaggagtgaaaaatgagcactcatttggcacccactgtatgccacacccttccttcccaatctcacctctcctggtccttctccagggcttcctgctcagcctccaggctagcctggagccctgactgctctctgctgccactgttcagactggcaagtttctgcctctgctcttcaatctccatgcccagggtggagtgcctctgcagcgcagaatgtctcctctccagcctggccagggcccgctccagcgcctctctctgctgcttctctctggactccaaaatctccttttcctttttcctcactttttcctcctgacgtgcaatgttggcagtgaattcaaaggtggcttggagcttttgcagctggtttgcattggcctggtactgtgcaagctgttcttctttttcttccatttccttttctacttgataaagagtgttgtctaagctgagagggcctctgtcaagaatttcaaatgctctctgcttttcttccaacagagttggcaagtgattctgcaggaggtactgtagctggcgttctttatattgcagcctgtactccactggctttattttctcgaaatcttgaggcacttccgtgacatctgtgacactctcatcatgtttttccaacaatctagattctttgtcatgttcacattttaaacactctaggatctcctgttcttcttggacttcttttttcaggatgtctttctgctgaaccaggtccttctccaagttcactagcttgacaagctgccttctcttgaattcgaagaaacgcagttgagccttttctaactcctcgccatcttcatcccctccggcacgagcctccttcacccgcaggagggattcccgaatgccttccaggtccctcttctcctcttccacccactgtacctccccacgccgcaggagctggatcatctcctgcttctctcggagctgctcttccagatgggccacgagcatgacctgctccttctcctgctcctctagtctctttttttccagttcaagcttggcatactgttcatctttttccttttggagctggtccagttcttgaaatatctgaaacttctcagccttctcgttgttgttgagttctttgagtcgttggagttcttcttggacgcggagaaaggtctcttcttcttgtctcttcttctgcagctcgatttcctgctgttccctcagcctctcctcttcaaatttttccttctccgcaagtaaatcctttagcttgttctcgatgtggaagctgcggcgtttgaggctctcctcctgcttgcgaatctggagctgcacgatttctgtctccttgcgctgggtctccacctcctgctgcatccgctccagttcagccttgtctgatttctgcttttcctccatttcttctatgagtttcctgaaatgcaaagcactgactggttgttatctggtcattgttcaaatgttgctctaactttactgaaatgttctgaaaatgcacatacaaccaggtcaaagcctccattaaaataaaaaaaagaagagtaactgctttcctttaaatttccagcagcatcctgtttaattttttttattttttaactgtccaacatatcacctgcctattctcctgaagtggcttctgatatcatttctttgtagagcatataatcataatgtgttatgcatgatataattttaaaaggcccctgagctcaaagagaaagaaccatgcccaatttaaattaaatgtgaataactttattcagcccaatgactaaaactcaacagaagttgttacaagacaacattaaataaaaatgcttatgctgtcctcatctcattggggtcaaatatcaaagtcatgataatcgacagttcattgttccagctaaaaaatacatactatttagcatttaatcactagtttgggacaaatggtgatcaccaaatggtccaaaatgttagtttattagtgcataacactgaaaacaactggagcctccattggaatatacaaaatgcataattttgcaggctggtggggaggtgacatgttgtgttttctgttggagaacaaatgatctccactgggtactgtactgaagtttagggttgggatggcctccagaggaagaacacagagttagagcaggaatactgggcttccacctcctgacccaccaaacgtctatcttggatgatgctggaaactaagccagtttatttgtgacatttaaactccaggtcctactaaataaacatttactttgcagattttctatagccttagtttttactctaactctcatctttggtctacgtcttggctggttaaataggacaggaaaaacagaaaaggagaaaatacagttttatcaggtaaagaattatttcagaacatataaagaactgcccaaatcaattaaacagccatttctccctccaccctgcccccccatacacaaaagaaaagtgagcaaagaataagaaaagcaaattatacatggggaaatacaaatggccaaacaatatcaggaaagatgttttaaaagcaggcaggtagaaggaaggcaaattgtcattcttcaggctttttaaaaactcaggggatattattaagagaagatctacttttgattaaatttaaatgaatacattttggtgtattaaatttaattggtgtgttaaatttgcctactgactctatttcccatttctcataaatatttgaagatgaacgtttaaaaaaatttaaacttgaagaaaaaccatctactccaaaaaaaaaaaaaaaagacctgcagtcattagacatgtaaataacagataacagacacagagcaagggggaagtattgaagcagacacagatggaatcagtccaggatattaacacaggaatccagactacaggagtgttgaaacttgaaccccatgtgacttaccttttactttctaatttttcaagttcttcacgctgttgcctctcaaattcaagtctaataaaatcaaatgaaaatgagtcacttttctaaagagcttttctatctctctctcactctctgtatacagagtcacatattaaaaagggcatcagtttttcaagtattacttttaattaccacgggttagcaagtttaaaatgcattctttgctttaggactatgattaggaattagacatacttttgggtacttgaactcaggctgaaaagaacagattttacttgaaggaaaacaaaacaaaaactgtattgaaaaagcagagttaaacaagacttctaaatgataagcacgtctactccatgcagcttagcactgatgagtatataaaaatggagaatctctaccttagacagatgggtccttttatagggaaaagactgccagggaggtggagagagagagagaaagagagagagagcacagacatcaattaaggaaagcatttaataggaaggaatatcaggagaaaagcagtaaggtacttaaaaggcaatagccatgcatgaattgaaacatctttttataaatatcacatttcccaataatttcatgaaacaaacactccaaaaagttagctctgttatgttttacacttctcacacttctctacacttctcatcataatcatagaaaataactgagtaccaataataaatataaacagtagtcaaactagcacctttactactttatagatagttatactgcatgtaggttcatcaagttcctgctgtaattaatggttatacagtataggagttatgggggttgtgagattgtgaacagattcatagtggtggtacaataaagtgatttaggtcattgggaattttaaaacaactcactaaaataataacacaagctgatttcttatcaaatactatatttaattatcgcaaagtttcactattcttattaagcagcagaaactgtatttctttttaattttttttcagggttgggatcggagttgggtcagacactgccagctacctccccccaccccaccacccttgaactatataattcttaagcttatacatttttctgttgcggtagagggcagatacagctaaaaagcttggctacagaaaagtcaccataaatcttcttcctcgaataatgtgcaaaatcctgattggaaacaattacttagtcatgagtgaacaaacttcaaatagttctctttccaatttaataatgtggagtaatattgagaataagatgtctggtggatttcgttttggtattgttttttgagtcagggtcttgctttgacttccaggttggagtgcagtggtgtgatcatggctcgttgcagccttgacctcctaggctcaagcaatcctcctctctgtttcctgagcagctgggaccacagtatggtggcttttttaggcagaactgagtatctcttacatggcaggtgctgtgtggcatgatttacacataacctccctctgtccacccagcaaattctaaaggtggcaaacagtatctccattttacacacaaggaatccaaaagtttggatatgttgaacaccttctccaaggtcacagtggtaataggtggtggagccaggatgtgaactcatggcagtctgcttccaaaataccgtctattaactcagtttatgagcaatgttcaaatttgtgatattaaagtattaaatatttcattgaaacctgttagatagcaatatatttattctactgacaaatggaaataatctgtaccttatgcatgagaaatcagccatataaatctaaatgaaaagcatttgccagtcatgaaggccagcccatatgcaattgcattaagtagtcctaggacttcattaaaattaaaatatgatcatttctttttatttaagaataaacagaaccttaggaaggattccaagttggtatcttcatacttcagtagagtttagtctttctagagatatttacatagtcaaaaagaatcattggataaaatactttttaaaatctgagaatttccctaatggaatgatctgtactcttcatttttattttctgtgaacaagagctcagtgtgcccatcagtagagctggctttgacagtgtcacgtgtgcacagccacaaatgctacactgagcactgggcattcggatggaaacctaccatctgaggattgtttctagaaacaggttttgtgtttgacagtcggcatgccctccgtcacttgttcttccagccttagaaagcatatttcttatcccttttgacaaagcaggaaactgaggcttagagtacataagcagcagaggcaggacttgaattcaagtttggtaatgaaatctctgctgccaaccactacaactgttgctactagtgagctgcaaggtctcaaggaggtaatcagttctgagttttaatatctaaagtgacattttaactgagcacctactttttaaaaattgaacacagtgtcacgaactgtgctaggcaagaggctacaacagtctgtaagagagatgtggtccctgtccccaccaggctcccggtctgtaagtgacagtcagtgtgtcacacatgagcatggggtactgaccccagaatttggtagtacctaggatcaaggcaagcttcctgaagaagcatatatctaatctgagtcattctttctcttgcatgatatagaaactcaaggaaagctaataaaatcagctttgggcttgctataggagaggtggcaagacatgaagctcaagaggacaacagaagctggacagtgaagagccttggatgttatgttaatgactctgaacttgatcttaaaggaggtggcagaaaaatgtcttgggccagggctgttgaagaacacatactcttggtgttttgtagaaaatagatgggtgggggagcaatatgagaaggcagagacaagttagtggtagcaacttaagcaggagatggcagagcaggacccatgacaactgtttgccttgatcctaggtactaccaaattctgggctcagaaccccatgctcatgtgtgacacactgactgtcacttactgatcaggagcttggtggggacagggaccacatttctcttacagactgttgcagcctcttgcctagcacagtacctgacactgtgctcaatttttaaaaagtaggtgctcagttggccaggcacggtggctcacacctgtaatcccaacactttgggaggctgaggcaggcggatcacctgaagtcagaagtttgagaccaacctggccaacacggtgaaaccccgtctctactaaaaatacaaaaattagccaggcgtggtggtgggcacctgtaatcccagctactcgggaggctgaggcaggagaatggcttgaacccaggaggtggaggttgcagtgagctgaaatcttgccactctactccagactgggggacaagagcgtaactctgtctcaaaaaaaaaaaaaagtaggtactcagttaaaatgtcacattagatattaaaactcagaaatgtattatcctggtgagaggataaagaagtgaagctctctcctgacactcagcaggttgaactgacaaaacttggcaactggtggcattttggtaggggtggtaaagagaaagaaaaagtcaaagatgaccctcgggtttctgtccaagtcctataggggggcaggaaggcagaacataactacaaagagactgagcccagagatcagcaggtctgaatacaaattctagtgttctgagaccatgaacaagttatttaaccttggatgcttcattgctgtaaaggctgaagaatgtaacaggccccacctcaaagggctgtagccaggatcaagtgagacacgacaagtaagatgcctgcctggcacctggacacatcgagggctgagtgttgcctcgcattgctgtggttcactgagatgagaagagcagtggggaaggaggggcctggggagtggcagctgtagcagtgctggtgctcaaggtgggagaggccagggcagtggttgacactcaccaaagctaacaaccacgggggactcactccatacctggcactgttctaggtactgtgaatttaattctcacaatgaccctgtgaggtcactgttcccatttcacacatgagaaatggcaatgttactagtaactggcagaatcaggtttgattctagagcccacaattttaatctcttctctgtcctgctttcaagctaagctcagttttacacttatagaatccaatgtttacaaagggtcatccaactgagacgtccagcaggcagcacgaaacattcaacgagctggtatgcaggcccttatcaaggctgaaggtatggacttggccttcactggcatgttgacaagaactgaagccccaagagtgggtgaggttacccaggacacacgtgtagaaggagaataaaggagcttgctgcaaagtcagaaagattacagacttcacagtgacgggcagagataaatggccctctaatgaggctgggagtgagcagttagagactcagagaaaaatctggaaagggcagagggaagagggtatctaaagaaagagaaagagatcagtagcatggaataacccaggaatgccaagtaaaatgcagagcccaaggagcacccaatgaccttcatgacgtggaggttcatcttggagagacctttgctgggctggggctggggctggactgcagaggtctgatgagtgagtgagaggaacctggagatggtgaatgtaaatacagtagagcgctttcttggtaggtttagttgtaaaggggaggtggtggttttgggagaatgggtgctcattttaacagatgaaatagacttgtgcctatttaaatccttgtatcaacaagcaggagacagagagattgagtgaaaaaatgggaagaggctgggaatatctgatagacagagaggtctctgagcgggcaggaaaggaaagggtagcgccatagctgagagcaagggttcaggcatgggtgcagcccagaccaaattctggctcctatatgaccaagggacaatctctcaaccttcctacacctcaattacctcatctgaacacaggctcaaaaataatcctagtcctcagtgggtgagaggatccaatgagggtactcacaaccactgttaacttagttaataaatactagctattaatcctatagcatccatagtacaggtaggggcagttagtctgagaaaggcaaaaggggagttttttcattgggacaggaagaagaagaaaaggatgaatgcaaagcagacatgggattcaaaggtgttgctctcttaggactcctgtgttctatatggagtcaggaacaagctcctctgcctaatgactcctcttcataagagtgaggagaaataatagcagggttagaagtaaaagagtcaggaacattatttgtaataatgaaggggccggtgggcaagagaactgatggaggaaatgagcagaaagggctggctgggcatcattcaagcttagagactattaatttacaggggcactgatctctgtgttgatgtggttttctcggttgcactgagcttagatgtctaggtataggcttagggtggggagatagctcaatggttctagaatcaatgagactcacataagtggaagaacagaaggatcatctgatgatctgggaagtggatggctcaagtgctggagatgagggacttaattggatagggaagtaagtggcgacaagacaaggcttacaggaaaagaaatcaaagaaagtctccatgctgaagaagggagtgctatttaagtaactagattgcaagatgagttagtttcaaagaatcactgaagataacatcacgacttagaatgatgaaaggcttagaaggaaatgtctggaaggggaggagaaggcaactgtacggacagtcaaagagtgcgaaaggcaaaaagtgggacaggcagcggtcccaagtgaggctcataagtgctccagcaggcagaggaagggtggtctggagcagcttggaggaggatctaagagtctctggattggtgaaatcataggtcctcctcaggcgaagccttcactttagagtgtctgattgggatggagaaggggaagtacgtgtattaagggaagttgtcaagatcaggcgcttgaggctgttgctctggcctctgaaggtagtactgtaaagtactgagtcagaaatcagagagagattctcattttaattcttaatgaagacttgtgattttctttctgtgaccagtctctaaataggtagaaactttggttgttttctactgaaagcaaaatgcctttagtaaataatgatacctgtttcctcaaaaataagagtaacatttaaaagacaaacaaaaaatgccgtaaagatgtttggtcttaaatcacaaacagtatgaggggagagtcattccaaagttagagagatttttagatatgcagtgatatgagttgctgctcacactggatcatttctgttaaatattacatatttactaatcatactccaaaatgcacctatttccataatcaatgataattatttgggatagtaaaactcagtagaatgtaaaatataaatgtgagtgtgtcattatcaaggagagaacatcaagaataattgtatttgaaggtggctttattttaaatatgtgtaattcattatcttactttactggaattatcatggccccccattctaatttcccaaatgttataattaaaaggaaaccacaaagaatgtaatttttgcaggtgtttttaacatttttaaatgacacttggaagtatacttactgtgttaagtccaacaaaaaaagcatagcatacaacctatttttttttttaaatcagagatagccttttcttttacattaaaagagatctaccatttttaggtataactgcacatacttcaattaatcttcctgttatcatcggcaataaaaaaatgagggggtgggaatttctcagcttataccataaagaaggagggagggagaaagaagggaggagagagaagtgaggaagatttaaatgaactgaaagcataaatacctgcatccttgtgtgtcttcatggtgattcgtgttgtacctatgatgtcgtttcagtttctaaacagagtatgactgcccaggtccagtcaatgcttgagcaggcagctgcagtgcgggtagatagggagggtaacggaagctgagtccagcccacaacatgcacggaagggagaccccctggcaacagaggcggtctccctatgggacagtcatattggtaaagttcctggcatggatattactctattatctcagtgggcacatgatcagacaaggaaaaacttcttggtcaatgcgtaggcctggctttttcctaggtgacttttaggctactgtcaaatatagggattacttcatgggcatgtgacccatgcagctgcacagggccctgtgctcagacaggtcccatatttgattctctgctgtggccatcttgaaattcttaatgatattagaacaagaggcccaactttcaatatgtactgaactctgcaaattatgcagctagttctgatcaagcatatgtcatctttgaaagaactcctggccttttgcctggaatgctcggtagtattcctcagtccagagaaccagaaaaggactagaactcaatggacggtgtttcacctttccctgatgcttcactagggtttagttccgactacagagggttcttcaatggtttagacaaaaaatgattgaccttttcaccacactaccatcccctaggaaacttcagccttctcaagcacctcacaactgagcaaatcccatggagactaggggatcttaaagactaaagagaatgtttgaatttgggtgaaggggtttgtgcttgtcctatccaatcttcttcctagccttgtgaacctaacattctagatgttccttgaaggctaagcagaaagcagttatttcacccagggtaggctctgggagactgatgaaaagaagaacccagccatccatcaggtttccagctcttcatggaaaggccttgaagtctttcctgtgtgaattagctctcaggtaaactttcattagaaaggtaggaatagctgttttgtagagacaattagaatttctacactactcactcccactcacccttttttcaaatcattgtcagggtatcccacagtaggcggacttacataaaattacaattcgaggggtgtgtatcaagatgggggtgggatacaagaagtctcacaatgcaatttattctagaaggttgtgaaattaaaccctcttaagtaaacgtcagagtttataacttaaaaattcaaaacactctgggaatggttttctaataaatttccaaattgctggtctagaaggtactcactaaagactttccaaggagccagtcttaagccttttgcattgcaaatggaaagtgccctaagaaaaaaggattggttttttaaaaaataataaaatttgatatcataagcattttcactaagtttctccccggcctatttctcatagcaatggtataacttgctctgaaaatgacagctaggaccatagatgtgaaacccagaggctttcctaatcaagccagaggatcacaggcagtctgactggatagacacttgaaatagatcatacaatgaactcgtacacaccccacctcccctgcccctccatcctattttacaggccagaagaatgaggcccatagagtgtgagagagagggcccaggtgaactccttttaagagtctggactcaagcccacctcttccaactcctcatccattcttctacccaggctggaattctatctcaccttctcaaccaaaccatggtactttttataccagaaggagcctctcaaaagttaaaaatgatccatcattacaaaatatacctcttcccattggacaaaccagaagaatgcaccacataattttcctcccacttccttcagccatgcattctacatatacaacaaaacttgtcctggcacctgctgtgaacaggcaggactctgagtagaataaagaatggacagcgtgcctttggatactcttaagtgagtgaaacagagtgaaagaaaacatgctcatatatcgatcacacagaatgtaaggagcccagtgggaaagggcatgttttcaacaggagacggggtggagggacagcatttatagggatgagaggaagccttgcagaggaggtgttgtctgagcttggccttgaaaaacggatagaattgtgatgagcatagtgtgggtgggggaagatccagtggaagaaaaacagaaggaagacaaatgagaggtacacagaggaagctatacagagcctcagctggctactgctctgattaaataaagggaagtgatgagaaataacagggaagttagactgtgagcagaatattaaaggtccagatgacacactctcgagggcaccttcctgggcaagcttctcttctgcctcccctgcccatgagtcctatatcacagcacggggcaggacattcaggaactggtggttcactcgcccataattcacctggtcaacatgccaggcactatcctaggcactgtggtctcagcaaaagaaatcaagtctcttccctcataaacctctataccagtgtggggttgagctaactaatacataatgcgtatgccgtgagataagtactatgaaaaagcataaagctggggaagaggaaggactgagaagaggacattcaggacagagctgcatgaaggaagggagtggccatgaagatgcatctggtgccaacatgagggatgagccaggccacaggccaggaggggatgtgtgcaggacaatggaagtacagaaggaccacatggtgccagcaggagaagaaaccaagggagggtggccacaagagaagaatcatggcccaagagggagctagggtggacaccactcagggcctttcaggtcacagagggcagaggttgtctccccctccactggggttttcagaggacagagatccccacctggctgaccatgtatcctgagggctttctgtaaggcacagagtaggtttcaaccggtgatttctatgggtagtgttttgaagacagtggcatgagcttcacagccagaaacacaatgacaaggagttacagaccacctgagtgaggagatggtgtcaaccgatgtccatctctttgccgtaagaaataacttttaataccctgcatgctctcatgtttacaataattcactgcaaaaaatttagaaagcacaggtaagtgtcctacaccatgactcctttattttgttcccagccctcagcctttccggccatacagatgcactcacagagaagagcctaccagagagtctattatttaatcatttcctcataatatacaccttggacaaatcagcaaatcattaactattattctacaacatagtttaatatcatgggattctataacatagatgcaccatgatttatgtacacaattttatattgttggaaatgtacatgggaaattatcctgaaaaaccattttggtgacgtctatagtgggtggcccaagaaggggctggtttaaggaaagaaacactgtgcacatttgtgggtagagggaacagagaacagagaagggaaacttgaagatgcaaaagagattcataaaaggcaccgcagttcctctgccatgacgatacactgttgaagtgaagagctttgcaagtccacctgacacatgtgtacgcctctgagatcgcacatgtgaaagacaacatgccgatacgcctaaccaggcaatgctgaaaatgtgcgcctctgtatcccagaccagggctgccagaggtctcagagcaccagcctgtctgccatgctcagctctctgttgcagtgcattttcttttctaggtctccaacccagtggtatagtccttccttcccttatttctctccctgacatttccctccttattcctccccaagttgctttaatttaagcagcagttgccatcaaagaaagaattctgggcgtggatttagctgacaaaataacaaagcagaccaagatttatataaagattaattgaaatgttatcaacaatttacatggaaaaaaaaggaaatagttctgagtgtctttaatgattagtcaaaagttaaatcaataatgatataaacataaaatgaagaatcatattcaacggcgtgagaaaaagcacacaattaaatgtttaaaaaaagtagaaactgtatatctagtgcaatctcaattctgttttttaaatactctatataatgcataattacaatatctgatgtacacttaaatatatgtacttaaaatataagcaaatattacaaatataaaccaatcatgttttcttggtgaaaagattatgaatacttgtgattactttattcatttctgaatgtgttactttttataataagcatttcactttataatgggagtaactacctatttaaaataattttttcaatctacactggttatagcaattgttttacttctgctttgcttctatcaatctgtggttcatttcaatttatttccaacaatgatgacaattaaccttaggtcatgagatacgggagttgctggtgatggttaaacatacggtgtcactgacttggaagccagccattgcaggttaagagtcatggtctgtgataaaaggagggtatggaagttccttatctggaaacagttcacacatacacacattcagtcaagaattattcccttaaacacctacttagaagttggaatacagtactgaaaaaaccagactcttccacttaccactaaatacagagaccaagagtagacagttgtacaaacagatataatcaccaactacttaaagtgctaacaagaaaagatagaggatgctatgaataagtagcccaggaggtaaaatttggactgagtttggtaaatcctctttgaggaagtgacatttacatggagattttggagacaatgtaggatttggtcatgtgaagagccggtggacaaatggacaagtgttctagaaggagagaatagcatatgcaaagatccagaagcaaaaatgaatgtgtacaactggaaaccttgactgaattagcaacatgttctaatcaaatgagttaacaaattacagagccggtgacacgtaatcaagttaatatgttactgccaaggaaaatcatgctaccatgtaggactaggaggaaacctactttctcccaccattgcctgtaactgccattcatcatttcaccagaacagtctcatttgctcagctgaccttgacaattcagttttagattgtgtggttataaaatggctgaagcaaaatgcatcccaccactcagacaatacaatctgaagtaactgaataaagacagattgttctttgaatttaagagctcatctccccacctactttgaaaacagaaaacacccgaagctcatcagttaaagtggctcacagtggaataatattcacggacaaaaaggaaaaaagcaagtctccaattaacactaatctcagttaatggaggaagaagcccacttctttcagttgctttcatcacatgttccccaagattgtgtatcttaacaagctatttaaggcaatctatagccaactgtaaagttagtaaatggtccataaaaacgcaagacaactgagaccaaaaactggagaagaaaccagccttgcagcaaactaaacttttgaaaaatggtaaggcccaataaaataaaccagtagagataaacacagtaaataaccatcaactaaaacacaggctaactaccaagttaccagcaacataaatactgccaactccatgtataaaaagtccatgctcaaggtgagcaagaaaaaaaaaaggataagacaaattataaagtagcagcgagtgagtgagaagagaaaagtgtgcttgcaagggaatgtggtcttcttccctcccaggacacgcagtggggaccatgacctcacatgaaggtgcaaaccttgttgagaatatctccagctaccagcagattctgtttctgaagccctttctacattgttagaaagcaaaggggaaaagtgcattccccttagttcatgtttattagacgtctaagttccaggtatgctgctgtgcactgagtaaacaacaaactagattctatgtctgttttctggaagtgtacagtcgtggacagcaaagctaaggctcagtacaacaaagggcatacccctgtcatcggtgtcttcttactctctccctaatgtgatgtattcatcctcccagtttagtcaaggcagaaaggagatgaggaaggggagaggaggggagaggagggaagaggaggggaggggaggggagaggaggagaggggaggagaggggaggccaagggaggggaggggaggggaggagaggggaggccaagggaggggaggggaggagaggggaggccaagggaggggaggggaggggaggagaggggaggccaagggaggggaggggaggagaggggaggccaagggagaagatatgaaagaaatagggaaggagtgggacacagggaggaaaacaaaactatttcctttcatataaatgttgtcatctggggagaagccctcactatctccttggtgcctttggcttttggtattcaaatcccagaactctacatttggaatctagttctttcaagctttacattccagaaatccatttccattcttaatctgaaagcaccaggaaggcggatgctaatctcatagagcattctagtacagcaagtagctcagcacagaactaattaggagcttggtgagtctttggtgatgaccaggatggccaggacttgcttttagagacagccactgttagccagattccctagactctagggcctgtgaatacagcctagaactgtgtctaggagggtgtaattatatcgacacattcaacactctaaggaggcccattttcagcttgaaaaaataaataaataaaaaggatagtctcatctatcagtgggaatgatggtgatatatgtataaacaatctgtaaaataatttgtgaacatgcatcgagagccttaaaactatatgtactctggcctggcaattctacagctacttcctccccgctgaggaattaatcatgagaaaatgcaaagattcagctacaaagctcttcagcccaataacttgtgatagttaaaaaacagacaacaaaatgcctaccactagacgttaaataaggtacggcaggggtacccagtccccaggctgcggactggtaccagcattcgatttgcataggagcgcaaaccctatcatgaactccacacacaagggatctaggttgcgcgctccttatgagactcacctaattatctgaggtggaagagtttgatcccgaaaccatccatccccctcctctgtccctgtctctgaaaaaactgtcttccacgaaacttggtccatggtgccaaaaaggctggggagcactgaggtatggaatagtcatacaatggaatatcatatggacattaaaataatgtaaaaaaatttatgaaagaaaaaataataagtgcaaagaactctaaagtccaatattaatccatcttggtaaaagatataaaatataaatatatatatataaatgtgtgtacatatataaatgtgtgtgtacatctacacacagagagggagaggcagagacagagagatggacagtggaagaaacagaggtatgggctagaaggtatggtaacatgttaactgtagtcgctttttttttttttttttgcttatgatttctaaatttcccataatgaacacattaaagtaaaaaatacatttaagtatcactcattcgtcttcttccccgattgtcggtgacttcagaccaacctctgagttaggggccttccgtggctgctgggtctgcactagccctgatgctaaccaaaccccctcaggctgctgcactccttgggatgatgctccttcaatggctcaccagaaacaggtttaatcctgatttttgatattctaactgggtttgaaagctagaatttaattattcaaatacatccatctaaatgggctcactactggttagtgctcagaggaggctaatgtgccagtgaaaaattcttttattttcaagactgaaatgagcttggaagttatctaattttgctttgagcactttcaagaagctgtgaaagcctctgcatcttgccaaattagctgcctgtttgcagtctcaaagcaaggcagaggaggcttgagcagtcggcttggtttcttcttaaagacgctgcaccagctgaggaggaatgtttcccctgcaggaaaattatctcctggcaaagaccctggctgggcacctctccaatgtggaactaactcccaaaggaagtcaccaggcttctctgcctaatccaaaaattctctggcaccaagtatcacgcatgtgtgcgtacaaatcatggcttccagagagtttgaggtgtgggccagcagtaatttcccaaactatgttccaactctatgtgcccagttaggctgatacaatgttcttggggaacaagaactttgcttttaaaactgcaaatcttactataattcagaccacagggtattttttagacatgggctgtttagaaaattagtagatggcctgctgaacagacaaaaatcacattgctctgaggataacttggagcttactggatacaataatttgcaaaccagtcattcttttggagagctttgttctgggaaaaactgagtactatgcagcaatttttcagtcaattgcaaaaacatactcatgtctacacaataccaaagaaaccaagaggtatggtaattgtaatgccaccaaacttgtagaaacacatctgtgtgggtgagagactcacaaagataggggccaagtaatgtggagatagaaaacagcacacagggaccactgacaaaagacctgggcagacctgtgagagggcagacgcatcctttgtgctgagagcacatgtgctggccaaaacctacagctcaatgaatatttgtgaggtgcccactctgtggggtcttctggagattcagagataaatgaagcatagtgcctgccctcaagaagcctacatcaattaaatacacaaacatcaaatgaacaaatttggaaagagctaagatacaggaatgcacaaaatgcctgcgagaggatacacgggaagcacttagctccaactggaaatgcacagaaagcttcctgaggatacgactctatgctcagctcaaaagaggaagaggactggccaagggaagaagagggggaaggcgtcacagacagtattacagatgcagaggcctggagaaaggtgtgacccatgtaaatcacaggataaagttccgagtggagagtgactgaaaataacattggagaacaaagtcagagatgatcaggttgagttgatgcttggaagtcaccacctggtaggtactgaggggccaggccagaagctgagaagaggaggagggggtgaccaggaagggctaaggaggtgtggtgagctccttcctcaggttcatggcagggacaggactccagggacaggcccacaagtcttccctgtgccatcagatagagaaagtcaggaatcacagtggtaaccatgccaatcggagctctgcaacatttgctgctcctcatgtactgaccacattgtccatttaaggaaaaaaaatctgtcctacatgttctttggtagtgatggacgacaagatttcccagagtgaaagatccctatatacttgctgaaggtgggggcaacaagaggaagagtgctaggaggacaaagtactcatgtagagccaattgcggaaggaaaaaaattcccaagggatagagtgggtgatgactgttatcaaccgacaggaaagcaggcggcttcacagggacctgggcaagggaggggagtcccagcattgctaggcagaagccagcatgagggcttagcacagaggaggaggccaggaggcgtgtttgtgtttgtgtatactggggcgggcagggaagcaaacatttaatagacacctgctttgtattacacaacaattaagagggtcagcccctagtttggcctaagagggggaaagtaataaagagcagaagaaagctctgaaacaagtttgtttgagtaggaggtgccatcaatgcttttgattcctgttaaaactggttctggagaggtgatgaggcaaatatggggttaagggtctccagactccgcacttctcagcagggcttggtcacctgctgaagctacaagactgctcacagggcttggtgactatgtaggtaccctaggaggtgacttacaatgagatgcaatgcattgggagcacaggtctggggtgacatgtgtggctttccctaatttaaagatcttcaaactcatccaagtctggcatgtgaaaagataatactaccaccgtcctgatttctaacaggctttacaagtgtcttccctgttcactaaatcatgctctgagatgactgagcctcggtctgtctcaatcactcaagccccagcacagggctggacaaatgatgggccctcaagcaccactgaatgaatgatgtaaaacggcagggctgtgaacatctattttattcaacagggggatttgccttcatcttccaagtggagaaatatcacctgtgacaggccacacaaacccgagcttttcccatggggtgtctgatcgttgacggagtcatagtcacttacaggagaaagttcaaggcccagggcctagtttttcaaggttgtactcattatcctcccttcctcttgacaacctgctcctcttcctcccatatttctgtttcagctgggtggcaagcagcacccaaccagttactgaagccagaaactggaagtcaacatcttttccttcattacatcccatatccaattcattatccaaacctcatgacttcctgccctgactgtctctgtagctcacccttctaggttcctcccactgctgcctcagttcaggccctcacctctaggatccttgtgagcttctccagggcttgtgctgcccagccaatttctgagaggtcagagcaatgcctttcaatgcaaggatgaatgaccatgctgctccttggctacaggcactccttggactgactgggttttgagaaacatgcaaatgagctagttgaactgaacttggcagaacatgagagaggtcatgtaatcatcaggaaatccatccaggttagatttacattcatcatttatttgctatacttaccaggggaactacattttgagattttctttctatatttttaaacaccattttcaacaatggacactcttgagaaaatagaagaagaaaataaagatgaaaagaatacaataagatactgcctcacacacattttgatgtgtactataaaaacagaaaatcacaagtgctgatgaggatatggagaaactggaacccttgtgccctgttggtgggaatgcaaaatggtgcagctgttgtggaaaatagcatagcagttccttgaaaattaaaaatagggctgccatatgatccagcaattctacttctgggtacatactcacaagagttgaaaacaaggactcaaacaaacaagttggacacccatgttcatagcagcattattcacaatagccaaaaggtgaaaacaatcaaagagtccatcaacagatgaatggataaacaaaatgtggtatatccgtaaaatggaatattatttggccacaaaaagaaaggaagttctgacacatgctatatggtggatgaacatgaaccaaagacattatgctaagtgaaataagccagtgagaagaggacacaccagtgattctacttaagtggttaaactcatggagacaaaagttgtgtgctgattgtcaggagtttgggggaaggagggaatggaagttatatttaatgagtacagagttttagtttggcaagacgaaactggttgcacagtaatgtcaatgcacttcacactactgaactgtacacttaaaagtcattaccatggggaagaatgttaactgaagatttggccctggaaacccacccctcaggcaactaaaattgatgggcaattactttctacagcaggtggcaagttgcaggggcctgggaaccagagagaaagtatgatgaagtattaaataatttttatttgaatttgtgtcaatgaataatgcaaggggtagcagagagaaaatgtgtacttgaagtcaggtcaacaggctgcataatggtagcgtcagatgcatccagaaccactgtaattcagtctaaaacagattgcttctcccgaattctctgattgccttggcctagttcttcatttcaagatgaggccctcttcccacctatggcttaaagatcctgaacatgattttgagattattcaagtaactgcagcatcccctgggacttgcagtatcccctgggattaggcagacagattaggccacaaaaccacattcctctgcataatatgtctcattccagtatttggaacatccacgcccaaagaaattttaaaagcctttcccaaagggactcaggtgtcttactaaaattttattcttaatctgtttacagaatttttattaagcatgttatgtgaatgacaccttatacagaaaagaataacacaaggcccctgaccttaaaaagcttccattctaataggaagtatacataagcagagttcttactcgactgctagcccaggcctgtcctccctgtctcccccatctcagggaagagtgtaccacctgcagcagctgtttaaacctgaatcctgggagttactcttaattccttgattctactttgctccacttctatggctaaagtgcagatccaagccactattacctttcacttggattaaggaaatagctttctaaatggtcttctgcttctatgccacattctccaaatggcatacatcctgatatttgtattaagtacatcttcaggttactctcttgcttaaatcattctagtggtttgccagctctcttaaaaaacagtcaaaccccttccaattgccagcacggccctacattagctggcccttgacctcccctccctcacttgtaccactcttcttcttgcttactatatcccatctactctggccctctcttcacttctcattttgatgccatcacacttgctttccccttcagtctcaatgctttccattctccccctttctgttttatgagtgtcattttctctccatacaagtcttagaccaaacatcccttcttcaggaagccattcctgatcactccatcaaacactgtcctaagacatttgatttcatttcattttcacttcctggatttatttttaaattatctgttgactgtgtctctcctccaacaagcatgcaagctgaccttctcaggattactggcaatggtgcccccgtcctagaatcctgactggttcataggaggcattcagagaggatttgttgacagatgaatatatgttacaaagaagacaaaataaggaggaaagaaatggagcaatgtacagtgaagaagggacattgatttttggttgtggggaagaaagtcaggaatagcatccacagcagagtttgtctgtactatgccctggaggacgagtaggtagccaggcaaaaatgcatcccaggctctggaactagcaaaggaaagccccagaggcacaggctagtccacatgtgactgagcaataaaacaacagcagaaaactggagctcagaacacctggagagaggtccagagatgagcacagacagtggacagcccgagtgacatggtgcaggctgggactttattttttagaccatggaaagtcactgaaaagttctgaggatgaaaactagtaactttgacctgcattttgtaaacactgaggaaaactatttgaacttaaaaactaaaaacaaaaaatggcattacttttaagagaactacactttctcctgttttagggagaaaaaagaaagacttccatctcacgtatatatgtaaggcaaagaggggcccatggctagtgaccctgtgctcaaaggaaaggctgagtgaagatagcgttttggttttcaaagccattgaatagccatattacattagcaaatggcttcacattaaaaggtaccaccactgtggaggataataacgatagtacctggattccaggattaactaactgggtcctgggccaggagacaaaaccaagccagcactcttcatatcacagacaatttaactagacaaacaatatttaacggatgggatcacactattttagctgaaattacactaaagatctgtgtattatattaaacttaaacattagtgattccatcttggtcacaataaaaggcaactgctaaaactactgtaaggaattaaagacctacaacaaaacgtgcctctgaagtacttaccatttagttgctctgagaatgttctcccatttcagaggtctgattgatatggcttatttcaggacagaattatttaatgagcacaactttcctcaatgaccatgtaacaaaatggaaagaccaaataggaaagacaaaggctgacacaagggagtcaactgctggtgcttccagaaatcctggaaagcgggggtgggggcgcccaggagtccacagccacagtgctgtactacatggctttttttcttaagttcaggcaggtgttggatttgggcttcagcttgctggcccataaaatgaggaatccagaaatgtgatcaaagatccctcctatgacactgaagaaattccttgtaggtatctgctttccacaaaccagaacactggcttgggctgaaggagtgaatggctttcagcacacagcttgatgtttgtgagaaatcccagggttgggggtgagggagcaatggaaaatggaaccagtcccccaactgcaggaggtgacagagtcaaagcatgagtgatggaatcagatagacctggatgcatgcttcagctctgactatgaaactgacggagagcaaatgtataaatatttccccacatgtaaaatgggaataggtttgtgagaattaaaagatcacggattcaaggtgcttaacatagtgcctggcatatagtaactactaaataaatgacagttctagaaaatgttgttcttgttacttcacttgttcagccatttgatttacctccattattttacatgagattatcctggtaggaaagataaaattatggaacctctcacaaccgaaaagggccctcaaagttccctgtttttaggcattttcattatcactgtcattttattgatgaagcactaaggacatgagttaagctgactgtccaaggtcacccagccactaagtcaatttaaaacactctcatttgtgctctcagcagtcccctagtgttcgaagtagtgaagataatttcctgctccattggatggcctaagaatcaggctgcctctgttataatttataaaacgagataaaagtgcgtaagccaaagggatcatgcactaagtaatcaaagtgccaactctaaaatattagacagttatgaaaatgataatgaagcttgtaacaacactcacgaatgcttattatgctgttaagcaaaaaatcagaaaatgcaaaactgtttatgttgtgattataactaagtaaaattatgcacatatatagtaagggctggaaaggaactcggaaaatgacggtggctgatttgataaggaggcgccgttgcagaagttttatttttaccttgtgactataatggagttggcacaataaatgcaaaagtgatcatcacagggaaggagatgctgctgttcactcacccggggttatacaacatgactgcagacaggttctcacgggacttcgagaggtcggtcatggacaagctgaaggaggacagaaggccactctaagggcagacacagggcagagtggttaccttagcagagaagaaaaggccactgctctggactcattgcttccaacatgtgagagacaatgaggtgcacatgctcctaattaacacgcaccacaattaactggtctatctgaggaaagcagatcatgggcagtaaggccctgatacatttcaaacccgagccttctcctaagtacagcaggaccttggccttctagggctggggaaattcatcaggaattccacaacccagttggtctcccctgccggttaaagtcaaggaaaggggtcacaatatctttgccatcctccattacctggcaggcagcaatctcctataatcagcgatattccctcacacttagaacgataaagaagaaggcaggaggggtgaagggagaccaaaagtaagagcttgacctattttgcttccaagggaagctattggcaaacatgttttttccctctgttcctctgaaactgtgtaccaaaaacgaccctctagggagaccctgggctagagcagataagaggctccactggccggaaaaagccacccaggagaaggctgaggtttgcagctttcttgctattttccaattagggcactggcaacctcgggcatcccttataaaggagacagaaatgagagtctgggtaaccagtggtcaagggcaaacacttctggtattcaagtcagtactgcagccaaagctccccatttgccggctacagaacaagttagggagagttgctcttggtctgtttctcatcttgacctgggggtgatagcatgggggtattaacggctgctgcacagataaagagatagaatatatgtacaagtttagcaccattcctggctcgtagaaatgttagctgtagcctttattattttcttcagtctaaggaccagccacgatgtccctgaacagatttctttctttctttctctggtccttagctccttccccatcagcacttaaacgtcctgccctttagacgtccccttccaaccaaaccaaagtctttcccagttgtcctaaacccacccctgctctcgcttcccacctcaatgaaaaatctgtttactgtggctgattttggattaatgtgattccaatgttgggttaattcctaacagatgctgattagaggaagtcactctccacctaatgcaaaatgatgcccagttccttggtgggaagggtggaaggctgaagagaaggatctaggaggagcagtttctccctgtctgctctagaatttacttgcttgctctcttacttcatcagccaatcatctgctgggaaacaatctccctagaatcaatccagatcacagaactacttttccacggttctgcaccccagaaagtcaaaagattggaaccagagtgaccaccacccactcatcctcacatacgatcagtggttccctcctagagacgccgtgtccctcaccttcctcttctccctgagcttggcggcttcctttggatggttaaagcgaaacatattggttcttcccaagagaatcacagcacctgaaaacacacaaaaacagtaatgaatttacagtaagcagtctggtcagttgccaataccataacatggaattctactgttgaaatgtaatttccagtgtattataaaataataagggaaagctttagtctcaaaagtctgcttacttaagacaatttcaaatctggaaatacctttatttttacagctgagtgtcacaacacacattatatcctcatatccataatatccagcagaagtgatgaatctaagcattacaacatattatgagatttaaaacttaacagacatataattagacttttgattgtctggaagaaaaaaggaaaccagttctccaaagagatataatatcaagcaaagcatatggtcacaactttaggaatgtttattgatactggtaaaagtagaaatctcaaaagaaaagtgctttcaaaagaaaacgtatggaattggcataatataggtaactattactaaaatctccctcagaatttgacgggagagaacttgtgtacatttatggtctatttccaaataaaaacactgcttcttctcaaaaccctattaaaattccacattagacccataagaaagggtccttttgactgatgacagtcttccttattcagaaaacaactgcacaaggggcaaaataattcaagggaaatgcccaaggaaaacaaaagcatgggaagaggcaaatttcagcttgatgaagcaaacaaacccattttagggtcacagctgtctaaagcgggcacaggtgcctgcagggctgtgagctccttgtcaccagaggcatgtaagagaaaagatgttgcagaagaggttcactgtgtcttctgaagtcccatccatgtatgagaggccacgtgtatggtcccatccacgtatgagagtctacaatgcctcagggcatcaatgaagataagacacatgcactgacagtcaaccatgaagaatgacaggtgagtgcttaagtgtctagcacacttagctgagtgtgtgattaagtgacgagtggagcctggagtagctggggacaggcttctgcaccaaggacctaagttgggtctcaccggataaccagagggcaagaggaagtgttccatgttgggtaattgcagagagagtctaagctatagaaaggagaatggcctgctatgctcaggacagaggagagaatcatgtccatccaaagttcaggatgtttgaaacagcatcaagaatcaatactggatagatgaaatagcctgtgaagaccggagaacaagtatgagagtttagaccagaggtcacaaactggtggccagaggaaaaactccagtctatagatgtatttttttgtgttccctgtcatgtttcaaaaacaaaatctttagttggcaagagttcaaagtctggagagttcacataaaagtctgggtacttttctagcattccttcaaaattcctaagatatgctatcagtagatctttgtttgcacttagcaaaaatccctgggctgctgagagttgcctcctttgcacaggtgacctctggttgaccacagtcactagcctcttgcttgggtaatatcttcacctgggccctgcaggaaatatcataataccagatatctattctggagctcaggccagcatatccacctgcctatttgatgtattgttttggacaactcaagggagtttcaaattcaatatgattaaaacctaacaggtttaaataacaacgacagggagcaactgatatgggttggttttagtggttgtcattatttagcagaaacaaagtcactatgaaaaggaggataagacagtttaggagccctagtggggcagcagcagatattatccactctacaatttgcttatccctgtcatgcagaattgcatttgtattttttccaattatggcaagaccattaccatgataaaaaaggtgtttcccatgccttttacgactaggactacatagtaagccaaaagctaagcagccacgtctaggatgtatgtatatttaatgctgttaaagttacattagagattaataaagcaatcacattccaggtgttaattacatctccaattcttctttttttctgttaatcaaatgcccagtcatgcaagttgaaaattgctaaaatatgttaatggaaaaatagaatggtatttcagagacatatttcaaattgtattaaatcattgaaaataatcttgccacccatgttatctgcatgaaatacacacaaaaagccctgtaaggagttataaaagaaagcaaaactatcatgacaattcagtgcttccatctagataatgtttgagtcaactgtctggcatgttaaaaggggtccattaaggctggtttccttccctttcttcttctaagcacctgtactcaacaaatctcgtgaatttaaaaatttgcttcatttttacatgatgccactgttcattcagcaaatatttaatgaacacttactgtatgccagtcactgtgataaacatgggggatacagagttgagcaattcagacatacgctttgcctttatggagctttaaaaaatgtcagagagagagataaataatcaaataatgaaatgattccacaaataaatgcaaagctgcagctgaaggagaagaactgtgtcctgggctcaaagagcaacaatgataagggtttattataggggaaactagagaaggatatcttcaagggaggtggtgtctaaaacaagctctgagaacaagttgggagagtgtcttgcataaaagcaataatgatcatgatgatgattgatgataataatgaggaggaagatgccaccaagaatgagtgactggaagacaaccatgtggctatggcaaagggaacaagagtgagcactgcaccaacataaggcttgagaaggagggagaaagtgaatcaactcaaatgtttcaggatgtaaaggatcttgtgttttatctagttgtaagaggaagacactgaagggctctgtgcagcagcataacatgattagatttcagtttcaccaaagatcattcttgcaatggtgactgaagaaaggccaaacagggcaagagtgaatatggctaagcaagccaggtggctactacagtggtccaggtaagtgatgatggctctggactgggggaaagggttaccaaagcagagaagtaaaacaaaactggaagatatgtaggagataaaatcaatatgatttgatgatgggctagacacaaagaggagacgggggtgaggaagatggcttctgggttctggaatgcatcactagttgaatggggagtcttctgcacagactgagaacactggaaaaggaccaagatggggtggggaaaaatcatgagtttggttttggacataatgaattagagatgcatttggcaaatgaaaatatgggtttgaagctcttgaataaaagtctgggatgtcgatctaccttcctacccacttacctacatatatatatatatatatatacatatatatatatatatatatatgtaggtacatatatatatgtaggtacatatatatatgtaggtacatatatatatgttggtacatatatatatatgtaggtacatatatatatatgtaggtacatatatatatatgtaggtacatatatatatgtaggtacatatatatatgtaggtacatatacatatatgtaggtacatatatatatgtaggtacatatacatatatgtaggtacatatacatgtaggtacatatacatatatgtaggtacatatatatatgtcggtgtacatatatatatatgtaggtacgtacctacatatatatgtgtgtgtgtgtgtgtgtgtatatgtgtgtgtgtatgtgtgtgtatatatatatagagagagagacatatacatacacacacatatacaggttgactatcccttagccaaaatgcttgggacaaaaagggttttggagttctgattattttttggatttcagaatactggaatatatataatgagatatcttggaaatgggacccaagtctaaacatgaaatttatttatgcttcatatacacttatagagagtcctgaaagtaactttatacaatattttaaataattttgtgaatgaaacaaagttagtgtacagggaacaatcagaaagcaaaggtgccactatctgagccacccatgtggacaatctgcagttgcttagcatcaccatcattcctgattctgaattatatgctgctgataagcaatcacctggtgatccatgtctttttgttagcataatgaacaagtaggaaattcactccttgaactgaaaacagggaggatgcaagcttttgcttatcacagcaattttacatttacgcatgcctgctgcattagcacatctcagcacagttattctgtccttggcacccttagttcctgtaggggctgcctcattgtctgcagtcagtgtctttctagagcaataatgccaaaacggtgatgtttcatcagcattacagacttggttctggtgtcagattttcatcaccgatgaccttgacatactcgtcaataaatttctctgctgcttcatagtaagcagatactttatcaccacaaatctttaaaatgtaatgctgtgtctgttcctaaatgtctgcaaccagcctgctgaatattcacagtttccttcaatttttggttcattgtgatagatttttgcttgttttcatgatcagcttcccattaagtggcaagtattcactgtgacactgatgggatccactcttttaatacacaattgagatcttcacttttagctttatgctgtgtttttctatttttcatttatgtgtatttattactttgagcatagaacttagccttctgtttcttcaggtcatatatgatggccacttcaacactatactcttctgtaagacatttcacacttaacaccaccatcctgtttctctaacagctttaccttctgtgccacagatcaacataaatggttcctgtgtttcttatcactgttgtccacaggagtagctgcagacctttctgacatgttcaaacattatctttacagcacagagcagagaataagtaagaaaaaaaaacccacagtgagtaatgcatgcaggtcttggacctgcgcagggtatcatggggaacatactattgtcatgtgtggcctgaacatctgccatttttttgtcctttgtgggcatactcgtatggggaatctggacatgtgccgaaaagatacactgaagctgaaggggactaggggggcctcttttcctttgtggatattgaacaaactgtgtgtgtggtggacctaagttttgattgcgaccccatcacatgaggttaggtgtggagttttccacttgtggtgttatgctggccctcaaaaacttttggacatttcggatttctgatgaggaatgttcaacgtgtgtgtgtgtgtgtgtgtgtgtgtgtgtgtgtgtgtgtgtgactcattgctaataaatgaaactataggagtaggaaagaaacctgagacaaaatacagaggtagaagacaagaggacctaacattgggcacctgaaggaatgctgacttctaatggccaagtagaagaaaataaacttacagaggaaacagagaagagaccatgagagagggagaaagaaaccctccaaagccaaggaaaagaggggccaacaatgcagaatgcttctcagaggtcaactgagacaaaaagactagaaaacaccattgggtgtggtggcatagaggtcacaagtggtgttagtgggagctgatttggtagtagaccgaggccagaaggaagagactgaggaatgcagaagaggtaaggaaatgcagatgtactgggcacaggcaactctttcaagaagtctatgaatgaagagaaagagttggtagtagccagaggggatgatagtgtattagtccattctcatactgccaataaagatatacccaagactgggtaatttataaagtaaagagatgtaactgactcacagttcagcatagctgaagagacctcagaaaacttaataatcaaggtggaaggggaagcaaacatgtcctctttacatggcagcaagaagtgccgcataaaaatggggaaagccccttataataccatcagatctcgtgagaactcaccatcacaagaacagcagaatgggggtaaccacccccatgattcaactatctcccaccagttccctcccatgacatgtggggattatgggaactacaattccagatgaaatttgggtggggacacggccaaaccatatcagatagatcctgcaggatattttattttttgttaaaacttatatgtatacttaaaatgcaataagcaaactgaagggcataaagaggaataaatgaataaaagaactaatgaatgagaatggctgataatgtagtttcttgatgaaacctgaagagtgtgtgcttcccagaaatctcggtgtggttaaggacaagtcagtgcttaatctctccagaattcagtttcctcatctagttatcaaactggacaatttctaagattccttccagatcttaaattcttgtcaaccatgaaccatttggtctgaggtcagtgtgattaacagcagcagatggactttatgtgatgcacttaatttgtaattttgcaagcatttctaaacctccttgaaataatgacttctttgagattaattcagagtttgctaaatacccaaagacagacaaattccagagagtcttcagaggggatggaggggacatgacattgtgaaagcatagacaaagacattgctggtttcacatgagactctctattctaatatttcaagtaagctgacagaagtaaatctgcaaacgtttctagtgattcctaaggaatgcagggacaataatcattaatatcaccaataattaccctcttcaagttttatgagattttctaattctgctactgcacaaataaaacaactcattttttctcctactgttttcatatgaatatttctgaggtaataatgtaccaattatttcattttgggttacaaatactacaaacatatgagacaactgtgttcccacaagtgtgtggttcacactttagaggctgtggtgtcaataaaaatgagaggccctttgtaattctgtttcgagactcctagttctacattttactttagaaacaccccctgccccccaccaaccaaaacataccccccgccctccaccaaccaacacacacacataggatgcaatgcactgtgaaagcaagctcagtggaagaaaggttatcattttagatgtgacaggtggagaaaccaaactctgtcaggaacatacaattttctgaaatggtattgagtgagaggctgaactgaggtagggcaggtaaagttcttatttcattgcctgattgaagcaaaaagaaacttgcttgtgtgtgacattttccttctgatttaaaatatcttaaagatatttatttatattaaaataagttatgatgatgataccatttagggaaactgataagaaaacatctaatttccactaatacatgccaatacttaagaacagattaagtaatatgttctagggccttagacttggtgacacagattttattatttcaaacacgagaattatagtactttttctctatatcaaaaatggctttaggaagctagataggaaaagatgaagatggaacatggtgtctgtggtgggtaagaaaatttcacataaatactaaacaaattcaagcaggacatatggcttggtgttaatggctggcttgcgaatgaatgacaggcactctgcaacaaaggcagcaggcatcagtatcacatcatgccatcagatcatcagttagtaattctgaagaataaacatgaaatgataccttatcaaaaagctacgttgaccttgtcccttctttttcaatgtttacaattcaaatatggatttacaatttcctgctttagataaatcacttcaacctctgtttacccttagtaaagtaaaaattggaaacttagattctgggactctgtagaagaaagaaaattgattttcaatcttggctactgaagtttccagccaaattatccatcaagaatgatttgcccaactgtgtgcacaaactgagtttgaagctttgtaaaatttcgagatgctccagtcccatacccaaagacatttttagatgtgtgtgtcggagcagggagagggggtggtaagtgggagctgatatttttcttaacacctcatgcgagaaacaaaaagagcacagacatccccaacttaagacggttctacttacaattcttcaactttatgatggtgcaagagtgatacacattcagtacagtattcaacaaattacatgaaatattcaacacttgattataaactaggctttgcgttagatgattttgcccagtgttctgagcatatttaaggtaggatagactaagctgtgatgctcaataggttaggtgtattaaatgcatcttcaacttaggatattttcagtttacaatggatttatcaggacacagcctcattgtaattcaaggaatatctgtatatggaataggtctgtccttctgcaggaaaatgtagaaagcacaggaaatgattagagggcaattcaagacagtgtatagtcacatgataaattccaaagtactgaagggaaagcattacacaattggtcaagctattagtaactttctttccattcttgcccagtagtccacattctttgctaccaacttcttattcactattagtaatcatctcaattatttatttctaggctcatacgcactccacagtgtcaatatcctattgttccttccgaaatagttcttgcacaatgcctcccttccttcagctcccaaagtcttttaccttcaaccccttttcctcacggctcttctatcagcctccctttgagctaaacaaaagctgcatcatcttcacctctcagcccacattacccatctactgagtggtcagcacagacttccttctgctttccacagaaaattcatgcaactgatctagaacttaagagccctacagacctgcccatgactcagactcaacagcgttgatctcactactccttctcctccctccatcccctttccagtcttagacatttcttcactacacactttggctgaagagcatctaagtcactttttcactatatgccattaagacaaatacattcacttcagaattcaactttgggtacattcccccttttcagcagtctaaaccaccctctgggaggagttttggttctgcataagctgaaacaagcacactccaccctgtttctcctaaggaatgtagctatagcctgaacaaaatgcatgtagtagttatttgagggccttgggaagtaaagagtagctgttgcagttctctaataaccagtgatattaggcttttattcatatgtttcttgactacatgtatgtcttcttttgagaagtgtttattcatgtcctttgctcactttttaatgtttattttttcttgtaaatttgcttaagttccttgtagattctggacattagacctttgtcagatgaatagattaccaaaattttctcccattctgtaggttgtctgtttgctctgattatattttcttttgctgtgcagaagctctttagtttaattagatctcacttgtcaatttttgcttttgttgcaactgcttttggcaatttcttcataaaaatctttgcccatgcctatgtcctgaatggtattgcctacactttcttctaagggttttatagtttgggttttacatttaagtctttaatccatcttgagttaatttttgtataaggtgtaaggaaggggtccagtttcaattttctgcatatggctagccagttctctgagccattattctcagcaaactaacacaggaacagaaaaccaaacaccacatgttctcacttgtaagtgggagctgaacaatgagaacacatggacacagggaggggaacaccacacactggggcctgttgtgggagggtggggtgcggagaccatcaggaaaaatagctaatgcatgccattaatacctaggtgatgggttgataggtgcagcaaaccaccatggcacacgtttacatatgtaacaaacctgcacatcctgcatatgtaccccagaactttaaaaaaaaaaaaaacagagtagcaggtggattgaagaaaaccaagattggaagcaccactgaactaacagtgaatttaccattttttgcctgcagtgcttcccagcttggtctaggaagaaagccaaaagtggacaagtgcaaaagagagaactccaggagaagccccctagttcaggttggaggaggagcagagagtcccttagcagcaacagtgggcccatgaggaaagggaatctttctttcccatcagaggagctgtagtcccccaagaaggtggggcagatccctgttgctttattccttccctgtcctctcatttcttggccgtagacacggagacaggcatatgaaagagtagaataaataaagctcaagatttccagggaagggaagacccgagggaggcagaaagtgcaggagagatgaagagggaaatatgcaggaaagcaacctcacagagttgtttattaactcctgggctcacccctatgtgtgtacacgtggatctgatcctcagaagaatgctaagactttgagaactgaactaagcgacagaccactgcacaggtcccagcctggccaacgggtagtacacccactgctactggaggagcactgcaaaggatctgaacactgaagcagcagtggaacggcagacacgatctgcaaaagctgatggtaacttatggcctacatccagctaggtaaactgtctgctgaaacaaagggtataaacatttcccataggatttaaacaagacccaggatctcataatatccaaaatgtctatgacacaatccaatattattcctcagcacagaaagaaccaggaaaatcccaacatgcattgcaaaaaacaatcaacaaatgtttatactgagataacaaaaagctccaataaatgtttcaatactcttgaaataagtggaaaaataaaaatttcaacaaagataagatataaagaagaatccaatattacaagtgaaaaacaaaatattcaaaataaaaaactcattggtaggctcaaaggcagaatggagatgacaaaaaaagtcagtgaacttaaacacaggtcaactgaaatgatccaatctgaaaagcaaagaaaaaagaatttatcaaaaaataaaaataggtaaacagagcctcaaggaactgtgagacaatagtaaaatatctaacttttgtgtaattgtagtcgcagaaggagaggggaaagagtatagtgcgggggaaaaaaaaattaacaaataatggttgaaaacttcccaaatccagaggaagacaacagcctatgaatttgagaagctcggcaaaacccaaacaggttaaccccgagaaatccatgccaaggcatattgtaaagccaatgtactgaatgtaaagctgaaaatgaagttttaaaaggagaagagagatcaagaaaaatagatgtgatgagtgaaaaaaagagaaaaaaaggggttaaacagaatgacaaatatatgtctcatgtccagaagtctggtgcaccaagaaactaactccagtataattagctttggccacttgttctcatattcaaacacatgagaagtcaaattctaagccatcaaactgactgaacagaccccctcttggccatggggaccccacagaaaccttggaaatcgagttcctggacatgacacgataggaggtaggacatgctttcttatactccctcctttgctaactgccacggctttcattcctcaaggttcaacagaaaccagcccattggaaagacttgtttcactgctgacttcaaccaactgtcactgcccctaccttctgtggtttccacacaatggaccagcattgcctcctgataagaaaccatcgaccatggagtggttctggccaatctacagggtgcacagtgaatgtttccatgtcctctgcttcaactcttgacatcagaggaccaaaaactctatccttgcatcatgctaaccctgccagtttttgttcacgcaactcatgtagaggcataagctcaactgtgcatgctcatgtttctccactcataaatattcatgacttctcctatagcttattaaacatgcacattcagccacccagctcagcataaattcctgttccctttccccctccctcaatgtgtctgcttctggcttccagctggaggctacacttcccagcctgtcagaatggccaccctgcaggccttataaaaaataaagctctcctttccaaatttacaaaccttgtcattcttcagttgacatgtgcatcagaatcacagacataaaaaacccgactgcagggcctgatccctagatttgctggttcagtaggtctaggtggagcctgggaatttgcatatctaacaagttctcaggtaatgctgatgttgatgacatactttgaggaccactagctttaggtatagtctgttaagaagagttagggctttgacattgaaaaatagttgttgaatcagcccatatacaagtgacagatgtcatatttgcaggtctctaatctgaggaagacatatgatgaatgcttagggtcaagtgcaggtgagtcagtgaaggaacagacactgatacctgctgacacataaaaggcctcctctgttaacgggataccttggctaaaccactgggagatctatttccctttctagttccactaaaattcttttttaatttgtcagcgaacaactcacagcagccctccagcagatgaaaattttatcaaagtctcctcagctccactctgcagacaatcatctgttccctctgagtacttgaatagatgaaaatatattttggcactcaagcataacacattcaaatgtgcccaagtataaatttcccagatgccaattctgtagcacttctaaaagaagagatgaatagtcaatggatctgacaaacaagtaagaccaaaggagtccacttatgtgaatggaaaaattaattgcatttaacaactatcagctttaaaataacatattacagtcaaaagaaaaaataataattaaaataagagagaatagctcctagaagttataggacaaatgctgaaatactgtttcaattacaatgcatctgactgttgtatcatttcatattaagtatataaaacagaaaaaagaaaaaaatctaaggtctaagccactaccaagaggagctcaagttttatggactagtattatgatcaaattcacattttcttcttggtaaaattcacactttcttgaagaactggctcttctttctttggaatcatcctatagaatcacagtgtggaatgaggagaactaagctttggagaatacaccaattgaagagcatgttagatataatgttacatatcccatcactatttctggaagaactaaaaaaagaggagaaaaacttcaggcaacaaactttatatatgtcatcacaattaatgctcacagtagcagcaaagccttttcttttgagtgaagacactaacagatgaaaatatttcctatggtttaaggtggggaaacagtttatgcaatctgacataagtgaggcagttaactgatacagaaatagaatttgccctcaatgttgacaatctgctaaatttagataaatctccgattagttggcattcacatatatggtaagtaatttagataaggaagtggtaattactaccagtgttttttaatgggacagcctaaataacacatttacaaatgaacagaaatttactaatgaaaagagacatctgaataccaaatatcagcaataaactggaaaggggtggtggaaaggtaggaagctgctggtagtgtaaggtggaccaggaatccagtcaattgtggagttaatatggctaggaatcattgtgacttgagttaccacgcagccgcagtctctcttcttgacatcttttacttctataaaaggaaaatgctgcttgggtctgcctcaaaaggtttgtttgtttgtttgtttgttttttgatctaatcaatgggccaaatacagtgaggtccattctgaggaccaagacacaatgagtcaggaagggtcctaggccaataaccactccaattaaccagaaactgggatgaggacagtaaatgtgggaaaccaggattacctggactttaggatcctagggctgcaggtatgacctaacctggcttagagagctaacgagatgaaatagcacacacattaagttataattatttaagtttcagagaaataatgcatgaattcgagcacgaatgataatgaatggtctgctgtaattatttttggacaggggtcatgggtgagggctaggggatgaagggctgatccaatatggtaagcatatagctacctaagacccatttccaagagacttggctgtcatctgttaattcaaatttgactttgtagaaattaactaagtgaaggcagaactatgcagaagtgtgctaaaaaatttacttaaaaactgttttatgggtaaaagccaagacagatttcaaagaataaaaatgctactatatttaatgctgttccccatttattatattttaatgacgttcatatgctgtttttttcctttagctttttgttttcttacagatacagttgaaaatccttttgtagctccacctgatataaccccctccttcttctccagtgggtaaacactattctgatataagaatgtatctgtctcattcatgactcttttatttttactacatattttcataaccagaaacactacatcacatcattttgtgttttaaaaacatgttccatttcccattttaataatccacaaacatcacgaaaagttaagtaaagaattctaatccttaatttctgaaggactatagactttttttctttaatgagatcttttggtcttaaagtatgtgtaattaaaagaaaagttatcaccttgcttttttgtacaatgcattgaaacaaagtcatctcgcattttactgccctaagacatgctaatgacatttacattcactgcacagcgttttaacaccttcaaacatagtatttttatgttaatttcattaacagtgatactgagaaagctgttcagtagcacagcagaatgccagaggaactcaagcccatcagatctgaagatcatggcaccatgctaataaaacaattaagagcatcccgcagggaaagacaattccgacaattaaccttcaatgccaattagtaccagtactgtccgaggaaaagtcgtatcttcaatatgaagataaaaaatttggttcctaacctgaatcattaaccagaataggcatattatttaaatgaactctcagtttaggtaaaagtttaagatcaaaaaccacttaataaaaatactgcgtgggagatacattatttatataccatgcctcaattcacaagacaattagagaggtaatcatcgctatataaacaatttcttctaactaactaaataagcaaataagctttccttaaggcggtggggaaggtagaaggataaccccaaaattaaattttaagttctagacagtgtccgtgtgtgtgctctaaaagttccttttgtctttttggtgtttggaattcagtactgattttctcacagaaaaagcattacatgctagcttctcagcaaatccacaagagactattttacctataacacggcaggaacattgctggtcaatgtaatctactcagcatcaagtggccagggctatgggtggtgggagctccaggagctccagagaagagtgactgtggcagagaactattccaaaatagttcaaaggtggggggcaacaaagccaggtggatccagcagccagtatggatgtttgggggctatttgtgatttaagaactacttatactaaataattcccccaaagtaatctcagttctatacaactataatgtgtttggaatttgtatacataaatgaacacagttcaacaaatgtatacattaaaaactttcaaagttttactgaaagaaatagatgataattcaaacacaagagggatattgcataagaagttccaagatggaaacatatttttccaaatgcaaacaaatcaaacaaaattagaatctaactcctcaaattacattttagcacaacaaaactatcctaatatttaaagaaaaaatttctttaaaaagttaataagcacacatagtaaaaagacactccaatgaaaatagagattaaaacatattataaaataataaacatcaaaactgtgtgatactgcttcaaaagtgaaaacatggagtactggaacaacaggagggccaagaaatagatataatgctgtatgtgttttcattttaggtaaagcaagtttcttcaaaagggaggtgggtataagcagggaaaggttataataaatggcataccaatatgaggaagaaaaaagttggagctacactttataaaccaatgaacccaggtgtattaaacaaatatttcaaaaaaatcctgaaaaataaaataattaatcacaaggaaaataaaaacaaatgttgactagttctgtggcagagtttaaaattaccaaagaaaacacaaagaacaacagattaaagcacatgaaaagttcattttaaaagtaacaaaattacatttaaatagaaaatactacaagagtgacacaataactaaatcaaatatgagaaagcacttacaaggagttatgttatatggtgtgtacactcaatcaggggaaaacacatgttttacttcccacgattctgggaggcaatagtgaccttgttctactcatgtattaataatgattttgaaaaccagtacaagcctcttgtaaaaatcctgtaacaataaacaaagtgattataacaaggttacttccttctgacctaactgaaggagatgcagccagtacatggatctctactgtgtacgttcctctctccctgggaaaagaggacagtccgtcatcataactctgtaccagcctgtaccagcctctgctgcctggaggaatagcagcaggacctctatctgaggttcccacagagaacagacagttgatgtgactacagtctagactccatacaggattcactgaaggggttgtcagtgaatcgtgttttaactgtgtatcttcccattactcctgctgtcagcactagagcctgtgagttcccaagcagggactgccactgaagagccctacatggtgacctctcatctgccaaccaattatggtcacttcctgggctaaaggcagagacagcctcccaccatgactaatactgctgcctggaaataacctgcccctccattctacattgctagagcccttgtcccactgcaaaaaagcaggaaatgctgcatttgtaataatcactgagggatcactgagtgctcactgctttgggttggtcatctacaattgctgacctttgatcttcctggccagctccagggtactcagatatttcccctgctcaacttacctttataaaattgaaaaaacagatggagagatgaatgggtgggtggatggatgtggatgggtacccaggttggcgctccatcgcagctgatgttagagcgtctttgacggacattatgcacctcctccaaaagcataatgtccctggtccatgctatgtttccttcatttctgaggtaccttcctgcaattgacttctgcttacaaacttggctaaccctgaataaactacatgctttccagcccccatctctccaattcctatgtcacaacagactcaattatacagtgtgcaaccattaaaaactgtaattataaagactacgtataacatacaaaaaggggcttaaacatgccaatgtctttctttccctcattcttacatagttcagcccaaaaactattacgcaggcaaaagcaaagtaggcatcagcatgagagtggaggcaaatggcatgggctgagaaaagtttctgcactgtggaagggtgagggccatgacagccaagcatagccatgcttgtggtctgagcaagaagaggagggtcccagtgtgaggagggggcaggaataacagtatatgggttacataatggaagccaggttcatcactgtcagaaaaaggagctaggaataagtgagaaaactacaattaaccctatggtattgggttgggattagaagtattagtgtattggtataaactccttgttagcaatataggtactgaaatacagatatttcacaataccaatataaacagatatagaagtacagttgtaaaggttgtacacaaacacacacacgttttcctagctctgttcacagaaagcatatggaagcagtgacactccagtagcaatgaacacacctggttgctaaataccattctgtactaaaaggaaccatggctccttggagaattggttagtttgaggaaagcacaagatgagtctggaatatcttgtgtcagaaagtaacgaagtgtttacagaacagtgaggacaggacacgaaagccagcttgaagaaactcacagtggccaaaatataggacaatttgatattgaaataaataatgataaaaaacagaccaaaacctagtaaataaaatcgcaagctgtgtgaccctttaaatagataaatgacaagaagagaaagttcttacaatgaaaatccaattaataagtgtagaaataatgatgcattcttttttaatcaccatttggcaaccatcataataataattaattcagccaaaaagaaaaaagaatggattcctaaaaccagtgggtgaaagtggtaatattccataatggaatggaaaatttacaatatcaaagtaccttcaatctcatagtactttcccacatacttactaataacaaagaagaaaagagtaactccccagtggggaggcctggcagctgcaccttagttggatgatcaaagtgaacatcatcagtcacgggacaaatggaaatcgtgtaatgagatatgagaaaaacagcatcatttctctgatattcttgccaaaaatgcatattagtctaatcataagggaacatagtcaactctcacacttctataaagaatacctgagactatgtaatttatggagaaaagaggtttaattgactcccacttccacaggcttaccaggcagcatgactgagaggcctcaggaaacttacagtcacggcagaaggcaaagaggaagcaaggcatgtcttctcatggagacaggagagggggcaggagggaaatgccacacacttttaaatcatcagctctcacaagaactcactcactatcacgagaacagcaagggggaaatccacccacatgatccaatcacctcccaccaggtccctcctccaatattgggaattacaattcaacatgagatttgggtggggacacagagccaaaacatatcaacagatgaatcctacatttatgtagagggacattctacaacatatctgacctactattttcaaaactgccaaagtcagaaaagtctctctttgggtggggacacagagccaaaccatatcaacaggtgaatcctacacttatgtagagggacattctacaacatatctgacctactgttttcaaaactgccaaagtcataaaagtctaggaaaggccaaggaaaagttccagtctgaaaaagaagagagagaggtaacaaccaaatgccatacaggaaatagaactaaatatgggacccacaaagaacactgctgggacaaatggcaagacttgaacgaggtctgaggatccgatggtagaaatgtatcagtgttagtgtcctaatgtagatgtcagtgtttaaaggaaatacacaatgaagtattcaaggacggcagggcactatttactttccaataattttgaaatttaaaagttcttggtactattcttgcaacttgtctatgatattgaagttatttcaaaacaaaaaatagacatgataccaaatcctctatgtatgttacaattatatctattaagatgaatataaataatagaaataaaattattaaaagaaaccattgtgttaaggttttgcatttgaggggtactttttaaattaaaaaattcctttaacatctcatctccataacaacaacttttaagataattctatatatgttcatatttaattaaacaagacaatgggtattataaaataagccctccagccaaacagaagagaaacagcctattgaagcaaacagtctcaccctttttatacctaatcaataattaattctaagatgcacatgttcccccattgcctagccaacttgttttctcaaacaatatatacaaagacctgtgaaaattaaaaccagataccttgatttagatgtgtggcctccacgatctgaacaccattcacagagcactgggacccactcaggggtatcagagtcactgtccccccgatattttcaaagatgcaatgctcactctccaagtcaaggccatgaagaactaaagtggaaaaacaaagtagaaagaatttttcccccttttctactgcaatgattcccagctatttatctataaatttatttattttccttttgaatactcttccttttccacataagtatcatgaagtgaacatttatgtttagtgagaaaaccgaacttcaggagctcatgacgttcaatgataggactggaagatccttagaatgttcttcaagggatctggacattacctgtgtaagaaaatcagttctgggatgttaactcatttcatctttggggagaaaacagtcgagtaacttgttttaactgaataccatggagttgccctgtttgatactgaataaatttcctccatcagccacccagaggccacagagaataaaagcaaaagtgctccatgggtcgaggacttactgagacctctgcactgacagacactgcactccaggagcagaaacccaaggtgaacttggcatgacatgaatcttgaaaagcccaagaggccttcagaagccatactgagatgcctgttgcctgagcctgtgtcaattctgagacctctcagggcatgcagctgctaaagtttatctattcatgtataactctcctagattcttgtttgaagaatggtcaaacacagatatgaacacctgtcaaataagcctacatgattttaggcacagttcttggctagcgtcttgggagtacaagccaactagtttccactgtctctacaaaattgcactactgatctctgatcacagaaaacgtgtgttcttaccatcatttatagctaccccaaagatcaaacacataatttaacaattagaagaagaggcctgatgcctacttctacccaaacataggtgaatctggggacttctagaaaatggtttttatctctctcagtctcacaataaatagtaaatattaggttggtgcaaaagtaactgtggtttttgccattactgttgcaccaacctaatacatgtaggaacatactaggattggctccattaatagcttacacttggcaagcaggttcattgccagcaattctaaaagcagctgagacaatataattcttcccctgccaatccctatcttgccacacacatatacacacccaccaccaccaccaccagttgcctaagttatgctcttaaagcctgtaaggacctcatctgtgtaggctaagtcactgattatttgcgtgtcttgtgaagactttcaggaaacctaaaaagccatgcttccacatgtgtgtatgctgtgttttctcctactttctgttgtcatctttgtgaagacagtgcctacaaccctctccttcaaaagacctacatcttttatctgtgtctgttggtatatttccatcaatcattgttccattgtgagacaatgtagagtgatttaagtaactgtgttcctcaaagacctgacaaggaatggaatgtagggtgggagaaagggtttattggcccactttattcaccaaattagttgttctgcattattcatttgagttgtattctaaattacaaaaatatatatacacacatatatatacgtacatactgaccaacactgtacttgaaaaataatttaattttctataattacttcaatgtcagtcattcgaaaaagttcttccttgaatacaaccttaaaaaatcattgggaacagatcactgataaatatgctcaccaatatcttgctccgtggaagcatcgtctctaccaacgtatgtctgaccttcctgggaagaaaacccaagcaaaatgtattagtaagaagagaaggaatagcttgtttcttcatttttcattgaagcccaaacaacatagtggccaatgggatgaacaacatcctggcaggccacagcttcaatgcatcgagagctccccaaggctctgtaaaaaagccccagttgtctggaaaggtttaatgtacagcaatggtgaggccctgctttgacagcgttaaatactttgctcatgacaggaatatcactgatgttcctgatcctttctggggaggttctccagtggccaagagattctttgtgtctaaagatatagtttatgtaagtctgcaaaacacaaatgcagtagcattctcattgttaagttatgggtcagagagagggcactaaagtcaaggttacaggggcatccattaatactgatgtggaattctgtactcccaagatgaactgtctgcttggaaccaagcccaataatgcaggtgagaagcacaattttataattgccaccagggaccaggaaactgtacatacaacaaaatccccccagctgtttacaacttttctccttcagtctgtgtgcctttttgttccttacctccctcttactaatcctacagaatagagggcaaatcaatggctcatcatttaactttagataacaagggaactttaaataccaaagaatcccaatgagcttctgaaaattcccaaagggctcaaggatttgttgtatattctttaatttaatttagttgtgttcatgaccatagaatattataataaacctagttagtgtctaatggagaaactggaaacaaaattagaatgttccacttaatcagtttctacctttaaatgatataagatgattccagtactcaaaaggtcatcatcgatgccaatcaaatgaggcagttcagaatccaaaacaactccaatcccttctttcctgagggctagagtttgttcctgaaattaagaggaaaagaaaaagaaaaggttactttgggaaaagagaacttcaaattaggtgttcttcagattgtcagaatgggcaatattttatttctcatctaaaaaactgcaagaaaaatggaccttaaacttcgtgttgaaatcctggcaggtaataagcaaagtgaacttggaacttataaaaagcgaaatataaaacgaattaaactcattgcctgatacataacctcttcaaagcaaatcttccttcagaaaggttctaggaacatccaaactacaaagtaaactttctcactcttcagagcctttatgccatttaatatcaagatgttgccttagttgatggcttttctctctacttaccatggttgaactgtgcatggtcctgagaagaagccttcctgtgcattacttaccttgcaccagaggaacctggtcctctgcctcctgtgccatcaacttctcctatccactggatcattccctgctatacattaatatgaatctgctattcacctcccatccccaaaccccaccacgtcttttggccttgcctctccttatagctaccaccaatttctctgtgccttttagagaaaactacctccaaaaagttccctatactttcagttcttcaattccttccctcttactctctcttgaactccctctatgaaggttattgtctttgggactcttctttaccgacactgactctcctgatggtctccttctgtctcttgacttgacctgccatctagatgctgatgactctcaaattgcatctccagggcagatgtctcccttaagtcccatactcaaatgtataccgcatatatgagtatactgtgtgtgtgtatgtatatatatatatatatgtacaccaacccaactcagtttagctatggagatgtcaaacaggcagcacaaatttaacacattaaaaaaaacaaaaaacaaaaaacaaaacaaacaaaaaaaaccttgattctctctgcctcccaaacctgcagactatcccatctcagtaaataccaacctttcctgtttggtctaaataccatgcttacactttgcccctttctttctctaaactctacatatgtagtattaactctaccttcaaaatatgcccagaatctggtaacatcaagccacccgcagcacgtgcctctggcccaaaccatcattgtctttcacctgggttactgtgataatctgggccaccactcatgtctcccgtgatatacactcaattcagcagccagaaggccatcagggcaggtcactcttctgctcaggtcctttaaatagcctcccatttcagtgagacaaaagccaaagtctttgtgatgttctaccaaattctacctgatctcatcccatgctcactcactctcatcttctgccgctctcccctttgctcactcctctccagggatagaggcaacttgctgctcttcaaacttgccagcctgccccatctcagggatgcactcactgcggttcctactgcttttgtggttgctgtttcctctgtcactgctatccttctcttcccctacagtagggtttctggactgcggcacagttgtcacttcagaccaggtaattctttattcttatgcacagtaggatattttgtagcaccccttgcctctacccaatagatgctagcaacacatctgaggttctgacaaccaaaaatgtctccagacatttgagaaacattgccctagacacatatataacatggccccttccttccttcaggtctctgctcaaaagccactctccccatcaccccatacaaaatagcaaccaccaatgttcctcatggtgatttctctccttgggaatggctattagtgtgtatatatatatatacatatatatatatactatccatttatatgtatacgtatacacacacacacacacacacacacacgcacaagtttattacctgtcctctggctagaatgtaacccagcacctaatttcatgtcccactcatcaattaatatttgccagaggaatgaatgagtgagtagacacacagagttcagtggaatgcagagggaaggtcagagacaaccctccggaagagaatggtaggccttatcttgacatcaggcccatctgaccccagacaaaagacctctaaagtcaagcttctggggaagtctgaagtagaaagcagacaaattccagaaggttgaaggtaaaaattgcagtcttgaggttgggctgaaccaggttcagactaaatcatgtacaagagcatgacattgtgctccatgactgtacgagcaacagaaaacccagttccaaccactaactggggatcctggtcagagatgctcctggagaatctccttccctccctgactcctatagtcaagacgcagtgaccaagacacacctctgtaactccaacacccaacacagccctaaacataaatacgattccttacaatcctggaaccaataaatgtactctgtgtcatttaagtattaaaacaacctacgaagtctaccattcgctaggtgatggattcagaacttctcaagctagtgtaagaccattaaagcaaaactcaaaccctgtagacaagggaactcctgggaggtttctggggcagggaggtggagagagagaagtccctcaggcctctgcagatatttacatttcaaatgcacactgaagacctgaagtcatgcgagagggcggtgaaatgaagtaacaacaacaacaaaaaaaggatggcttaaaaaaataaaaataaaaatcacaatgtgaaagaaagcaatttaatttaacaaccattaaatagatacgcagagaaaatgaccaatgcataacttagtttcaagaaaaggaaatgaagcgtgtcattgttcttcaattaccactcttatcagccaacctcccattccatggctcagaacctcaggctttgaggtcggagacttcagtaacattgatttactatagcaaggaatatgcaaatctcagctaaactgagcactctccataagctaacccctactcctacctctcggatattagcagaattcatgttttttcctcctgaccatgaaattaaagcagaaatgggatgtgatttttttaaagacatatattacaggggagaatttaatcacacagctctatttcataaaatgatgtcctcatgggaaggtttggtagctctgaactgtgaccaaactgcacacacagtcagtagccccatggcaatgaattattacaggcctctaggtccacatgaaaaggaaagtgaccattctcgtaagtccacaggcatgtgtattttctttctgtacagaagtagacaataaccccccacccccaaaaatgcaatattttaaactttaatagctcccactcaaactacagaaagtgctttggactacatcccagtttcgtttactattctttctttttttaaccattgagaaacacttttgtttttccttgaaataagattttgaaaggcattggaaattcatagtttcaaagccattaggtcaaaagtcttacttgttcccacccatccccagcatgtagacacacacacacacacacagagacacacacactcacacacacacacactcacatacacttccatatatataatgggtaaaatctgaattaagagaaagttttccaggattgcaagtggggaaggatgaatttatgattaatgctgccctaaagctctatgacattcaagctgcattcaactacatgatattataaaagtgtcacctcataaaactggaaacgagggtttaaatcattgctcaagcgaaaaagtaatttcagacaaaaatatctatcacgtataaaatatttattgagtggcatctactgttatacataatttatgaaatacctcttggataagatggaatacttaacatagtagagtgggccaccctcccccaactccagacacagggtcccaaagaaatcaatgtaaaatatgtatacttgcatatattttacattgaaacaaagattttggcaaccatgcttatttggattaaaaaaaaaccccacaaactgactaaaattgtcaaaacgtagcatcagtttattttaagcatcctgttcacaacatttacaaatgatatgctccatatgtttttcttcaacctccaggcatctattcaggtgaaatccatctgaatttaaaacacatgccctttgctgggactctcacagactcacttctgccccttccggtggctctggtgattgcaggcagggctgcccagatctcgtgggaagaagaccacaggaggactcggctcaatgcgcaaggcccgtgtaaccaccgtaatggtttatgagagtaagcagggagtctagctcttttaatcacaaccacatccttagtgcccagcactctgccttacaaaagtcaacaactttcttgaatagataaccgaaaatgatacaaaaacttaccaacaacaaaaatctattttttccccctcttagaaagtctacctgggatctagattgtacttggaaaaaactgggaaaagtttgacagtgtgtctgccccacgtaaattaagatctctttaggaataagaattgcgtgtcttcacagagtatgttaggtgaatatagctgcaccaggcacacagtagtcactcagtaagtgctgattatttggttctatagggagtgatttctaagtggcactttttttttctgaacagacaagaatgaaatgtcaggatctttttgtgaaaatttatgttacagagaattatatatttcactagcgagtagaattttgtagagttgactcacatcataaagtgcacataatttctgcaaccctgactacaaacacagcagatgtctgggggctgggggttggggacaatcagggcttagagcacatgcccagtgtggctgtgaggatgggggaggaagtcagatagccagaaagacgttgaaaaaaaataaaattatcctctagtaaaactactttttaacttaaaaaagttgtatgtgattttatttaaatttaacagaatgaaactatttcaaccatgtttctttattattaatataagaggtatttcctaaaatatccttgtaagtcaagaggttatgaaacataatcacagtgcatatacatttttcataagtgtttcagttttaagcaccattacctgaatctgtaccggtttgagaacgttgcttcttgccttggcatctgaatgacatcatagctgtgtcgattttgggccacatggtgcatgttgggcagtatggtacttactttcctcagaaggttaaagacatggctccactcttttcaaagctgaatgctactctaagaaaattaagctagtctgacttttagtccacagcagataatttggttttatgtctggatgtttaaagagtttcttctttatcttgaaattcaatggcttaattaggatagatctcagtgttgaacatcctctactctatattttcctggaacacaatacattcttctgatctgcagactcagttctttcatctacttatttttcatttcacaaagcttgtcttgttttattttccattttctatttcatttgttgaccgtctacttcaagaacaccaattgtccttatattacactggtctttgtcttctatttctttcagtttctgattgctttactatcttgatcattccatttgtgttcaatgggcctaacaagcctttattctcttagtaatttgattttcagtggggtctattcttttccttgatattttctaaaattatgtattagtcctgcaatgatgttgttttgggcctcaaaggctttctttattctacaatctttcttttttcatctcactttgctttttattaccatcttgctttgtttattgaattcatgtttctcattcatttgttctaccgaatgaaacaattgtaaggaattcccttctctcccatgaagtgtgatttcatctatattgggatcttttatcttttgcgtgctatattcctcttctttcttgttctctaccagcccatctgcccatctatgcagccacccatagctatagttatgtttatataattgttctacatttttttcatctcgtatatgcttaggcgtatctgtgcaaatattccatgtgccctaacataggatgggaaactccttgatgcttgcctggccatatctgtgacgtttctagttgactgagtagtctgcagtccacccacttttctctagccagatggaatgacagagggctaggaggtctcacctgaggcaccacaggctttgtttgaggcccagccctctcttcctgggctccctaatgattgggaaggggtcctcttcccagggggagggaaggggcaggatgccctcgagcttcttaatgtttccccaggccttcacttacaagagagagtcagctcagctctcacttcattccagttaccaccactggccatcactactactcttcagtaacaataggaaaatcaattctgttcctccaatttgaaggtacagtggggggtattctggaatcatcactgattcagcttctcaggtgcaggtttaggaatatccccttcacaatctttccttttccccagcagccactcatgatcttttctcacatgcttctcttagtgacttacagcagtattgctgctgcaggcttgtatgtttgctatgctttctattatttcttcatttatttgaaatctgtgatggaatcaccaactggttttttaacattgaagacaagaatagcattaaaaggctacaaaaaggaaggatgaaaacagcggtactccaggttttaggggatttcttgagcaaagatacaaaggctaaaaacatgggcaaacagtcatcccttgatatccatggaggactggttcccggactcctgaggataccaaatccaagaatgctcaagtctctcacgtaaaatggcgtagtacttgcatataacctatgcatatgcttctgcatactttaaatcatctttagattacttatcataccaaatacaatgtaagtgtgatgtaaatagttattatactgtattgttcagggaataatgacaagaaaaaagtctgcacatgttcagtacaggcagaaccatcataggtctaacatatcatacatatcagcaatagtacagcattttctcaatttttttctaatattttcaatctatggttggtaaaatccatggatgcagaacctgcacatatggaggaccaactgcatacacaaggaaccactggacatccagtttagctggtaaacctggaaaaatggtctggcaagcgaagcagatgggtcactatttgattcagagactgggaaggcattgacaattttgaaaacagaaattggttgctacttcatcagatgaatctggcaggatgtatagggtgaataagaacagagtaaaaagggggatgggattagaatggaagtgacaccccttgagagtcacgggacaggtatgtggattctatgtgactaacagtttcggttgatggacattaagtaaagacattctcctcaagtgttttactcctcttaatgagaaatacggaaattggagaactgcaagaaaatctgatagatgccaaaagatttttattgctaggcaaaaaatatacttatgtttccttgtaatactttccagggaactcagtaaggaggtattattcatgtgtgaagaatcactcatgaatttgacgagcaagtggtgtctagtaacttacatgtttttaataatgtacaaatgctaaaagtcgttatcagctgggcgtggtggctcatgcctgtaatcccagtactttgggaggctgagatgggcggatcacttgaggtcaggagttcaaggctagcctggaaaacagggtgaaaccccatctctactaaaaataaaaaaaaataataaaaaaaaaaaaacaggtgtggtggcgtgcacctgtagtcctagctacttgagaggctgaggcaggagaatcgcttgaacctgggaggaggacgttgcagtgagccaagattgtgccactgcattccagcctgggtgacaaagcaagactccgtctcaaaaaaaaagaaaaagtcattatcaacaaaaaccaattagctctgaaaccctgaaagtaagcaacaagctggcgttcatccagaagctactgtttctcatacagtaggcccccctgtatctgaagttttgctttccccggtttcagttacccaatgtcaactgtggtccaaaaataggtgactacagtgcagtaagctattttgagagagactattaatacaacttttattacagtataatgttatcattgctctattattagttattgttcatctcttactgtgtctaatttataaattaaaatttagcataggtatatacatatagggaaaaacagtgtatatagggttcatattgtttgcaatttcaggcaaccactggagggcttagagtatctcctctgcagacaagcgggggcctattgtattctattttccacataggaagaatcatgtccatctaacaaaggagaaacagtcaccaagattactaggaagtcagtgaagctctgtcaactgcctcaaccaccatcctgcctttctcctcctttggtccataaaacccaagcaagctatgatgaaaagatgttaagaatctccttcattctcctccaggaaatgacttttttatttttgctctgttcccagagagtgacgacgtgaataaaaacaatactggtaggccagtaacatgttctacatccctgcaaagttgattagtaatatgtaatccttcaggtaagggctctattaattatgttctatgaatcacaatcagatttaaaaacaaacaaaaataaaacaaaacaaaaacaaaaaagagaagggaaggagcggtctgtgaacgttaacaaatggaaatccactggggatcagcctctgtcagaactaagctccaggaaggaggaggttcaggtgggaaggcagagttcacaatccacagcttgggaaaaagaatcaagtgggtcagcctagaaatcacctttgaatcctctctgtgcttcagacttcacagagctctacccgcatgatatggtcagaatcatccacaactttccatctccactgctactgccctggtcccagtaaccttcacagcctgcctgaatctctgatatcccccaatcggtctttttgcttctcttgccaccctaccatctactctccatatggcagccagagccaccttttcaaaatatcaagagaccatgcataaaacactacaatggtttcccacacgtttggaataaaatggtcaccatatctcacttaatcttgcccctgcccacctctccaacctcatctccccttcactttctacctgacaatcacagcggcctcctcattcccactgcagggcttctccgtgtgctgtttagtctgcctggaaaattctcccctaaatctccatagcttgccctttcttgtcagtctgttctattcgggaccaaagacaccaatgagtgagattgtattagtccatttttgcactgctgacaaagacatgcccaagactgggaagaaagaggtttgaatggacttatggttccacgtggctggggagccgtcacaatcatggaggaaggcaaggaggagcaagtcacatcttacatggatggcagcagacaaagggagagcttgtgcagggaaactccacctcacaataccatcagatctcttgagacttattcgctatcatgagaacagcacaggaaagacctgcccccgtgattcaattacctcccaccaagtccctcccacaacatgtgggaattcaagatgagatttgggtggagacacagtcaaaccacatcagagatgaacaaggtccctgctcagacaaagcttatttcctatgcaagtaactccacccctactcccagacacactctatcactccacctggcttactgtctttacagcacttaaagtgatcaaaatttctcatacattagtttatttgctgtctgtccctgcagaaagcaaagaataggtccaagccaagatgtcaatcccagagaaggagaggtcaggatggggtcagtgagagccaaactattaaaaacaatacccaaggccaagaccgtctcttatcagtcccgtttttaatgctccttgccagtcaaaagcagcccttaaaactcaaaacaatagttaatatggccagaataagccagaagtgaatacaggaattttaatatttagttctaataaactatcatcataaataatttaataactgtccccaaaatctgtatctagcatcacatcagacaggcacctatgatgtcactgaaaatgaactaaaaatataaaagccttgctttttccatgactttaaaacaatccatattacaatacctatggttaaaacacacaagcgcgcgcacacacacacacacacacacacacacacacacacacacacacacacacacaggtacacatttagaaccaatgaggaagagccacaggactcaccagggcagaattaggagaagaagggtctggctaccaccacaccatggcaccaacaaacctaaatgtcctgacattactggcagtcagcccctaaacagtaaatacaattaatactgcccttttaatgaacagaaactcttggggcagttcaatttccactacacttcccattgcagaaacatcgatctttatttaaatgccaaacagctaagtgttggcacacagttcagagaagatgctgtgtggatcttttggatgaaacagtcctctccgctggctgagcaaatcatcgagatgtcaggatttaaattatgcaaaatgcataataccaattaaagaaattacgtgtgaaaatatgcaagagcaaatttcctcacattaatatttaactagactttttaagtagagcagcatcttctgatcacaagtactttagtatatttcacctacatggaagaccaaaatattcaggatggttcatcagaagattctaaaagggcattttctgtataatacaaacattaacacgaggtaaaacagctaacggaaaggattactttaagtgggatgttgtggcccagaaagcatcagtctgacattggccttacactttggtcttgtaaagctggcccgttcttgtttctcacccacggaaatacgtcatgctcatcttcaccctccggcctgtgctctagtaataatgtcctactaggacaaccctctgattcccagttacaaatgtttccccttccccaggagtcagttagagcctactcaggactactgtggccccttcctctgcactgaccagttatcaggcctaatcgcatggatctccgtcaaacacagatcagtgactttacattcatgcactgcttgtttctcccgctagaccaagaagctttcaaaaaattggtattttttgaaatgtcaaaatatcaaaaaaatatcaggcttgtgcccacaccagatcctctgaatgagcatctcaggagcaggatccaggcatttttttaagctctcaggaattttacatccagggttgggctatgattttctgtatcctccaaatgacacctctatcctgctgggtgcactttgagaatgctcaaaagggcaagtactgtgacctaactccttcatttgccagctaccttcttctgtgattcattcaaccaacacctaacgaccatctgctacttgtcaggtgctagtctacattagggatatatcagtgagtaaagcaggcaccctcttatattttatctatatctgtctctgtctttagatctaagtctatatctgtattatatggaaagatctatctatattacattaaaaaatctacagatatacagtcctgcatcacttaacaacggggatgcattctgagaaatacatcactgggtaatttcatcactgtgccaacatctaaagtgaactcagacaaattgacatgtggttaccagaagctggagtggttgtaggagagggttggggaaatgttggtgaaagaatgcatatttacagtgatacagaaggaacaagttcaagggatctactgtacagcatggtgactatacttaatgatgatatattgtattcttgaaaaatgctgagagagtggatgctaggtgttctcaccacaaaatgataaccatgtgagataatgcatttgttaattggctagatttaaccatttcacaatgtgtgtgtgtgtgtatatatatatatatatataaaataggtgcctatctaatgcgatgctcagtgtatatatatacatacatattatatatatatacatgatgaatatatacaattttccacatcaattttaaaaataaataaatttgataaatcacaccttgaaaaaaaattctatgacggaacttgtaatggtgtcttggcatgattctgtgatgataaatatatctggattcctagcttttttaattacacagaaaataaaatattaaagccaaaatcctctggtttatctcttttgcaagctactctgcaccattctttcacataaaattggagtagggtgggaggagaaccaccagcagcggcaaaatgaggtcttctctaacaggtgagatgttagaggttaatccctaagcttggtgcacagcctttgtttatttcttagccagttgaggagccagtatcattatcagaagggaatttaggaaaaagcaagaaggtgatgaagaatgagagggaggaagaaaagaaggaaaaggaacaaacttccagcttctcacaattcccttctgaaagacgtacactgcccatggcaaggcacgctggtgagtaggtaaagaccatcccctaatgagtaggctccttgcttctcctaggatatgggttaagtaaccccaatctgaaaatccaaaatccaaaatgctacaacatcccaaatgttttgagtgccaatgtgatgatcaatggaaatgttcactagagcatgttggatttcagatttccagattagagatgctcaaccagaaataaaacctgctttttatggagaagagagaatataacccccttccaccttgtattaatcaaatattcactccaatcactaaacccaaatttgtctaataaatcaaactgttcaaactactgcttatgccatgagtaatgacaatatgtcaaagaaaacactggtacagaagggagtttcttccctggctgtgcagtaaacttggtgaaaaggagggaaaccacaacccagacacaggacaggtgactgaataaattgtcctctatgaacccaaagagttaatattttgtaaaaccatctgccactcaagtcctgtctcatcccgtccctttgagagttcacaccatttatatcgtaacagaacactttacatgaacgccagctccaaaggggtccccaaacctctaatcaatttggcctggatataaatgtgtatcttggttgtataaatactactatgggcaacaatactttacacaagtattcctgtaattgatacactgcactttgacattattaacatatctttagctagataaattacccagtaaatcaaaagggctcattcactcagattatgcaggagaggactgctccaaagcccaaatataattttgaatgttgactgcatatggccccaatagtttattaaaataaggaatataatccattttataaagagaaattacattagaaagacttttataagtaaagcatatgtggctaaggttatagaacttgtcaaggaaatgtgaagttcaagatacaaaataaattgtgtttgctgatctggtccattaatagaaaagcagtaaaccaaatacaatgtaacgtacacatgcaacactttccaatcacacacatcaattaggtttgctaatatgtgcagtgcaagccagctatctaaacatctaacttctcacaactacagtcaggagtcaaaaggaaacaaactctttcctaagccattacaaacttcaactataaaatctcacatctttcattagttaaaaaactatttacatgttgtaaactggatacaatcactttggaaaactatttggcagtgtcttctacagtgaaataatatccacatcacatgacccagcagttccacccctaggccctatggtagaagtcagccaactatggctgaaggccaaataaggctgtctgcctgtttttgtatggctggaatgctaagagtgatttttatattttcagatggtccaaaaaaaaaaatcaaaagaagaatattacttcatgatgtgtaaagtgtataaaattccaatttcaatgcccataaagctttattggaatacatgttccatgttcattcatttacaaattgcctgctgctttttgctatcatggtgtagtaccgtggagtacttgcgacacaggtggcgcgggccaagaagaaggaactgattactacctagcctttcggagcagcagtttgctgacctctgcattatgcatacatgttcactgaaagacatgctaaaaaatgttcatagttttacacagttacataaaattccatttttttgtatctactttaatgtatgtaacctgtccactgttcgtgggcatttaaattgctctcagaacctttgcattcattagttattgccaacaatgctgagatgaaaaacgctgcacataccttgaacctttcagtgctagctgagagaaagcacagacattcatgattgattctcatttacatgtcagaaacaacaaaaaaaccttccttgaagcttctattctaaataaactaagttctttactgaactcaactgagggcaaaagcctcctctgtttccagcgtctcagcatagtgttagttatcacacatgcatttactatagattgtgaacggaaaaagggaaatacgaatatattagcaggccaggcatggtggcatgcacctatagtcctagctactcagcaggctgtggcaggaagatcatcagcctaagagttccaggctgcagtgagctatgattgcaccactgcacaccagcctgggtgacagcgagactctgtctctaaaggaaagaaggaaaagaaaaaaaaagaatacatgagcacatatatttatttgtttttattgccatttttccccaaagaaatctataataaatgcacacatgataactaacattctgtactcctggaccctgggagcaggaaatctttggcctcagaaatatatatacatctatatttattcattcttatttattcatttgtattcagacatgtatatacgtgtgtgtgtgtgtgtgtgtgtgtgttttaatctaaagtcattctaagcagggactttatgaaactaattttatttttaagtgagcaatttgagtaacaaaaaaaaaaaaatcacaaatggcctagaattctaagtgctctcaaatggcataatcaggagcagccttgatgacctttttctgaaaatgtggacttaaatgtccgaatcaggtttttgtccaggtcagcacttttagcagggaaaggcatgtcagggccatttttacagaaccaacgaggtgcttacacggtgacactaagtccagagcagtgtgactcaggacagtgtgcaaagtgcttgctgccattccagagtaagtgccaaaattaaaggcaaccattgagaaacttcagtgcaatttgacagagtaattttataaacattgcatctaataaaatactggggcttccattttttgtgtctctctttttttctactttattatgttagtagttcctttttattgtgctttacagaaaagttagtgtgtgatggattaaaatatgaaaaaataaaaccctgtatttggtcatagacagtgtagacaacctcctcttcctgttgaattcctccagaatggacagcctatgagagtgcagaagcctgctgttgctgcctttatttcttcaatgtcccataaaaagtgtaagagccagaaaaaaggaagttgtcacctttaataaaaacaaaatttacccttgtgtaccacttaaaccatgagaaaacaatcaagaaagctaaaagttcacttcattgctaaaaggtgaattcaaaagtttagaataaactataaaggcagttccactgtggtcttaatgagaacaatgccaagcattagcttattccaactttggcagacctgtggtcattatcaaaacaccagatcggggttagtttttactttaattaatctaatgaaccggctgtctggcttcagtagacattttttaaatgtcactgcgtaccttgaggctgcagctgaactggtggcatgttcccctgcaccatcttgattccattaactcttgcctacagtgacattttaagtctgcatccttacatgccttgataatgtagtaaatttgtgctttattaacccaattaaaatacagaaatgttaggtaacggaaatcaacaaaattaaaacaattccttaaaacagactagatctttaattcaaaaatatatatatgaaactacagcttccagactttggtaacctaaaaagtccctggattctaatgttaaattctaaacagggaaaatgctgatctaatcataagagaatatactatttaaatcctaggtattgtgttaatttaggcttaaacatcagtaggcacgctaggtcgaattgtgaatttctgaagactttgcagagtaaacaataaatgctcctacacaaaacttgcaggcaaatttgaaaaaatacttggactcacaataatctatcctgcactagaataaattcacccatattcaccaactctactcccacattttcagaacaaggaccctgtcttttctaactttttcttcccagtgctgagcacagggcaggcactcaaatataaaatgactgctcccttggaaactaagtgagcattttgtaaattgtttaaatgacaggccacacttgcaaataggaaatgagaaaagagtttaatacatctcttcaggggcttatctgattcaccttagatgtgggccacgtagaacatctgcactttaagttcctcttgttctaaaaagatctactatggcctaaaaactctactcttaagttagccaaggaactagacaattgcagctaagtaataaatcagactcattctgatgttaaaaaaaaaaaagttccttttttttaatcactttcttgaactaagatcacagatctgccacctgccttcaactctgcagatcgtggggcgtggggtaaaggggtcctagaggatgacctgcaacgtcactaggaaaagaaaaggtgtgacagaaacttatactggaaaagtccaataaaaatgcctattgcggctgggtgcagtggctcacacctgtaatcccaacattttggaggcctgaggcaggaggataatttgaggccaggaatttgagagcagcctgagcaacaaagtaagatcctgtctctattaaaaaaaaattaattgaaaaaaaatgtctaccccaagctctaataaaaactctggcttaagatggcaactgctaaagccataagcagctgtttcatcctcatctatttctgttttagatgaaatgtaaactaaattcaatatttctaacaaactagaaatattggttatatgggccataccctgaggagttttatcgataaaaccattgacaagccaggcatggtggtaggcacctgttgtcacagctactcaggaggctgaggtgagaggatcacttgggcccagaagcttgagtctagcctgggcaacacagcaaacataacaagactctgtctctttaataacaaaacaaaacatggacaggtgtgtgaagtaaaacacaaaaccagcaagcttaagacaggaagatttctatctgtgcttcttcctacctccactgccaattgttggcagaaattcttttctgaagtatcctgggctaggtcatcatcccaacccaaccatccccattgatattgctctttctccaccagttctcactcagtcatcatcacagccatctccacagggtggaggaacaggccattgcacactgtgtcttggcacatggtggaggtaacgggaaggggcggaaagaaagctgtgcacagtgtcctacaaagaagagagtttttcatgctgtgtttatgctaagataaaaaatgcagatgcttccacgtattatggataaatcctcctttaaataatcccataagatattatgggaataagcctttccttatgagaaagacaagccaaactagacaaatgaagaatctggcaaagtgtagaccacctagcccagtccttcagctcatgacctcacacagatttctaacagtaagaaggtaggcagtgtcagagaacaaagaaaatcctcctgggcctggacaggccactcctcagccaggcaaaagcaaaagcaaacaaccatcaaaagcaaaacaaacaacaagcaacaataataataccaacaaacatcaaccaacatcaatgaccataaacagcaagcaacaaccactggcaaacaatttaagtaagcaacaatagcccacgacaagagccaacaacaacagagctctcctagcaaaaagattttcgaaagcaaaataaagggaacagcatattcaagatagcagaaatgaagtgttttgctctattctgcttacaataagaagctagtccaagaaaacatgaccttaagaaaaacagatagaaatatgacagagagagagagagagagagagagagggaggaaacaattgacatgtgagtggaaactcagaattagattctatattagaaggagaaagaatacaatctacacttcaaataatcaaatgggtaaaatcagaaagcaaacatgaaatgcagtcatagaatgaaagtgtcaagaataaatagatgaaaataatgtaggagaagataacagacacagagaaagaaaaaatggaaattgtcaatgaaacgtaatgggaactgcagaggaaagcgaaagaataaatgagggacaagctacactgaaagagtcaatggaaatgagctgaaaagaggccagcacctgaccaaaaaagggggtctctgaataggaaggcaaaaggacggaaagacctgctgaaaattttaaattttaaaaataaaattgtaaatcctatagtatcaacacaaaaacagagaatgtttacaaaagaaaaaaaatgttacgccaatgaaagaatgtcccttggcaatactgagctccagaacataagaaagtgactttcacagcagtttgaggggaaaagatcaagagcaaaatagttcttcactcacatagttcttcatgtgcaaaagtagcaaaatcaccaaaagaaggtccacaaacttgctctgaaaacaatgactctgagatgataaataacagacaacctaaacaaagaaccaaagaatagaggtgggagatggtctaaaccgagtggaagcaagcattaaaaccagttcaaaataaaggctgatctcaatagttgttggaaataaggttataaaactgaatgcaatgtcaaaataggtaaattaaatacaattatgaataacaggatatagaaccccttatcaaataaacaacagttaaatggatggaaggtgggtgagaaaattactggaaaaatagttgctaagacagagccaccttgacatgacttgcttcaacaaacattcactgagcacctcatgacacatgggtgcaccagggcacatgaaagtgaaccagaaatatagtttttaatgaggataactataagaatgaacagcagaaatactagaagaaaatcgaaagaattaagaggaaaaagaaaagacagatcataaaaatgcttgctttcagaaagcatattatataaattaatatactatggacaggctgggccatggtacaagaatggcaaacatacgcttttcaaaaattataaatgtgatccagcctatttcaatatttccatagattggtaaagtttatgagcatttggtcaaaaatccaattttatagatctattttatagatctttgctaatttagatcacaaagaaaatatatagcaagctagaaaagacacaaatacctatacacacgcctcagtattggtgtttatgcaacttggggctggactcatctcaaaagaaatgaactttacaaataagccccaactctaccatgtaacatcttcactcagagctcaaagagctatcagttgccttcagcttaaagtaccaaaatgccaggtcagcctgagggttggcaaagttctaccgcaaaagctttcccagcatgaagcagacaaaggagtacagaagagccaaggacctgagaaccctgagcacattcacagacagacatgcacacacctccccacctgccccacaggctgttcctccgctccagtcctccacgtcccacgtgccttgttactattctccctgtctgactgtattgtcacgacgtgctgtctccctctctgggctgtgagtttcatgagaaaaggggcagcatctcactggggtttggaaccacagcacctcacagtacctggtgtatggtacactcaacatgcagtgtcaggatgagctgagctttaagcaagaagagatgctcaacagcaagaggaaacaaacagagtcatatttgagatctggattttgatgacaggagttcaaaaccaaagagacttgaatgtgccactctttgaacacagataaacagtaaaatgatgtgagcaggttatagtttactatttttcacccaagactgtcacaatttgttttaagtgacaggtgatgtgagtgtatgaagagagtgccgcgcatcttctgtcatacctgcgcgtttacagacaggtctgggtcagtcaaaatctcagtatcagtgtttcttccacattatatggaaaaataagcttgtcagcacagactctgcaagctgccttccaagctcatatagaatgtacgtctggaaaatacaaatgagaaagactgaaatagagcaagtcgttcagcgtcgcatgtggctaatgtctttagggaaaacatttctataattgtaacttccttatttggccttctgatgggagacatttatagcagcaaatgtacgatgctgctagacttgggagacataaaaacacatttcatagaataatgagagacagaaaaaaaaatggagctcctctagccacttggaaagtttacgaagcatacagaactacacttctcttagtatttaaattttcactaatggtgattcctgataaatcataaatggcccaaaacagcactcctaagtaatttgaagacttctttctttggatcactatgccatttgcattaagttgaaataattactaccatgttaaaaaaaaaaaaaccaccaccaccacaacaacaacaacaaaattactctgcagaagaatgtagtcaagttcatttaagctctaccttgtagacttggaaaacagaagtcaggagagaaagcaacactaaagcaacattaaaccaacttcgtattcatgtcaccctatccagtgctgtcgaagattatatatccaatacacgctaaagattcctggtatttgtagaaatactggggaccaaactttttttttattcaggccttggttttatttactttaatattcagtattttaaagctaagctcatgtttacctattttaaaaggaatatgtagaatctatccagactctagaaaaggtatgggcactgctcacacctgactcttccttcttgtcctaaaaagcatgaaaagcagctggaagagtaactagaacctctttatgtttactcaaataacatgagtaagtgaagggacacccacaacatcagaactgatggcatgggaggggggcaccaggtaagaatgggtgggtctgtaagtagcagacccagaaaccaccagcaaatattcaccaacaggaggagaggggctcaggctcagtaggaactgctctgagaggatctgagaatgaacagggtggagaagggagcagtgagaaaagcagacagaaacgtcatggaaagtgaacaaagagtccagagaaattgcaaattcagcagcaaaagaagctacaggatattgagaaactgagaaggctgccctaagtcttccaacctcacaggaccctcatgctaacagaaaattcagaaaaatacaaataatttgaatatgagcaaaaaagtaagtaaaactgccataacccctataagaaaaaaaaaaaaaactattgtttctcagaagcagaagaaaatgcaccagaaaagtatatccacaaagctagaaagctgcagtgaaacatcctaaaacttcaaagacatgaccggaaacagggatgcagaagaaaatgcatagaactcaggaggccgggagcagtggctcacgcctgtaatcccagcactttaggacgcagaggtgggtggatcacgaggtcaggagatcgagaccatcctggctaacacagtggaaccccgtctctactaaaaatacaaaaaattagctgggcgtggtggtgggtgcctgtagtcccagctactcaggaggctgaggcaggagaatggcatgaacctgggaggcgaagcttgcagtgagccgagatcgcgccactgcactccagcctgggcaacagagtgagactccgtctcaaaaaaaaaaaagaaagaaaaaaagaaaatgcacagaactcaggaaggatgaaaaacgaagaaaaaaaaatagaagaagtgaagaatttcaaaacagtaagtaaagatcaatctgtaaatacacatgtgtggcaaccagatagccatttagaaaaagataaaactgatgccatactttacatatttcacatgggattaactctaaatagaccaagttccaatataaaatatgaaactagcctgggcaacatagtgagaccctatctttaccaaaaaaaaaaaaaaattactcaggtttagtggtatgcacctgtagccccagctacttgggaggctaaggtgggaggataacttgagcctaggagctcaaggctgcagtgagctatgatcataccactgcgctccagcctgagcagcagtgagatcctgtctcaatcaatcaatcaataagataaaatataaactatataaaatgaatgaaaaaattaattgtactagagaaaaaatttctaattataattcaaactccagaagccataaaataaaatactataaatttcactataaaaactaatctgaacatactatatgttttaataaatatacatacacatacatctataaatacaaacttctacatgattcacatccacacacatacaaacaccaaagaagataaaatggatagacaaataaaacactggaaaaaaatatttacaatatatattactgacaaaagatcactacatgaagagccatgaaaattatgggaaaacgcaatgatcaaaaacacaaatggaaaaatgggagatttataggaacatatttcacggaaaaggaaatgtaattaatcggcccttaaataaaaagctgtcttattttcattcattaacattccagaagaggaatacaaatcaaaaccaccatgatccatttctgatctatcagaccagcaaaatttttagtttgataacaccgttgaaaggctgtggaaaagcaaaatggtacaactcttatgaaatggaatttggcaatatctttctaaactaagattactttatccttgatttggcaatctcacatccagaattctagcctgtgaacttgcaggaagaagtacagatgacgtgcacacacacatgcacacacgcattattctcatcccttacgacactgcttatctttcaaataattgaaaacaaaaatgcctaaaacagagaaatcttggggcgatctacaatgtatctacataataatgtaccgtgcacttgtgaaaaaaaggaaaatctctaagaagattggggacatactgctacgtgaatacagtcatgatgtagaacaatgtatagtttcttttttgtagcaagtgtggaggattaaaatatatattcatatttgcttacaaaaagcatattcatattattcatattttccataagaaaaaacaaatatcagtaataattaaaatggctcctactatagcataccagttttaaattttaggatttaaaattttaaattatatatatttatatattaagttttatatataaataaaaatgtatatatggatatatgttaaggtgcgtatataatatatattacttttatgcaattctacagtctaagtcaacatggaaaggtatatacagataaaccttacttttattgttgtccccgtagataaccatggtagtcttaattacatttattacttatttgatttatttgaaagctgttttgaaacagcatcagtaacattgtaactaataataaaattacttaataaagtttaaaatatctttgtagatctttttactcaaatgctgttattaaggaagatttgtcatcagagtcctttcaaatcaagtaagtaaacagaataaactcttttgttaatggacttaggaatcaaggctttcagcgtaaaggaaaacacataaaattatgaaatcgaataaatacaaacactgtatttatgaaataaatatcttagaagcaatagtaccccagcagcaatgagcaccctagttctcagaagtaggaatcagaactctctcaagaaatagctggtctcaactctcagagagaaaagactcaatatgtgcatgggacatcttattctggcagaaagcaagaaagctttcagagatttacaagtttgtatagggacacgggctgaaaacagcccctcaacaaagttgtgagtttgtgcatccaaaaagcagaatgtctgtcgttaactgaaacacaccgaatccaggaaattcatgattctacaacgataatcaaaggagaaaaagccaaagatgagggacataaatcatttgtcttcatttgaaatgactataaaaccaacttgtttttttaaaatatatttataacaaaaacaagagagacagggtcttgctatgttgctcaggctggtcttaaacttctaggctcaagtgatcctcttgcctcagcctcccaaagtgctaggatgacaggtatgagccactgcacctggccaaaccctctgcttatcttaaaaaaaaaaaaagttataaaaagaaaaaaattaaacattatcctgccctttcagaggactgacatggactctggtaatcaggtgaaggttgacctttcaaacaaatactgacaaataaaggaggaagggatgacaaacttagaatatccttatcctgcaacttcctatgaaatcattgactcaggcaagaattatcaactgttgtcaagaccaataaatagttcatgggcactaaagtgacaatgtatactctttattacttccattctaggtccaacacgattttgcatataataaagacaaaaaccagaaaaatttagaataaggagagaaagaaagagacaaaaggacagtaggttacattaaggagtgagaacaggctacaaactgcctgccaggaaatcctacatatgtatttatttggggtggaacaaaccactgaccctaaatgtaccagccaatgcagagagaatgtgcctggctacctgactcaaggtctattaagtttaaaacaaaccctttccagccctttcctccatacagtaatcaaagacactcaaagaccctgagaggaccgtccttcacgggttctcacagagccacaccaacctgtccttgacaacacctgagattatacatggcaacttgctttctagggcgtttcttacaatgtccttcaatacggtatttttccaaaaattagttcaataaaaggaattcttctactggagccaatacaatacaatacaatacaatacaatacaatacaatacaatacaatacaatacaatacagacatataattctgatgatctggcctaatctgggaaaagatttctcagtatcctgaatccaaatcaccatattttactcacataaacccttggcagattcccatttcctaaaggagactcagtttggaatacatagttctcaaatacttaaattctgaaattcacatgacattaatgtctttgcaatagattgcttttttctttgaaagaaaaataccaccagaaaaggccctccatatccttgctaaaaatagtcctgctgtttttcttattccaattaagatacacacacacacacacgtgcacacaaaccctttattccaaaacatacataccttgtgtgctctcttaaccaacaagatacctgatggaaggtgggaccctctgagccccaaagagggaaacaaataggcactaaaagagatcgctaacatcataaaggctaaaatataagtaatttacccaaattacataagtggtaaatagtgtacccagattggaccttaagtagtctgacctcagagaccatgacattacaacgctatgctctactactcagtggtactcccccactctccctcccccgaaccatggattctgtgcctgtgtttttgccacatctggcttggagaagaacatgaaaatggaagctgaactcgcttgccatgtttagtgacctatgaatgctgcacagcagtcaaggctcatccagtgtggtaggacctccccacacagcttataggcttcagggcatagaactgactatttctaaagcctcaggatggaaacagatctatgatgcctgaagatcccaatcacatatcaaatcaagacaaaaacaatgatgataacctttccctcctccttttctccaatggcttttacttacaagctagctctggtaagacaaaatgagttctgggttagaatctcagcaactcttcttactcttgctttattttgataaacaaacaacacttcattttggtacatgttctgggagacctttggtcatagtttactttagagacaggtaatgcaagtgtttcatttttttttaagaacaacaacaacaacaaaatagcaaactgtgtcagtaacctattatttccaaataagatctgtgtggtccactgccaaatgacaaattatacatattctgaaaaggacaaaaaacatgtaaagttgcaaaacttctattagcaatatctctccccgaaaaccatactcattgctgtttaataacgaacgttcaatgcttgactttgctcaaataaaatttaaacttatgttttgatgtcaactcagcctttcatttctgccccaggagatattacaaggtggggaccaggggtgtgaggcgggtcctgaatacatccagctgtttcaggtcttcacctgccttacccatgaaaagcctggcagtggcttgtaagccatcatcaacagctgagtatgtaatatgctgcctagccttgtcttgtgcggagaatgaagaggatactaaacaatccgttgaaaggcctttgcctcatggaatcttacagtttccagctcagtgtgtttataaaaaatcatagtaaggcctgccctagataaggagctcccccttgacatccacaaggacttgaaacagggcaaaaaaaatcaagcacagcttcacaatttagccacgccggcacactggtccaagatcacagaaagatggaggcaaaatccctttttcctttttgagaagaaaaaaaaaaaaatctaacaaaactacaacttgcattacataagtaaagcatgagtgagaggaaaattcagaatccgtgttttaggaggtgacagagagagataattttcttttggcctcatgaagcccttttactttaatcaatcaagaaatccattaaagattctgccacaacccagatcaaaacggtatagttttgctgtgagccactttactgccaaaatgcagctgctgtaagagcaacccacaaaggcactgatggctgctgaagatgaatatcaatgaaagaaaatgacagatgccacataaacaactgcccaaatgagcaagttctagcaaagaaatgaaagtaatacaaaattaatatgcttgctctatataaagagaaaatgttaaattagaaataatttcaccttctcacagttctcacttttcctcttgattacttgcctttgtcacctaggcaattgctcagcccaacggtgggcatgaaaataaaagcaagcattaagaaatcaaattctattataaaagtccaaacaggaagctgttgctgaaattcatgttctgacagcatttctgatatcaatttttgattaatgatctcatgtgtatgggtagtataagctgcattttttttcggaaaactctgtctttatgaataaatgtggtttaatattccaaaaatggcatgcaattctttgaaacatgaggcttaacaaaatgccaatttctagtcaacataggactactatcacatgaaaagcaaagggaagaaaggagggagagagtgggaacagagggaaagagaaaggaagggatggaaagagggaatccatgtacaggtatatacacacacacatataaacacacacacacacacatacacgcacacacaccactccccattagccactctgcaagaaagccaaagaaattaatgagatgattactggaaagtgctttggactctttggaagaaagggactatataaatggaaggtatccgttttcttattctaaaaggcattttcattcacatcaggatgaaacataatacaactaatatccagtctgctcacttttaaaaatgaaaattaatcaaatcccaagtcttttagaacttgcattgaacaaacaccagttctccatttcccagctttaatgcttatgttataattttttttaacaactgcatggagtcacaatttcttgccaaactaatttaatttcaaatttaattacaggtatacttacattctgacttttgagaattacactctcatcatcaagacaaccaaccagaaatattcattgactaatatagagaggcatgaaatgtagtccctgacctcaagaagtttgcaattatagggagataatacttgcataaaatacagaaactatacattaatatacttaatcaacactgtggctggggatggctgccagttgttctccacaaaagaattttcccaaaagcctaggccttcctttacagagtcccaaactgttttctcaaatgtaattatattcaagggcaattttccaaaagtagcagcacacttccccgggctgtggagtacagcacactgtctcctctccctgggtctctgagtcatcatttggacctcagatgactcaagtgtaacagaactcagtccaggtctttggtggggcctctgaaggccatgtggaggctgctttcatcctccaccaaggagttatcaaagtgcttggatttgtttaaattattctactttaaaaatcagcaggttgtcactaatgtaagctatcttgggcctgctcctcagagctcctatctcttctaattggatttttgctaatctcctgtgggttaggaaacttaaatcgaatcttaaaagttgttatgcaccaaagaatctcatatgagtgaaagtccctaaaacattccaatacttcccagcctttcctttacttctgacctgtgctcaaaggacttgctctgttttagtactcatctagtttctagatacatgaaactgtcaaatgcatgtatgtctcatgtctctactcacaaatacctagtttaagagaataagaggacacaaaaatagagaaaataaggagtattactgtgggtaaaaaggtagtatcttttttcaacaacagaaatttcaaattgttttcaccaggaacccagacagagtcttgactcaagtgaccaatacctgcacatattatagtaacatgcttttaagataaatagaaaatgctgcaaagaactttaaataaaatttaaatgcaggttggcttcaaagtaacaaaaatcaggttggcctaaagtttctcctcggcttgagaatttggatgaaaaatagagcatatctaagctttaacaaaaacaccatgagcaccctggctgggcacagtggctcaggcctgtaatcccagcactttgggaggccaaggcaggtggatcacttgaggttaggagtttgagatcagtctggtgaaaccccatctctactaaaaatacaaaattagccaggtgtagtagcaggtgcctgtaatcccagctactcaagaggctgaggtaggagaattgcttgaacccgggttgcagtgagcggagatcgcaccactgcactcaagcctggatgacagcaggagactccgtctccaaaaaaaaaaaatattcgcaatgagccttacaggcaataaagctgtcatttgaaaacaaaaaccaaggtcatttcagggatgacacctccattcatccaatagataaatcaaaatgaagatgaagaatggaggaaccaatggtcaaaggcactgataggaagcaacgaaaaccagaaaaaaaaagtattatgtttattaatacaaatatagtctagatacaaatagaaacactgaaaaaaacagaccatgaaagaagagtgtaataataaatcaataacctcggatgaaaatccccacacatcaaaaactcaaggaaattctgaaaacaaatatcctcctacatacctattgggacagttaaaaaaaatttaaaaaagcaataattataaacttctagagaatctaaatagaaataaaatgtgtaagatgctgccaaattcatattcaaaggaaaatgtatagccttaagaaatttcattgttatataaaaagcctaaaataaactttttaaaatataaaaaagaataaggaaataagacatgcagacgttaatattttgaaacaagataaatataagatttgaaggcacaaacacaggaataaaaaaaggcaaaacctttgatacatctaatgtaagaaagaaaaatataaatatataaaatgagtagtaagaaagatatagaatatactttcacgataatatatcttttccatatcctttgagtagtaatatttcaaccttgtttcttctttaacccagttagaataaagaacccagaagctcatgaaaccaattgattccactttcccctggaaaaataaatcaacatgtagaaaaaagcaaaatgtcaactctacttaaaataaacaggcccattttgtctatcactatacatgaaaaaaattaagtacacataacaaacaacgctgatcataatggagccaaattaaaagtaatttataatttatacattaaaaaacagtatcagtgattgaaaaacacaaacaactcaagaccacactgaggatatacaaccagatagaagagctctttctaaaaatcacagacagatttcttaatggaatactgactggcagccaatattttccagtaattcccaatttaacacttggaaataccaaattttagtgacctaggttattaacaagtaactgttagataaaagaaagaaaactcacaaaaatgtgcattatatgcccaaaagaattagagaagagacatgaattgttaatgtttctagtgattctcaagtaactaacgaaggcagttatttgagaatcagtggccaaaagcagcagtcttcaaagcggtagttttctaagggctagaacagtgaatattcagcatggctagttttaagggtataaatttccagatctacagccgggcatggtagctcacatctgtaatcccagcactttggaaggctgaggcaggtggatcacatgaggtcaggagttcgagaccagcctggccaacatggtgaaaccctgtctctactaaaaattagctgggcatggtggcacacgcctgtagtcccagctactcaggaggctgaggcagaagaattgcttgaacccagtgggcggaggttgcagtgagccaagattgtgccattgcactccagcctgggcggcaagagcaaaactccatctcaaaaaaaaaaagttcagatcttcaacttccatatgtacacttttctaaaatgtgtctacctgagagggcccctgcaatcctcacccggttctctcacaactcctttttcaccattcttctttcatttcacaacagaaagacttaactgctacccatgctaaattttctacagtacacttgatgtgccaaacagagaaaattcaaatatactggaagttaagccttcttaatcaagacctatgataggacttcttccctttccctgtcttatacatatttctgttaagaataaatctagtgatagaatctgggtgtttcagcctgtgttgggatgctctaaatttagatacatcagagtcctttgagagcaaagcgaacaggaggaactgatacaggagctcaaaaaaaaattatttagacagttagagagggtaagagagtccttggcaaggtttccctttttattaaaaagcagccccaaaatcattgctcttctaacaaaaacgagcctaaaaaaatcgagctgcaaacatagataaacaagctggaagcttgcatgggcaaatgccagcagctgtgccaatagcaaaaggctacctgggagccaagcacattcgacatggaggctccaccttccattttctttgtcaaccacatgttcagtaaaggaacaagcaacatggtgctggccaggcagagaacccatctgcataacaaaagattaggctggagtggccagtttcttcccacgctatgcaaatggcacatctagtcctaaccagatcttcgtgcactatgcaaatggcacacctggtccaaccaatcttgtgctccctatgtaaatcagacaccacctcctcaagctcatctataaaaccaaccgcatctcgctgtgaacctaaaagacctgctcaggagcccctctctgtctgcaggaaagagagcttttctctttcttttgcctatttaacctccactcttaacctcactccttgtgtgtccacgtccttgatttccttgatgtgagacaatgaacctcaggtatttccctggacaatgatgctgcttcagaaccacaaaacatgttgaaggcagtttccttatttcaagatggcaaagtcacagtaaggcactatacctagtggtccctctcaaagtatcctagcattagaaaacagaaatggcataaaaataaatattagcatatttgtttgaaccgaagagtgaagtccgatgttttttaacaaaaagcctgatttttctaactggaaaggcaataattaattccagagcgccacagttttctacacacaaacacacacacacgataaaaatgcacttaaagtccataatataaaaatgccttcccaacctttccagagtatatggaatttaacaaggtgccctaaagtgtaaaagcaacaagtatgagtgatagtcttctgataggtccaggtaaagcctttttggtaaacttcccagaaattgagaaagtaaattattctaatgactggataacagggccttttcagaagtcaggtggtttccaattcttggctctcaacaaaattaaaggaggaccaaatctcaagttgccagcatatagagtattaaaaatattttttaatgacagatcacattagcttattgcataaaaacatttcaaagatttgagaaccactgctaaagcaattctcctttcaatctcctcaactcttctgcctgaaaaagtttaccaggggtaaatctgtggccccatcaatgccctttggatagtcatccagaggtacgtgattgaaatgaagggaaagcccagtacattttgttaaatgacatttctaataacatttttaacgtctaataattagttatcaaaaggtacaatacttatgttgctctgaaaaaatgtgtgccactaataattataatgataacccacactggaggcatttttaaaaataattagagcctcaccgttacaggaaatatttaattacatttaaatttatttgcatgatttaattgcaagggaatataatagaatgatcaaagaaaaacttccaaacacattaaacaagcaaaaattttatatgacaaattggatataaaaattcaaggagaaaacagaatgatataaaatttctgacagtttaaaaaacagacccttaatgtatttttaacattggtgatggtgggtatcaaatctctagggttttagattccaccagatgcattttaaaaagtgacataaattttattttaaaatatcaatatttacaatccaccaaaaattccatctcatgaaaacaaacatcaaacttgtgacaaaacacagataccaacttataaacagtcaaggcggtacacagttttgcaaaattcctatagcaaatatgaagtgtgaaggcccctgccctctagttcctaagcacggctgcagcttataacaggcatatactccaagttccagactcagtcatttttctggggtacccaagcgcccattgttaagttcttcttcaaatgtcttgaactctgaatttctttgtttactctttcatacttgcatcccaaccgcctaaaagtgttggttttcaaactaaaatgtcattggccaagggttagagattaattccttgctctctgagaacctgtccaagctgaatatttatcagatacaggagatcagatggggtgaactttggaccacatatagagaagccaggggtaagtttctaactaccatgaattcttagaatgacctttgataaatctaactgttaaaactaactgtcagatgcttcatgcaggttctcatctatttaaatataaataccaaagagataaggactcttactctcttgcaaaggaggcctcaagtggattaatatatacctgaaaaagcatttccagatcctagaagaaagagaggcttaacattgggacagaaaggatttctagtagtcatttattctggtgtattctctgcctcaagataaaaacaaaccaattccacagtgagtacagggggctgcactggtatttaatcataataaatggaaagtcaagagctttttaataaaaaagactctttgctaatgcagtttaggtacataccctctcaagtccttggagatggtcaataccagtccatcatgcagcctctgtcctccgacaatgaagcatctcacacacctctgaagtaccatgtgcagcgatttcaatggccccctgtgctaatccttatttcaattcattttagcatgttattttaaagcatgtggctatatccacgcacattcctacataaatacacacatatttgcaaaatctctacatgaattatcttatataattcaccaactaaatgtaaaagaaaaaatcacttgtaggtcttccaacaggaatccaaaacacatgtttacatatatgcttaacattcatttaatcatgcattcagtcacatcacatattaagttctaaatagccaaggctgaagaaagtagttctatctctcctctcacttaaaaaaaaaaaaattatatgtggaattcttagtgaatagacaaataattccttctttatttctctttcttctcttttcttcctgaacacaagaaatttctaagagaagacagaaccaagcccttgcctgtcttgttccatatcccgtgtctcagaccctgcctggcatgtggtaggcacaaaaaagttacttgttaaacaaataatgcaatagtgatccaaatacaaagggtgatgtctaaccaccacagattttagaagtgcaggacaggaaaataagttcacaatgagctgttttaaaagaagtttgtttagctcatttgtattgaaatataaattattataatgggcaaaatattactaaccacagatgaggacttgaatgagaacccatggctgggattcatttcaaagaaaaagagaactgagatctgaattctagtttccagttcagcatgttccacagcttagaagtcaccactccatcctaacaagtaaaagccgaacaaactgaaaaagcatcaactttactcagattcatcagagaagtgaggttacaaggcaaatggctaccccaaaaatggagagatggacaagtggtgatatggtttggctgtgtccccacccaaatctcatcctgaattgtagctcccataatccccacgtgtcgtgggagggacccagtgggaggtaactgaatcacaagggtgggtttttcccatgctgttctcttgacggtgaataagtctcacgagatctgatggttttataaaggggagttcccctacacatgctctcttgcctgctgccatgtaagacgtgactttgctcctcctttgccttctgccacgattgtgaggcctccccagccacgtggaactgtgagtccattaaacatctttactttataaattacccagtcttgagtatatctttattagcacatgaaaacactctaatacaggtggacacagagaatcaaaacttactggagcagaaacccaccagcagaaagttctgcaagaaccagtaccagggtaggaaaacctaaacagtaattgacaaattgccagaagctccatgtggacaagtctgagagctaaaaactccaggagtggcttttctaactcagtaagttaaacaaacactacaggaggacacagtcacaaggggaggagggggcatgcttttgtgagttttaccaccagaagtccacgttctcatgcttttgggaggcagagaggaaaagaaatcactgtgaaatatggcagggcattctgttcttgctaacaaggtttgcccttgggacaaaagattttaccagagcctaacctgcttggattacatcagagcccaacctacctggggtaaagaaaataacccaacttcagctccctgcagccatcctgtcccacactagggtgatggccagggcagggagaggacactgagaagcactgtgaagttcaacaggggcacaagctcaccaaaagactgagacctaatcataggactatagaacacttcctgtccccccacgcctcaccaccacctcactaaaggcctgtttaccacagctcctcttacccagtacatcatgaccacctttgcccaaacacttacaaggcaaactaaaaagcaaaacacagttttgaagagactgaaaaacatcagaaccagggttccataattatgtcaggaaggttggaattatcaaccagggaaattttttaaactatgattaatacactaagggcattaatggaaaaagtagacaacatgcaagaacatacagatcatgtaagcagaaagatgaaaaaatcttgaaataagtcaaaggggaagacaccttatctataaagggacaaagacaagaattacaacaactattccttagaaaccatgcaatcaagaagagcatagagtgaaacatttaaagttttaataggggggaaaaaaaaaacccggccaacctaaaatcctgtaccctgtggaactgtccttcagaaaatgaaaataaagagacaacactggaaaaggaataagtgaagataaaattttaaagtttattttctttattcttaattgatctaatagttaacagttgatatgctaggaaaggagagaaaatggaatcatataaaatgctcaattaaaaccataaaaggcagaaaaagtgtggaagacaaaaacagaaacaaagaacaagataacaagtagaaaacagtaacaaatacgataaatattaatccaactatattagtaatcactttacacatcaatggtctaaataaaccaatgaaaagacatacattttcagagtggatcaaaaaataagacccaactgtctatataaaaaaagcccagtttaaatgtaaaaacaaattatgactgaaagtaaagacctggaaaaagaaataccatgctactctaatcaaaagaaagtaggagtagctgtactgatttcagacagagtaaatgtcagaacttagaaagttgtcacagataaaagggaaaattataggccgggcgcagtggctcttgtctgtaatcccagcactttgggaggctgatgcagatggatcacctgaggtcaagagttcgagaccagcctggccaacatggcgaaactccgtctctatcacaaatacacaaaaaaattagccgggcatggtggtgggtgcctgtaatcccagctacttgggaggctgaggtaggagaattgctggaaccctgggggaggagattgcagtgagctgagatcaagccactgcactccagcttgggtgacagagcaagactccgtctcaaaaaaaaaaaaaaaaaaaaaaaaggaaaattatataacaataaagggatcaatactccaaaactacaaacattaatgtgtatggcataacaatagagagtaaatatacgtgaggtaaaaactgacagagctgaaagaacaaataaacaaatctactattagagagttgaagatttccaacactcctctatgagaaatgcacacatccagtaggcagaaaaccagtaaagacatacttaaattcaacagtactgtcaattaagggaatctgattaacacctatagactacttcatccaacaacagcaaattacacattcttttcactgtcacatggaacattcaccaagacagaccatattctgggccataaaacatcttaacaaatgtaaaggaacatgggcacagtggttcatacctataatcccagcactctgggaggctgaggtgtgagaatcgcctgaggctagaaacttgagagcagcctgggcaacatagtgtgaccctatctccacaaaaaataaaaaattaactgggtgtggtggtgcatgtatgtagtaccagctacttgggaagctgaggcaggaggactgcttgagcccaggagttggaggctgccgtgagcttatgatggtgccactgcactccagcctgggtgacagagcaggaccctgtgtcttaaaaaaaaaaaaaaaaaaaaaaaaaatggtctcctttcagaccacgatagaattaaactagaaatcaacaacagaaagataaatggaaaatcctaaaatgtttgtagattaaacaacacacttctacataacatgtggatcaaagaagaaatctcaagagaattgaagaaatattttaaactaaatgaaaatgaaaacaacacttatcaaaatttgcataatgcagtaaacacatcaaggaaatgtatagcattcaatgcgtgttagaatagatcaaaaatcaatcacctaaacttccaccttaactaaaaaaaaaaaaaagagtaaattaaatgcaaagtaagcagaaaaaaataaatactaaaaattagagcactatactagtattagaaaggtcaaaattcaaaacatgacaacacaaatgctgacaaaaatgtggagcaacaggaactcttgctcactgctggtgggaatgcaaagtggcacagtcactttgcaagacagttcggcaatttcttataaaattaaatataccctttccatacaaaccagtaatcatactgcttggtatttatgcaaatgagctgaaaacgtatgtctacacagaaacctaaacacggatgcgtacaggagctttactcataattgccaaatcgtggaagcaacccaaaagcaggtgaacggattaaaaacaaaacaaacaaacaaaaaagggtggcacatccaaacaatggaatattaatcagctctaaaaagaaatgagttattaagccatgaaaagatatggaggaatatttaatgtatattaaataagtaaaagaagccaatctaaaaaggctcatatggtatgattccacctatatgacattttagaaaaggcaaaactatggaaaaagtaaaaggatcagtgattgccaggaattagcaggtagagagggttgaacagtcagagcgcaaggtgtttttagggcagtgaaactattctttatgatgttataatgatggactacatctttatacatttgtcaaaattcatagactgtacaacaccaagagtgaaccctaaggtaaattctaaattttgagtgacaatgatgtgtcagtgtgggttcactgattgtaataaatgtgtcactgtggtgagggatggcaacaatgggggaggttgtgtacatatgggccaggaagtatatgggaactctccacacttaaagttccattttgttctttttgttttgttttgttttgagacagggtctcactccatcacccaggttggagtgcagtggttgatcacagctcactgcagcctccaaccccccaggctcaagcaatcctcctacctcagcctcctgagcagctggaactacaggcatgcaccaccatgcccagcaaattctttttttctttttttttttttttggtagagacagggtttcaccatgttgcccaggctggtcttgaactcctgggctcgagcaatcggcccaactcagcctctcaaagtgttgggattacaggcatgaaccaatgcacatggcctcagctcacttttgtttgaacctaaaactgttctaaaaataagattgattttttttttaagcaaaagttaaacactgagatggtttccatttctaccccagggtatgtgaacatagcaccttcactccgttctcacctcgtcttcccttgttcctccctcaattctcagatccaccagtgagacagaaaacataggagacaggaaaagaagaatcaaatgggaagtggaaaaaagacagggaagagacattgggcaaaaacacattctcaagttatctctactgaacgaggttttgaacagagagagctaaccatcatgaaatcttggtgcctctcaaactccactatgatgccctctggaaactttccgtctccatgagtttacaaaatttaaaaaattgacccaacaaaagccaatttttcattgaaaagcactactaataattgacatgaaagggcaacactgaaaaaattccttgatttgggaagcataaaatatgagtcctaaaatacactgtcactctgtgaagactaagcctccaggaccaatagctttctctctgatggaaagtggtcccttctagcaatataaggggttctgccccttgaccagcatattataagtgctgacacaggtatgccccaatgacatgatggtaatacgtggtaaatggtataattttgtatcatcacaatttgaatctgcctcacaatgatataatcttgaatcttccttgcagacctcaaacagaaactcacttcacatatttaaccgcaaacagcatagacatttctcttacagagagggctcattttaaaataaggatatgccttaacaagtatatttagtcataaaagccttaataaaaatatgattttaaaaatccatcacagaatgatgcaaaagcaagctgagggttcttttgacccacacactgaggccaaactacctaaagtgattactacacgtactgaattcactgtgagacagaaagtatggctaatttactacctatggttcttcagaactttccatatttattcttttttccattaaggttttttgttaatcatatcttctgaaattctgtgattacacaaacaccaaagataatgacatgacttaccttgtttcttacatatagctgcaaacatttaaacaaatatgagtccaaaattcaagaactccatggctggcctaatgttaacatgaaactaggtatgaacaacaaaaattacaaccatagctactgtcgtctattgagcacatttgatctgctaagccaggggttagcaaactaatggtccgagggtagcactctgctgcttttgtaaataaaggtttcttggacacagccatgtcccatttgaggtcttatctgcatatgctttcgttccacctccacagagatgagtcattgtgaaggatcatacagcccgcagggcctaaaatatttactatctggttcttcacagaaagtctgccaatccctcttgtaggcacagtgctaagtactttatatagattatctctttacatagattattccagtgaggtggaaatgattattatccccattttaaggaggaggaaacaggtttatcaagattgagtcacaagcagccaagccaggcttcgactcccaaaccctctaaactgccaagctacactgggtaggagcagggaggacaacataaccctaacgtcatgtaactgtactggtataaaggtaaagccttccaaagcatctgaaattaaaaaaaaaaaaaaaaaaaaaaagtaaaaggaccaagcccatttcaggaacagagagactcccacacaccctgtggaaacacttcctgaatggtgtcattatcattgatatcacagcattaccaactttcccatgataacgtcatgccacgcgctctcactacactgtgttcagagaacaaacctctcggctgactgaccgcctgcctactgactttgcattctgcccttgtcaacctattctatgtgccactaccatgccaatcccttctctaagtattgagaaagtcattacctaagagcataccgtttgttttgagttaaacagactttgatagaccaaccttagaaactagccatgaggaatatcaatactcagaggataaaaaccatatctaggttctgagaaactaagcacatcaatcatttttcagaatgccactatcttctaagacaggtttttttagcagaaaaattgttcaccattttaataggaaaagaccaaatggtaacctacaaagaataaaaagcaattctgttataaggaatccattcaggctacaagtcttcttaagtcctggacaccaaaaccgcaaaagagcatttagcttaaaacccaacggaagtcctcagaacacaaggaactttggagcaagcaggcccctctactcatcaaacttagagccacagagcacaagagcatcttaaaggctctcccaactttttataaacaggcctgctaaattttgcttaatgtgatgtttcccagacttatttgagaaaggatttctttttctctccctttacagaaccatattaatactaaaacagtccctcaacaaacatttcccaagggtctgctgtgtgacaggcactgaactaagggactggaactagaatctggggaggatacatattaaacataaaattgcaagttattaaatgaatgttagtaccccatggaagagatcgcagggactagagtagacactttgagaaatgctagtataggaaggacgctggaccaggagccagaaaactatattcccacctcaacttggaccctaactccctatgtaatcccaaagatcactaagtaaggaatgcagtgtgtgcagacctcggattctcccaactatgatatgacaaggtaggataagatcagctctaagactccatccattttgaattcattctgtgtcattaattcaatgtgaaatgagagaaacgaataagaaatttcaatacagtacttagacacttcaaaagaaatactgatggctcagataatgaaactaaactggaaaaatgtcttcagaataaatgtccagaatgtaaatgagctctgagtatttttcccgaagcaataatgaagcagtaagaactttaatggggaaattaagctctgacatgatctaatccacgctctttttccagccttggcatctccttcctccctccctgctgctccaagctcactcagtgttcccaaaagctccacctcctcaggtaatagagttttctgaactcaggccatcagaaagtccttcttgcccaatgcaggactcttaacatctatgtgtttccatggctaccctccgggtcaactctctctgaacccctcctgacatccttgctgtcaccttccaaaatatctaacctgttgaccacgcccccctttgtgaccccaccaatcctaacactggccttcagcaggccttggcacttactagctgtgtcaagtttcttacccgctccagcctctgtttcctaacatagaataacgaatttgtacattgcaggatttttatgcaattccaatgtacataaacatgtgaagtgcttagggcagtgcttggcacatagcaagcgcttatgctcaggatagcctcctgctttcccttccttccttatgaacagaaagttagttttattgaggacagcaatatactcagctgaagaaacaacttcctagccttccttgcaagcaagaagcatcatgtggcataggtctgctatgaaatataaatagaagttgctgagcggggcttaaaagaggagtaaactcaactaacatatactcctttgcccttccccatttttcctgacaaattttagatgtgatgatgtggtcacaaaaatgtctcaaaaccataagggagagaccaagagaattacatagacctcagctctggcaactatgtaccactaaacccaggccaccagcagtcagcctagttctgtagtttttggtgagggaaaaacagagacaacttctaactgccttaggatatgttttctcaggttgctcttgcagccaaatgcactccctgatccagttaactcttattaattagcacctgcaacaatttatttcattatctgtttatgtttggtttctctaccagacaaaaagagtcttattcattttcacacaacacctctcaccaagcaagtgttcgataaaagttaaatgaatgaatgaagtgacaataatgaccatcatagtttgtctccagttctttcacaagagaaaaacattactcttaagtttcagaaatatttttcttcatctcgaactgaatattcttcaaagaatttagcatttgtaaaagttcccatagagtgcctgaacctaaagttatttaacaagcactgacataagagtatttagtgtgccaggcactgctttcaaagctttcacaaagaactcattttattctcataacaacccgatgagttaggtactattatccccattttacccatcaggaagctgaagtgcagggaggttaagtcacccaaggtcatacagccagcaaccagcagagccagcactggattacatagaatttggttccagagttcatgtccttaactgatattctccaccacttctcaaccactaactgtgacagtacattctttctgtttctgtgtaaacaaggaaggagctgggagaaattcgatctgaatatctatgaagattcttggctccacagatcagccgggaaccaacgcagaggttacttggctagagtggacgttaccaaatgtacaacgaaggatgacagaaataattgtacaaggaattgtacattttaattctcttaagaacttccacagttgaagatgaggaaaatgagaggtaaaagaagaaatgatattacaagaaaagtcttttaagtggcaaatacaagtaaatgacacaaaaagctttctaatagcaagctaatcaaaatgactacctaagacccaattttcaaaaaccttttagctgtaagatattaccctggtactctgctcttgaagcaagattagaaaaattatttaaaagaactccagaaatgtgaagatgcattttcatctttctgcagcaattctcaaactagctacaagaagacattccagctgaatgattacttatactaaattctgcacaatttatctctcacacagattctgcatccagtaattatcagcaaccaggcccaattccatggtattgacagtggtatctgtcacgtcttcagacaactccactaccaagggccctgcaacaaatacaaacaggcagagcgtgttttcctatctacagtgacatctagtgttaagaaactaaaacgcagtctgtagaacaacatttattcccattactattgtatttaaatgcatattataaaacaggaatatatatatagctcttaaggtaaacagcttttcccataattgggattgccaattgtcaattgtattatactccaatatttaaaatatctcataagattaacccattgaaaagacacatttgttttgttaaagtgaagaaatcattttgttctccaatagttttgttttaaatgcaaacatatctttacttactaacagcagactggaatgtcagaggattttgcagacattaaaagacatcttgttaaatttaacaaaaagcaatctggcttaatataataataaatacaagccctttattcaaaatcaactcgcaaaatctctaaaggagaacaatttaaatgcaaatgagcccattatagaatggtttctgatttaggtatatcatgggctaaatcttgtctccaaattttacatcttaaaattagattctaaaagatgcaggatagccatattcccctcaccaaagtgaagtatcattccggttatgacaacaaaggtgtttgaatatcttttttatttatttactttttttgagacagagtctcgctctgtcgccaggctggaatgcagtggctcaatctcggctgactgcaacctccgcctcccaggttcaagtgatcctcctgcctcagcctcccgagtagctgggactacaggcgcgtgccaccacaccatgtatttttagtagagatggggtttcaccatgttggctaggatggtctcgatctcctgacctcataatccgcccgcctcagcctcccaaagtgctgggattacaggcgtgagccactgcgccgggcctggataccgtttttaaaggtaaataaggcataattaaagagcactggattagaaatgagaaaacagaatctagccctgggtctacctaaaaaattctgagaccaagttatttaatttctcttgccttcaatttccttgtgggttttttttttttctctccttaaaaaaaaaaaaaggtggggaagacagtgaggagtttagcctggattccttcctgggctccttgttctaacattctatgttctatgaagatgatgatctctaagatctctctaaaccttgctttagttatttaagccacacagtgccacagtactctgaggagaacagtgttaagacaccttaagactcaaacaacaaacaaggtttgcattgaaatcggcatagagtaaaagacctctttaagatgtttagatgatgactcctgacctgaatcaaagatgtactaaatcacatccactatgactctgcacttcctaaaccagcaagtatcatctaaagtctcttaataaagacgttcagaaatcatgttatttaagggggtttattgctaaaccaagatagtcataaacattctgggtaagtgaggatttgccaacagagtaagttttaggtctttgtttaggttacagggaatgtttgctgaaaagttttctaagatgaagaaagaactctaaataattcaaaatatgcctggcgttttctactataattatggttattactctcttacttggcaggaagaactttgacctggctgaagagaaacagctatggcttagaggtaacagctacaaagagataaaagggggaggaagcagagcagcagaatgagtagtcaaactcaacaaggaagagagaaaggaaatgaagcaagcagaacccaaaagactcaccacagctgggatggctccagaccacggcaatggaataccccgaggacctcagaaggtaccgatgggcatctgcgacaagtggtgactgtgtgagtgacagctctccaagatgactgggatggcaagtttatgcaaaactgaagtggagtgaacaggagagagctggaggagtgcccagaggctgaggatattaaatactgggacaattcacctgatgacaagggtcagagggcaaatcatttgaaaatgatgcaaattaaaactaacagaaaattttttccataccttcaggaaattcaaaatagaaccataacgtgatacaactagatacccactagagtgcataacatgaaaaggacaaaaaacagtgaatgtcatgaggatgtagaccaaccgggctgcagggcaggtgggaatgcaaatggtatgaccacgttggaaaactattttcagtatctactaaagctaaacatgtaatagtccccctttatccacggctttactttccaaggtttcagttacccaccattaactgtggtccaaaaatattaaatggaaaattctaggcagaaacaattcaaaagtttaaaattcatactgttctcagtcgcatgatgaactctctcaccttctcgcccaggacacaaatcacccttcttccagcatatccatgctgtatttccccccagactattagtagacagttaccagatcaacaggtgtaccatttgtattcaagtcacccttattttaattgttcatggccccaaagcacaagagtaatgatgcaggtatattgttataattgtttaactatcagctattgttgttaatctcttactgtgcctaatttataaatgaagcattatcatatgtttatgcatagtatacatagggctcagtactatccaaggattcaggcattcactaggggtcttgaaatgtatcccctgtggataaggggggactattgtacacctactcaataacccagcaattctacttccaagtatacacctaacagaaacatgtgcatacattcaccaaagacatgtctaagaagattcatggcagcacgatttctaacagcccaaaacagaaaacgagtacaatgaataaactatggtatagccacattgtgttatacaactatgtacaaagacataagtagatctcataaacataatatggaacaaatatggtacacatacaccatggaatactatgcagccataaaaaggagcaacatcaggtcctttgcagggacatggatggagctggaagccattattctcaacaaactaatgcaggaacagaaaaccaaatactgcatgttctcacttacaagtgggagttgaacaatgtgaatataaagaagacacagggagtggaacaacacacgctggggactggaggcggcggatggggcagggggagggagagcatcaggaaaaatagctaccgaatgcggggcttaatacctaggtgatgggttgataggtgcagccaatcaccacagcagatgtttacctatgtaacaaacctgcatgtcctgcacatgtacctcagaactttaaaaaaaaattaatattgaataaataaggccaaacaaaaaaatatacagttgtgcactacataacgtttcagtcagcaatggaccacacatgcaatggtggtaccataagattatagtaaccccgtatttttactgtacctttcctatgtttagatacataaatacttaccattgtgtgccaactgcctacagtgttcaatagagtaacatgctctacaggtttgtagcctaggagcaataggccataccatatagcctaggtgtatagcaggccataccatctaggtctgtgtaagtcactctatgatgtttgcacaatgagaaagttgcctaatgacacgtttcttagaacacatcattgacaccaagccacatgtgactgtgctctgtacattccatgtggataaagttcaaagcagactaaacaacactaagctttcagacctcaggctagacgtctcccttggagggaggaggagtactgccagaaggggacatggcagggactccttcggggctaataatgtgtttttcttcacctggttgctggaggtatgggtgtgcttagttcctgaaaatctgccaagcagtactcatgatttgcataatattctgtatagatgtaatatataatgcccagatagaggctgggctccaagggcatattcaaaaaggaagagtattccaaaacaaaaacccagaaacaagggacaaaaagaaagccctcattgaagacctttcataacagagaaacacagcagggtcctcgcacccaagacatgggccctctatacagcctcctaaggaagaatccgagtctttcttagacagaagaaatcctcaagagttcacctagatcagcctacccacttgtgattgaaaaaactgagaccaagagagagaatataacttagtcaaagtcacacaactagtaagtgataggtccaagggcaaaatccaggtcacctcagtaaacaagacttaaataatgataaaatactcaagatatgtcaaaagaataaattaagtgaaaactcagaatgagtaggaactcaaaaaaggacaaggcttttgtgtatttcattcaaatgagataagcagtgaagaggtgacacaatgcacagaacaaccgcagagaggaggaaagagctaggaagctggcaatgtctacacatcttaatctgggtgtgggttagatgggggtacacagaagtaaaaattcatgagctgcatataccatctcttcacactttgtgtatgttaaatctcaatcaaaaaccaattcaaatagtttttttttaattctgtgaacaaataactgcatttaacaaaatgaatctattcagttaaaatttcttttcaaatggcatcacccagtgtctccaaatgcttgtatgagtgtacaacttgggggctgcaaaacattccaagttatatgaaccatttgattctatgaacctacaaccatgcaataaacatggagagatgtgtttgaagggatgatcttccacatgctttagggctgtgctttccaactcttctgaggctcaggacactttcgtcaaaaatagagatttgggggtatcactcctattcattctcctttcacgtgtctgcggtaggctgagaaaactgtctttttaaaaagatccccagtgattctgagtggaaaccacttctgtatggaagtggtttcaagacaggttctcactctgtcgccctggctggagtacagtgagcaatcacagctcgctgcagtctcaaccttccaggctcaagcagtcctcctgcctcagcctcccaagtagctgggactacaggcgtatgccacctgtctggttaattttttttctgtagagacagggtctctctatgttgcccaggctggtctcaaactcctggcctcaagcaatcctcctacctcagcctcccaaagtgctgggattaaaggcgtgagctaccacacctgtccaaaagtcaacttctgaggtggagaataactgctatatgtggttttggatgagaaataggacttagcaacctaaagaagtgtcacgtcaaattctgttgcttgacttccatcaaatctgctgggaatgccagcacactttcactctaattacgagaacaaaaaaggcttaaatgtataatgtactggacctagaggaaaatgaccatcttttgtgatgtctgtgtggctaaattctttcagggagaattcagagctatttggaaccaactcctctcatccatttgacaaagacaacttaggaaggctggttttagctggaaaagtttcacatcaaagaggacaggttcagagtaaacaaaattaataaggaaaaaatggatgacattactgtaatgctgactgtgtgctagacaccactgtcagcactttgcctgtcctcgtttctcactttgtatgataggtacgattactgtctgcatcttacagtgaggttctggggaacagaaagtgacctgtgaccatggtcagaaagatgacaatgctggatccagaataacaaaggtgacatgtaaagtacgagataagatgtgagaagtgtatagtcatcttcctccttggaaatatcagaatatcctggtaatagacatccacatgcaacttaggcccttattcttttgtcagtagatgcccatttgctaattatgctgattagcataatctgatccttacagatacaaacttcttaataccaccacttctgcttggagctctgctgcctggagttaagagaaactgctgtcatccttaaataatgcaaaggcaaaatcaaccaggatgctaaggaaaaagtaatctctgaaaactggctgttgtgatacaaacggagggcaagtccaacctgccgctcctagtaactgttgctaggtaggctgggatggaaaacagcaagctaaagaggtcaatgagaaattgagccaaattcaaaactacctatgaaagactgaagagaacacacccgcatttggagctcattttaaatcatgtaatcaatctaaaggagaaaaggaaaatgactttaaatacacagaatttgttgtgtgccattcttcagttctaacaccagaaaacagagggctctcctgtaatggaatgttcacaccacagtacagatattcagctgcttttatgtaatttttcacctcaatacaggattcctgagtcataaatattttctcttaagaagtaaaagaatgcctcaactcatgtgcatctcctgtttgccttgaatatatatgacactatagtaagtgtccaagttctatatttatggtaggaaatgtgaatggtgtcaccctgattcacctgctcccccaaccccagctcacagaagctgtggtgaatgagcttgacctcactccaaagggctccagaggtggcccttgattcatctcaatcaatcagggtaacctatcccttatcacactgattggtttagataacctagacctaagccagtcagcatacagtgtctccttggccccagagactggttcagaaatgcaccattcaatggagagctcaaaaagttgttgggaactcaggaatgcacactccttgaatttgggtaatgcgttagggagatatgaatctgtaattgctgctctccctttgcattctgagggtagacagcctgaggagtaagtcagtacaccaaaaagtagaaccaaggagaatcctggtgagccagagccctgatcaaaccatgcctaaactccatcccaccatcactcttctgtgagctaataaacccctgtaccatataatccagtttggaattgggttttctgttattcaatgtaaataaacaaacagaaaattgtagctacctgataaaatacgtctaagtaacaccagcttgtatctgtataaaactacataccttaaaaagtttccatatacataatttcatttcttttctgcccagctgagaagataggtattactggtaacccagttttacatcaaaaaggatagattcagagtaaacaaaattaataagagaaaatggaacacatgctgtaatgctcacagtgctgaccatgtgctggacactgccctcagcctctgtgtgtttcctttctccccttatataacaggaactactattgttggcatcttgcagtgaggttctgagaaacagaaagtgagtggtgaccaacgtcagaaaaatcataaattattgatccagagtaacacacaggcaaaagtcactagtctaggcaaggagaaaaccatctccttgctccctggctcactattgctccaccaaccaccccctcctctccaagctcacaagacgtagaaatcctccaaggtgagttaaatgtgttcctgggtgacataaacaatcaacttatctatgtcatgaaattgtgtttttttaagcttcttagccaactaaaccaagttcctacaatgcagcatccgctgagtacaagtgtacataaagcacacttccatatgaccaatcttttcctctctgaccgtagcaataaatacgcagtcagagcccatcagcgcacatgcctcgccgcaaaagatcagaaggaaaatcccttatgcattcaagataatttatggcatggcaccaacatttaacatggtgcacatgaattatttctgagcctttttgctccagaaatgttattcaaaagtaagaaccagcatatacttggaatacctttatttatgagcagccccttcaagatgagaactgcaatggaaaatatggtaggtttggcatcagtaacaacatcagagctggttatgggaatagctcagctcagcctctgaccctgccaagtgcaatagcactgacagtcatctccccctgttaattatcaagtcccagttgcagagaacaatgaactttctttattactttgcctttcatcttaaaatacagttgcaagagcagaactttagaaaaggaagaacacagtttgacagaaattagcagccagagtctaactttaatgagaggttgacaaattaacaactgcatactatataaagtacagtaacgtattttttctcttgttttaagaacaaggaagagccaatgagatagtatatgtaaatgcattagaaaaagataaaaggctttgcgtgtgatggtactggtggtggcttttgttcaaaccgactcaaaatcatccacgctagtctgcaaattaaagcagagagacaaatgatatctcaaaatcctctctcaagtcatcttcattgcaacccctgatcccaaatccttcttcctttcaatactctcttctataggaagacaggaacatacactcatacatacacagttgcaaaccactggggctagcagaaggcaaaggggcaagtaaaatagagaaaaaaggatgctcgtggcagatttttttgcaaaaaatgacaagaattattgatctgcctgtactcattcctttgggtattccccactcctacactgtggttgtacccatgactacctttagccaatgaggcattagcaaatgagatgcaactgaaagcctgaaaaatgcttggacactggggttatcctttcttgccattcttaggatccagagaccaccatgtaaaggcctaaactgatggggatgagggacacaagaccaaatcatccccagctgacatcaagccaaccaccagccatgtgagtccatcttggaccattcaactccagggcatgagtgaaggcaggagaaatccaccaaaccaggctggtccacaaaattaagagaaataatcacagtctgtttaagccactaggttttaaggcagtttgttctatagaaaaaaacctcaaacttgacctgaaacttctcaaaaatgggagaacaagctgagttcaataattattcatggaacacttcctatttataaagagctactgcacaagacactagaatttttaagagattcgaagatgagcaaaatgttttccctgacctaaaggaatttataatttaactgagagaatgacaaacatatggatagttacaacacatgaaggatcaaatatcatcccctcccatctccaggaacagctgtcattccatgtatgaactcattcctccaaacaacttctgcagtaatgtacagccacactgggcctttaaaaccaaccattcagtgttcagacctactgagcaataaacaaaagagacagaaactgtgtcctcatggactttatatcctaatggatgtcaatttacaaaatactttctatattgcaagggcttttcaaagtgctttaagtgtatgtgtgcagacatgcacgtgtatataagcatgtctccacacatacacacatatatatacacatatatatacacacatatatatacatatatatgtgtatataaattcacttagcataagttatctttgtaagtaaatttaactaataatagaactgaaaaaaatcttatttattttatataatctcaagcttcaaatatcagagattctgggagcagaactctgatattgctttatcaacaaaagtattttaggcccgttttgttagaaatcagaggacgagactagatgagactatgggagctttacagaagaatacccaattgtggggaaaagtcttctagcacttctagaatgtaatctccatgagagcagggattctttgttttgctcactgggtataccttgtgtccagaactaggtctaccacataagatgctctcaataaacatgtgcttaatgaaggagggagaaaggaagggagggataaagggagggaagctgggaaagaaattctattatggggagaatattttcaaactcatagtaatgctaggaatttccttctgaacataggtagcaatcctagttaattggaacgttagcatgtcaaaggatgcccaccacctctcatctcttcttcgcccaaaagttttcaaaagtttgaaaatagttttttaaaattacaaaaataaatcttacaggaaatttactgagatcctacaggcatgacctacacatggactgcactaatccacaggagctgaactatacggactcgatttttacaatgaaaaccaaaggggaaagagcactgacttctcaaattaccactgcagccaatttctgcctggatgaacacttggaaactcaatatattatcgtcacatagccaaatgagctctcgagtcagtactttctatctttagaatggcgataactaactataaacaatatgtgtgattatctgaggtcagaagcatcaaatgcccaaagagttgctggtaaggaagctggtaacccatggctgaaagaaatgtctcctccttcatctaaaatctaggagaaatcgatgaccataaataaaattatcccccagatctactcctaggttcaacgtttgtaccaagaagaggtcaagattaactgcatttaggccaggcaccatggctcacacctataatctcagcagtttgggaggctgaggtgggtggatcacagggtcaggagattgagatcatcttggctaacacggtgaaaccccatctctactaaaaatacaaaaaattagctgggcgtggtggtgggtgcctgtattcccagctacttgggaggctgaggcaggagaatggcatgaatccggaggcggagcttgcagtgagccaagatcgcgccactgcactccagcctgggtgacagatcgagactccatctcaaaaaaaaaaagattaactgcatttaaacgagagaggccacaaaaaatgttgtctctcccatgctttgtctgtaggttttccagaaaccagaggattcagtgccctggacaacaggaatccagaggaccgcaggaaacttgttccacaaacctgacccgcctacaagcctgctgagcaacagccccagttacgagagctgcttccgaatccattacactcccaatacacatcttctccacaaaatggaaaactgcaggcagccagagaaaaaaatcttttataggttgccataatgttctggagacaaaaagttcagtggattgattctattataaaacagatataagctggttgaaagcatgcctccccatgaaatttaaactcagaacatcttaagccggaaaagaatcccaatttcattttactatatttcttgttagtcaaaacattttgaaagggttacaagttatctttcatcattgtgctatccacccctgccatggccctgtagtatcctgcctctcctactcccccagagaaggaatatcaagacgccagctcaatttaaacttcagtcatttacattaggatcccatcatcacatggattcaaatatgctccatcctccaaattcagttttcgacaaacattaattgttaagtgtgtaagacaccaaataattccacataattaaagtctaaataaaacaacttcaatccaacttatacaaattgctcactttccaaggaaaagcctctccagctaggcatctgcatgtgagcgcctgcttctcctctcccacccgctgccacaccacagtcaaaagccctgtgcaggcaatgaaaacaccaaagccagccggacattggagccatcaaaggatacgttttcagcaaaaacaaaagggaccttattgattaaaaaatgagaagaataaccaatgctggaaggattcaaacagcaccctcagggctgcgaggaccactttgcagctctgctctggacagacactcacagaggcagctctcccttctgccgcaccatctgtcaaagggctgccagcttggcgctgcagtccaaactgtctgtgcgttattttgaagcacagagctcaaggagttatttggaagccagatgacataccttgagcatttttctttaattgttcataaaacgctggaacagagaaaccaaaacgtatgcaggacagataaacccaaaagggcataaagactggggtggggaaggagaacacaggaatggagaaaaaactggggattcctcctcttaaaggatcacttcaaaaaaatcattagcaataaaacataggggacttgtaaaagccaagcctacaggtacacagggcagggggattgagtagtcactttgtaaaccacttcaaacaccaggcagtcagcacaatattgtagccacgcaaaagggaaaccgatatgaagggtctcaagaatccattgatgtcaaggctggatttatcacaacactaacttcccagttccaagagaatcactgcagtttgagataaatttagccaggatgaaaatcacactgaggcagcattctaacaaagagaccagaaaaacccaagaagagagcttcctatgtgaatggagcagattctgaagtgctggcagtgcagtccagagcctgcatgtggaacacacttgggtatcaaatgtatcagacaaagcctaaccacgaaacagaaactgtttcagtatttaaatccaagggactttaatacaaagaattggttacttagctgaaggaacagctggaaagccattaggaacagtaaggccacccacaaactggcaacagcagagaccagcatcaccctaggcaggaggggcaaaggcatgagggagtatttcccgagggcaaggctatgtcacctggcagaactgctaccacaatgggctggtccttgctgcaggagctggggccttggagaagaggtacctgctgctggggatgctaggcgaggctgaagggggagggcctggtttctctctccaatctccacagggatccaggagcccagaaaagggcggcccacaggggtcagcccacgagacagggcagaacaggagaaggagaagaacagatatgaggacaaggaagcctaagactactctgcatttcctcagtgtgtctaaatcaacactgtcaccccagcactttgggaggccaaggcaggagaattgcttgagcccaggaattcaagaccagcctggccaatgtggtaaaaccccatctttataaaaaatacaaaacttagtcaggcatggtggcacatgcctgtaatcccagctacctgggaggctgaggtgggaggatcactttagcccaggaagttgagactgcagtgagccaagatcgcaccactgcactccagcctgggtgacagagtaaaatcctgtctcaaaaaaaaaaaaaaaattcagcactcaaacttgaaggtacagacccgtcccctggggatcttataaaatacggattctgatccaggaggtctggagctgggcttgagggcctgcgtttctaaccagctccccggtgatgttgatgctgctatccatgctatgctctaaacagcaaggatctaacggatccaaatgaaggactgagctgtacttcagccatattccctccgagaataaaaatgcacaatcatacaagagcctttctagtgggaatgagaaagtaagaagaaaaacatagcgaagagcatcactgggacaggaccgccgcctgcacaacactccctgtcactctgcccactaggtcatcagatttgtatggctcagggctgttgttataggctggattacgacaccctaaaattcatgttgaagccttaacccctagtacctcagaatgtgaccgtatttggagacagagcctttcattaagttaaaattaattaattaaggggattaaaatgaggttattaggatgggtcctaatccaatctgactggtgtccttataagaagagggcatggtggctcacgcctgcaacactttggaggctgaggcaggtggatcacctgagatcaggagttcgagaacagcctggacaacatggtgaaaccccatctctactaaaaagacaaaaaatagccaggcatggtggtggacacctgtaatcccagctactcaggaggctgaggtatgagaatcgcttgaaactgggaggtagaggttgcagtgagccgaaatcacaccattgcactccagcctgggcaacaaaagcacaactccatctcaaaaataaaatttagaaaaacacacaaaaaagaagaggaacctaggatacacacagggagaccaagttgcaggcacaaaaaacaaggccatatgaagacacagacaagagaggaccatctgcaagccaaggatgggggcctcaggagaagttaatctgccagcaccttgatcttggacttccagcctccagaattgtgagcaaataaaagtctgttttttaagccatccagtctgtggtattttgttttggcagccctagcagattaatacaaaggtttttatttttgtttcttgatactaacctaatcccatacattctcaccgcatgcctgctctgtgagaagcagagtgctaggagctggctcgcggaatgataatgagacagtccttggccagatcctgctcctgtttttctgtgtgtaagagttggcagaaagaggaagaaaccaataccacctaactcagaggacaaagaatcctgtggcagaagcaaaaccaaatactgcagaagcacaaaggaaaagaaaattcatcctaactgggaagtaggggagaagaggagtgatcgggggaggcgggcttcaagatggattttgctagaggaacggaaaggggacacatcctgaatgaaggagtaacacaggcaaagaccacaagacaccaggaaacccaaagccccggtgcacacaccaaccagcagcagggcctctggcagggcggggactccaggggtggtgggcacagaaagaactgtgctaggacagatgataccgacaaggagattagtgcctgtaggggccaggcaaagaagtctggactttagaaaatgaaaagtaataaaaatgaggaaggcagactaaggggcaagagagtggagacatagagtacagtacagaggataataaaactctctctcattacctaactgtctaagacctgcctcattaagataaacacatgttctactgtcaactactttcaaaataactcagaacttaatgatgtcttcctctgttaacttggatataaggaagaggttgccatccgctgtgatttccaagctgggaagtagggtacgtggcagttatggatgagtgccatgacccagtgagtcagaaagagaactgaagactaacatccaagttctgagttctgcagatcaaagcccaaggctccagccacgatgaccatgttgccaccagctctgctgcagtcagtgcctgctgtcagagctcacacccaccccacagtctttcacttcccctccaccttcattcaacaggaccgtggattccactcacgcagggcaagggaagccaccgactaggtagagaaagaagggaacaaagtcactccctgcttttgagtatccaagagcttaggatctggtgatttccagggaaatttaaggaactttcaagagcaattctgacttcaatggaccttctccccacccactgacttcagcctcctgcccaccatgagagggggtttgtacagccactcctcaggatatatgccaataaaccaacctcatggctcataactcaaacagggaatatgagcacacagctcaggaaactgccactgagttggggtgggttttatgcgcattactggaacaatgactgactgatgtaaaacgctaacagcagaaatacgggaaaggatacagatacaaacccatcaactaacaatcaatttctaaagaatgtcttcataaaaacatttgagtagctctcctcttcaccttagtcttcaggcactgtcttccaataagagtttaaggcagcccttaaaatatcaaacacgagcagaaaatgactacaggtttaaagcacaaatactagcagaaaagtctaaaacaggcttataagatcgagaaagggaaaaacattgaaatagcattctcctttctcataaagtttaacacctagcatgcatcacatttttcccttctcctatgaaaagtcataaaaaagaaaatagttagacttattttttaaaaaagcattggaattggaggagaatttaacttcaggacccaaaatcaccttctgagaaaaagcataagaaaaagttcaggctgtcatagttctcggtgtggataccctttacagaaacattataaaagccctactacattgacatggagggacgctgccgcagcagcagaagagacggagcttccatcttttcacctcttgcagcattgcctcctgtgctaatgggcactatgtatactaaggacttttcaaatagctaacggtttgatttctttttttttccttaagtaaagtagattttagtcctccctctttgacaaatttccagagcaacattacatggtgcatgaaaagtcaaatgacttgggcttcaggggctgaggcaccaacacctcttacagggaatgcaacttaaacaacaacaaagtcacatatttggtgaacttattccacatctgactattctgaaatatgaacgaagtatttgctcagtttcctgcacaaaaatctctcaacaaagaaaatactgcagaagtacctcaaaataatatgacattatcattgtaatcaggagaagagaaaagtctgaatgcagaaaccctcacttgttgcagtacataagaagctggaaaggccatctctaggaccatcacaacctaccaccatctaaacttaagcacaacctctgatctcatgagatacaatctttctaacacctggtcaagccaagttgcctaaatggtgcaaggagaacattacataatataatgctgagcctgcattctgaaacagttgtcagatgcagaactcacctgcaaatccaaggctgcagaagtttaccctgtgaaacagtaattaggtgtgccattctcacatgaaggtgatccaccttaggattctgccaagacattctgccaagactcatctatctggtctcatcaatatcagatggagatttttgttctttgggaaagttttacctcaacagatgtcaaaaacaaacctcacattgaatagcctctgaattcttttctcttgtgcacaaagtcagccagataccatcaaagcacaaaactcaaatttgtgtctcaaacctggtatggctgactctcaacagatgacagaggttgtctgccaactcagcaaaaaatgagaacaaaaagaaacttgtattttgaagcattatgataaatggaggctactgctgacatcttttcacagcaagtcttgccagaaacacaggccatcccagtctagtccttgagacatgcagaaaaatattttgataggaaattactagctttgaaatttctgaaatctagccgtgctttgcaagcatattctataatattgccacgggaaatatttttttcatttaatatgttgctttgatattggctttaacaaaagcagaaaaacaaagtgaatatccttgaatattaaatagagttctaatatgtgctgagtcaaaaatggaaaaacccctaaaagtaaaggcaaacatcttaaatatcaatataacctgtacatattaaaacacacagctataatatctaatagccttctttctcactcttcaaaatcaaaccagaactcccatcccatgaaagtcactaattggttccagtgatcttaccttaacaaagtatacaactgccatgtttggagattaaaaaaaaaaaaaaaagttttaccagtttaatccaccatagtaagactaaacacatttttctagtccttactttcaaaatattttgggtttcattccacttatttgtccattccttggtcaattcttgaacctgaaaagaaaaatatacatacgtgactgcttcataaagaaagtttataattttcttctagtttccgaactctaatatctcatggaaagatgtactataattttttaaatgagatcgcgacttttacccctgaaagaaccatcaccaaagataaatcaaacaagctgatttattcctacaacctacattagggcaaaggaaagaacagacagaaatttgtcaatttgcctagaatttcacaactgcctttttcatggtgtacttaaagcagctcccttggattattaaccaaaattacaagtttgaagatgacaacgtcccattaaatggattaatttttcattattatacatcaggtcctaaaaaatagtgatttatttttatttctaattagatgtgattaaatcaccttggatgctgtagttttactttaggagataatttgcttttgtagctaattaacagggcttataaacctcattctatctttttttgttgttgataaaaaaagaaaaaaaggtggttctttaaacgactcttagtaaaagcaaaaatcttttgacaaaaatcacttctttccagttggctctaacttaggggagtaaacacgctcaaccgctgaacacagcacagttggaaattgcttctcaaagttaatggtaatgttttgttagttccctaaaactttttaaatgatcctaggattcaacaggaaacaaaaagtgatatttgagaggtagaaaaaatatgaatgaaaaatgcgttctgtggaaaggaagagccaaggtctataggagagtagcttcagaaaggggagaactcatcctttccaagccttttcctttcagcacctttatcattcctgccacctcctcactcccagcagcagacaccctcccattaaagttacctggtctccccagtaagtttccctatttaatcaggccaaaataaatgcacagaatacatctgcctgtactctcactgctaagataaactgattttctatatgccattaagcatagtaactggaaagggtattcaaggcagcaaacttaatgaaagaaagcatcagttattgacaaatatctgcagtgatggtttatccaagaggaaaaccaaaatatatctcattcacctatagtcaatcattcaggggtcctcaatttacctcaaataagactgtgggaattctaggttaacttaaagaaaataataatgttgcttcttttactacttattagtgccaaaatctatcaccttcttgatgaaaaacaaatgaaataggaggaagaggctccctaactctgtgctttgcttgttttcttgttgttgttgtctttggttttgttttttagagatggggtctcacactgttgcctgggttggagtgcggtggcgtaatcacggctcaccatagcctctacctcccagagtttgagtgatccttccaccttagactcctgggtagctgggactacaggtgcacaccaccacgcccagctaatttttgtattttttgtaaagaggaggtctcatcatgtcacccaggctggtcttgagctcctgggctcaggcgatcctcctgcctcaacctcccaagatgctgagattacaggtgtgagccactgcacctggcctgctcgttttcactggtgtggtaagactgtcctgatttatcttaaaccagttctacactccagtccttcatttcatcacttgagtgataccaaccctacagactcctgatagcaacaaaagtcatgtgactctcctggctttttgttttgaaaaagctttcagagaaggaatattcttatgccttctctccctacagatggggaaaagactggtgtactgaattactaatttatactcatcagttaacagattgtcattggcaatttatgtgagaacacaaagcatccaacaataaatgattctgcatttcaccaacagatagtttctcatcgaagaaatgtgagcaaatcaatcctgtttgaattcaagcaattctagcttagaaaaagtaagcatgccttggatttattttactgttgcatttaaacgaaataatatccatttaaaacattaatttaagaatgcaaacatgtgctactacttctaacagtgggatcaggtgatgagatttatatccaagcaaattgcaaacaattaaaatgggtcagcaaaaaactagatgataatttagaaaatgttaagaacaagataggcagtcatttctgtcacagcatgtataatacatccaaattaatacgtttattagtttccaataacttatttggtattcatgaaaactattgttaagaaacaatttaagactatatccagatatagtttaaattatagcactcaaaattagaatttgaagcactaataaataaaatttcatttaaaaaatagggattaagaaattaatgttttactgaggctattatcaggatattcatcagcataattatcctagatgtgtcaacaagttcctaactacaccccaatttttatcttccataatgtgtattcttgaaaaagcttttacaaacagaatccaattctttttcaatctgtcttagccattcagcaccatgaacaaaattgactccaaaagttgttctaatgtctgtttctcttttcacagaagtttaaaaaaaaaaaagtatagaaccaggtcagccataaaactggtttttcaaaggcatgggcacacacattggctttagcccataacagctccagatctcttctctctttggttactcactgccagtctctcccatctcaaatctcatctagcttcacagaaactaagcacctaactagagtaatcagagattcctcaagtgccactcttcccactgggaacaacaaaaagctaaagggtggtcattgttgaggccatggggaccactactgtttcatgaatgttgaacacagactccctcaaacagggactccagtcagctctgatgacctgagcagcctcactgctttgcaggatctgcatatccatttaactaaccatcatgtgccagacaaatcccgtttattaaaccacagagaatgtgctgcaatacataaaatgtcagctatcgtgcttcttcaaaaatgatcaccaacgagggaggaggctaagtgcaataaagaaaaagaaggcatctcaaacggcaagtcctaaaaaagcatgcacttaaaataatagtaaaagttatgatttaaaaatataagtcaaagtatcacttactcttgcttcattctgctgaagtttttcctccatacttaaagctgtgggggagtctaagagggcaatctacaatataaaccataaaagaaatcagcaattaataaacagcaataatctaggtttttccctgaatatagtaaattatccaaaatttcacagaaactattaaaggtaaaaagcaatgtcctacaccctgccaaaaagtgttgaatatcaccaagtctttactccacgggatacatctctcataatattcaaaaccatggcatcccagtaaacctacatttgcaatacaaatcagcaaagcaaaagatgtaacatattgacattttaccaaaatcaaacacagtctaaatccctagatcttaaggattcgcctcttttaatatgtacagagtccaacattcaaaagggaccatgcctaagtcttgcttaaccgcaggcttctgagatttgctcttactgatacatgaaaatgaaacgcatttattttcactgctgatggtataccccatatggcatggctacacgacaatctctgattacatttccttatccctgtcgaagaagtgtaaagattgatgtgagaatgataaataccaaaatcagtttaaaactgagcaggacaagcagacagagacaagagagggaaacggaatcaggctggggcttaaactgcactcttaacatgtgagtccctgacctgagtggcagggacactgtgcttcctattctgcctccttttctcatggcctaagatatcccttggaagaaaaaagaaagagaatatccctcctatcctacccgcaggcaatcactttttcccaatttggttgtgtaaacttacagttactctggtcatatgcaagcgtgttttttgtcgtgtttttaaatataagtggcataaaaacactattctggacattgcctttttaacacaccaatatatcttagagaaaattcagtaaaaataaaaaactgcttcactctttttaacaattccaatttaattatacaatattccattgtatagatttctatgattcatgttagtgctctcctattaacataaatgtggtattcttaatctttcaggaggactatccttatgcccactgcctacagtatgcatggctctatgaatagaataaattcctagaagaagaatttgtgagtcatctatacgtatggtttttattttttataattgccaagttgtcttccccagagactgtagcatttttttaatgactatttacttttcaatttctcatcaaacaaaaacacccacaaggtgatcttcttcggcactgttaaacattcaaactatgaagactaccatgggccacacctggtatctgtatactgaacgaaagcagagctggccagaaaggagcataagcgttcgtcttggtaggcaaggtcctcgtgacagtctatgcagtagtcctcagagatgtccccgagctattgtctttggccttcctgagtaaccattcatacgtgaggggtcgagattcacataggcgtctgtgggacccaccctggttagaagcccacacccacagaacccagcatctctttcaaaaatgccaaaggcacatcctccaggggccccacaagggacacaccctgttacaagagtcactgtcctccaggaaacccagagctatggtttctcagctgatattaatagtacatatgtagttcatcctaatccagatgtaattcaccagttaggggtcattttcgtcattagggatgttgcctagttagacaggtgtcatcccacttttatctggtttgcatagaatgaagccagaaagttaacccaaggtcaaatccatcctcagtaaagaaaagggagctttgttagcatgttactacaatgcatcattgcatctaacatgttgtcttgcacagagatggtacttaataaatatttttcattgaagacatgaaagtggcagatgttagtattactgcattgtttatatgtggttgacaattttcaaaacaaatagaaagccctttataacgtgggtaattttacagaatccattgttgagacttttattgataatcaaagctgaaacagttctgccacatcatcaagtcaggagacaatcacggactgaatagaagcacaaagactcatgaccagcaccccttctggaacattatttttaagcacgtgtaaagaacgaccttcctaaatccttttaaaagaaatcattggtaaaagtaccattttcaattaaattactatttgcaaggtgtatctttagaagaaaagtgtttcaaatcaaataataatcagattaagttcatacgttgttaaatcaaaagtaacactacctcaaaaacactattacaaaagggtagtaatagcagttctactaacaacttatacaagcaccccttgcctcacaccctcatcaatatactgtataatcaattttgttctttgcccaacaggtgaaaaggacatcctgtttttaaagaactttgaggtatcatctacatgcagccaaatacataaatctaaggtccactgcttgatgtacccacgaacatgtatacgtatacccatttcactattcttaaaatctgcatttattgtatttcaatgacattgaatatactttcacatgtacagaaagcatttgaaactctatttctatggattgtgttcacgtcctttgccccctttcctgctgtgttatgatgttgtcttatgttttcaatgaacctcctttcctaacataaaaggtagtcttttgttgcatgatcagcaatcttttccctggtctgtattggttagagcaaattttcattatgttatataaatatgctatgttcttacttttgtctatgtgagctttcacagaatgagaaagaagagttaaaattttctgtgacaaatgtgtgtggctttgtctcctgctatttcgaacagttttgttgtttttttcaattacgaaagttgatatcatgtctgattttaattgttagttgcaccctttgtcgtgataaagtgctcttttttaaagctcacacaatgctgtttctgcaccgctttctttcctcttgaattcactggtttgtccattcttacaaacaccatataattgagttttactttgtgaccctatctgagatgtgtcttctttaaaagtttacacatgatacttttattatttaaaatttatctttaacctcagctacaagagtgagtaattcattctactttcatcttccctttcccatcatcttctttgcttcccacctttggttgtgtttttcatttctatactgtttgatttacttgttgtctccagatacattcaagagagatgaggaagtcaagagacattttctctctgccaaattaaatgcagaaatagctgaaaatacatttaaatataataaaagagaataaaacctttaaaaaagaagatattcaaatactcagcttcatcaatcgcctgagaagcacaaagtaaaattattctatgattctggtatatatccattaggatggttacaatgaaaactgtacattatcaagtgttgcaataccaagaattgaaccagcacttttatacactgatggtggtctattaactggcacaactacttttatacaccaagaattgaattcttggttcaataccaagaattgaattcttggttcaataccaagaattgaattcttggttcaataccaagaattgaattcttggttcaataccaagaatttaaccggcacttctatacactgatggtggtctattaactggcacaactacttttagaaaattgcttggcaatatctactaaaactgaacatatgtactcctctgactcaccaattccacttgtagacataaatctaacagaaatgtatccatatgttcactaaaaacatctagaggaaagtctacaaagcagtaacagcccgaaataggaaacccctcaaatgcccatctaaagtacaatggacaaatgagctggaatatctttgcatgatggaagacaactttgcagtgaggataaatggatccactactacatgcaacagcatgggtgactctcacaaacataatgttgactgaaagaagtgagatcaaaagagtgaatatttttcattatttcatttatataaagaacaaaaacaggcaaaaataaaaactaacaaagcctgtagaggtcaggagagtggctaccctggagagaaaggggagtagttcctgaaaagaaggattaaggggggcttcaaggatactggtactgtactgtctcttaagaagcaggttagatgggtgaatttagcttatgaaaactcactgaactatacacatataacttgcaattttgggggataatacgtcaataaaaaattcaaatatataaactactacatatatctacatatctagatctacatagtagaagaatcaaatacatgtcaaaaccttttgctttactaaaaaggtgctttaaaaactctgatgcacatgactttttgcaatgggaaagacagaaaattattaaaagtagaagttgatttttatttagctgtgcttaaaaaaaataaccctagaaatggaactcagatttgaataacattctcaatgaaccacagcagtacctggtatagaatattctaggaatagagcaatactcccagaaaaatgtatacagagatgtttaatggacatttaagaacacctgctgtttttattaagcttcataaatttaattaatttaggataagcctatattgtctcaaaacaatttacagcttcatagcacgataaattattttaaattggattcacatttttattgtaatatattgtatatcaaaaattttatctgcaatgcgttctgaaatagacttaactgtcttttatatcctcacccccaaaattacagcaacaaaaatactcccttaaacacagcagtggtaataagtcataaaaggaaaaggaaaaaagactacaaaatataaggcaactatatggcataacaatacctctgaaggcatttttcagagagaaaatgtaaagtttcaataaattaaaggtttttaatctatataagattccttccaatgatgtcctcagttaattttaaaaagataatatttttacccttcattcttttaacctaataaaaggttaagcacaagaaactgcacatagaattttccaaatacttccttcacatatagtaatttgagtgatccaatcaaatcatcattaaaggcttactttatataaacaatgttttaaaaacactgagaaagatgccaggctgggcgcggtggctcacacctgtaatcccaacactttgggaggccaaggcgggcagatcacttgaggtcaggagttccagaccagactggtcacgtcgtgaaaccccgtctctaccaaaaatacaaaaaaattagccaggcatggtggcaggcacctcccagctactcaggaggctgaggcatgagaattacttgaaccctggaggtggaggttgcagtgagcccagattgcatcactgcactccagcctgggcaacacagtgagactctatctcaaaaagaaaagaaaagaaaaagattccaataacaaggtgtataaataaaaatgactattgtggttcatgttataagggcctcatcacgtggagctggactcttcattctgacaacttccaccatagagcaaaatgcatgtggagatatttttaagcacaatgaacaattcctattcaactgctgtccaccatcttgtgggaaagaactgccaggtacatttcaggacacaggaaattcagtgaggttttcatcccatcagtattttcaaaacatttatgggatgccaagagcttcaagtgccacataatcccacgtggaaagcactgctccaacgggaccactctgcacataaagaaaagcatttcttttcacgatatacttaagacatccattcatgagttaagaaaggagggtaactccagtctaacttcaacatttaaaaaagctatccttcattttctttcaagggttgcctttcttcacagcaatatcaaagcctaccagaactttacttccaccaatcatcacggaatgtaactctgtacatacaccatgcagactatcaggaagcttactgagaaaatcacaaagacaaggaatcttcactagaatcccaacagatcctaaaatgagactatttcaacaatcaagcgagggcccagggacagcatttcagccagatcacaggtgtaatatacatgtgtcgcggggccaccagaaccacctctctaataggtgatatgacacaggcattcagaaaggtgttcaaacaagtcttttattctgttaaaacacattttaaagtcataaaatgcatgggtgaaattttaaatactattctaagcatatcaatttctttccacttaaagagattatgccattaatcctattgcatagtacatttccattcataattgataactattagagagttaatcatttcaggtttagtggataaaatcttacacatgcagcccgtaatgaatgcaaaggctgacaagaggttgatgtaaacgagggactggctaactcattcaaagctttacttagcacttatttactcaaatcaatagcatgagtgagaaaattgtctcattaagatctagaaatagatgccattactcaaagaaaattatccataaatctcagaaaaacccaacctgattcccttgagcaagcagcgttttcagtctggctatttcagctcgcagctcacggataagtttgacgttggcatcctcattaatggtaggcttgttgatgatgtttttggctctatttgcatagcgaagagtacttagggtttctccataattgacatcagcaggtgaaatggctgtgaagaatgtattcaaaaaataatttatccagcactccatgttccatttaacacaaagttggtttgtaatttaaaagtcagattaaccccaggtcattggagagactaaatattcattgccacagtaatgaatatgaaaaattatctaacatttctaggaaagagtgttcacaatacaaaattaagtgtcattttgctcttctcaaatctagaatcaaccacctaaccaagtctaaaatgagatatgagacattcccctatagttaggtagttttccctgctgaaaacgtaagaagaaggtttaaagactatttgtcatctcaacattaagtaggaattcaaatacttttaaaagttctggcaaagtctactgtctggaaaaaaaaacagaatatgataagttttgaaaagggtcacaaatctatccattctcttcttaaagcttggttaatcttacccacctccaccactaccactcaactttaaggattaggtgactatacaaatgcatgtgggtgtacaaaccagggtaaatcccgtggctccatagttagcacatggcatgaagcatgggaagggcatgaagagaggggaagggaagaggaaagagaggaagagggaggggaaagtagagtcagaagggaaacaagtcctgacttctcccaaacaattatctcccctttctacgtttttttctctattctgcttctttcaattattggctgaaatactgacataaagtatactgctgttaccattatttgttttatgcattgggtttttttttcccctcccaattcttacttttaaattccgcatttactgccttaaataaaaaaacaaagttgggttattttgaccttgtgttcctatgatttttctcctatgaggtaaatttctaccttgcactttaagcaaagaaaagctgaaaagtcttcgtgcatgttatcacagcttccaaaatatggcaaggtggtataacagttaatgatgatactatagactggatcatagcaggatcataggaggtgattttcctcaagatagaaaaaccattacttttttaagatgtaaaaggtgctatttcctaataagacactttaaacttaaatatttacagttaattcacagaaaatattgtatgctcagaaaagtaacttaaaactcttactggcaatcatgatagttttagagtttcctccaaggctatcttttaacaaccaagtcaacacagaatccctgtaaggcacgaaaacttgcttcttctttgcaagagtatttgcagcatcctgagataaatcagctatgaaaaggaagaaacaaaggggagaaaggacaattagtaaaattttttttcctctacttttgcttcataaaaccttgaagaaattacctcagtttgcaacccaaatattacacatgaggaaaaagaggaggaaacagaggaggcaggagccaggcgtaagcatacctaaggcagaaatgacgttccccagagtcacgagggacttgttaatatttcccccttcctttagcctaaccccggtggctccggtggcatctgcacgctcacttccggcaagatcaaccaagtggatcttactgacggtttcacatggcatttcagaatcaaatttagcctgtggtaaaataaaaaagtaaaattgaagaggtgcaaagggccctgatgttgttgatgatatgaattctaactattttctgctcctcactgagatctctcagggtagatatttttcaattttattgttttactggccttcctactgattacagaaacttctcaaatttaatccaatgcaaaagaagttactgtatatgattcttaaactttctaaagaagcatttcattctcaaccaagccctgctgaatcaggctgtggcagaacagaaaactaggcactgagtggcactcagcagagaaatgtaagtaagcaaataataatttttattctcatctagaatcccagccttccaagaacaaaagctttccaaaatatgatcaatatagacaagtacggaaaagagcattcaaccattatcggatgttaaaacatcttgttgcacaaattatttcttttaatgtaaaatcttaaatactatattcctcgcttctgaattctaccaaaattttatattcacaaatacttctgatctatgtgttacattttgaaccaaaatgcgccccccgccagattactatatttttatagaaatttaaacctcttagaaatgagagatggtggccagacccagcagcttatgcctgtgatcccagcactttgggaggccaaggtgggaggatcgcttgagcccaggagttcaagaccagcctgggcatcatagtgagacaccatctctagaaaaaacttaaaaaaaaaaaaattagctgggcgtggtgttgtgcactgcagtcccagctccctggaaggctgaggtgggagatcacttgagcccagaggttgagactgcagtgagccgtgatcacaccactgcactccagcctgggcaacagagtgaaatcatgtctcaaaaaaaaaaaaaaaattagagatggtaatatgctaatcaagcactaaccagaaagcaggagaaaaaccaatcaacttgagtaaatctaaaggaaaggtctaacagaagattaagatgtggagaatttaatgcaagttgttctgactggccttagaaaactcatttttgtgctctttgatctccctcattaataaaatgctgcctctttgtatctgatgtgtccaactgttaacccagataaggacatccccaagctcctagcatatacttagaccctgacaggaccctacatttttgcattcatctattctactggcctcagtgttcaaatatttaccctcaataatttccacagatgttcaagatgctctccacctcttgatcataatgaattcttacattagtacttataaatattcgctgccctttaatatcattctaataatcatcatcaacacggcaagatgagtgccatggagcggtaatgaactgcactgagttactcaccttggcttccagctggtctgactcgcaatccattatatcccacagagtttgcaacaatgaaaacttttgcttaattaagcacagagcaagttgttttatgtctagaacagggtggaagccttctaagtatttcttaagggtacacatcaggatatttcaaattactgtgattgtaaccacagagaaactcagcgcacagcacatgttcaactctaattaacaagaaaatgacagtcagtcacctttacctgctgctgctcctggttcaacaatgatcagtcctcagctggtgctaatcagcaagtaaagacctcagggatggagccagctggtcccgcagcagcccttacctgagtgaacttgatggtgaagatggcatgagacctgctactgacgtcgttcatcccagtcgctgcggtggtccggttgatattgcccgcatccataagttcttctacgtcaccataattctgtactaaatgtttggataaatctgaaaaagaaaatggaaggggtgaagaaatccccctaatatataggaaatggaatacaaaattaccctctatgaaataatacacaactccaaaatctgctgacctgtctgaagacctcacttgtctctctagggtggtggtatgtaatgcagacctgggagctgggtggctggggccgaatcccagctctgctgcttactagccgtggacttacatagttatggacaaactgcttcacctcactgtgcctcagttacctcacgtgatcatgtgtacctaccacatagggccacggtccccaactttttcagcaccagagatcggtttcatggaaggccatttttccacagataggggtagggggaacagattcgggatgaaattgttccacacctcagatgataaggcattggttatattctcattaggagcacacaacctagatccctcacacgtgcagttcagaatagggctcatgctcctatgagaatctaatgccaccactgatctgacaggaggcagagctcagatagtaacgcttgctccctggctgttcacctcctactgtgcgacccacttcctaacaggccatggaccagtaccagtctgcagcccgggggttagaggcctctgacatacggtatttaaaaaaaggttagctattatattatcatcaacctcattcacattagtcatagcacatacaagaaaaatgcaaaagcactgccttcatgcaaaacccaaaagtgttttttaaatcattttaacaaattattttattaacttttttggaacattcatatggttctaaagtcaaaggctacacagttacactgtgtaaaaggtcccccgtccctatgctatagctccccacttccccttctgtcagggaaccaaatgttacatacccttctagaaataacctatacatacacaagcaatcatatttatatataattatctttttccccttacatacaaatggtagcatacaataagcattagtttgtaccctgcttttaaatggattaatacattaaagaacattctgtatcagttaaggtgtttcctcattcatttttaaggctgcaggggattggatcatatgcatgtaccacgaccaatttaaccatggagactacagcagttgttcatattttgtttccaattatgagtaatgctgctacaaatcaccttgcacataagtcttttcaaatgcctgtgaatgtttatacagaataaattcttagaggtggaatttctagacagttgaaattttgataactattgcaaaattgttctccatagagggcaatttacacccagcagtagcaaggtataagagtgcttgtctcccaaaaccctccacaatacagtcttatcaggattatttacatctgccaaagatgggtgacaaatgttacctccaagtattcttattttgtttttcttttactatgagtgaaatgctaagcattccttcctgcatttaaaaatcatctgtatttccgtttctacaaacagcctagtcatacatattctttgttcatttttctactggttgttgaatctgtccttactgatttataggagctctttatatagtaggaaaattagtcctttgtctaaaacttgaattcaaaatatttttcctattttgtaattaagctttttactttgcttacagtgtttctgtcaagtatgatgttttattttgctattctttgtttaaccatttcaaatttaacattgtttattttatagtttctgagttttaagtcaggtttttaaaagccttctttcctccaggtttccgggaaaaaaattaacccacggatttttatagtcattttattatttaatatttttgcacttaaatcttcaatctagttaccatttatcctggtgtaaaactgagttgtggtgccaatttacttttttttcctcctacacagcttaataatccctctaataatttccctaaggtttgaatagcacattgattataaactaaattcccctaagtatctaggtcagattctggatgtttgctctgttttgctattctatctcttcatacaccagttttatatgttttaacatgtgataagacacttgtcagaaaacatgaaggcatgagttaggctaaaaactcttaacagtaatagctataccacacaccacagaacaactacatactggcacaccctgctttgctttgggcatacaaggcaaaagcttaagtggaaatttattaaaatacagatgggccgggcgtggtggctcacacctgtaatcccagcacattgggaagccgaggcaggtggatcatgaggtcaggagttcaagaccagcctggccaagatggtgaaaccctgtctctactaaaaatataaaaattagccaggtgtggtggcaggcgcctgtaatccctgctactggggaggctgaggcagagaattgcttgaacccaggagacagaggttgccatgagctgagatcacaccactgcactccagcctgggcgacagagcaagactccgtcccaaaagataaaaaaaggaatacagatggggtcctgttgttatatctggtatctcccaggaaaagaagacaaccaaaaccaggaagaactttaaacctgtgaccagttctgtcctgcatccacaaagacacaaatgaagaacatgaaagcacatctctatgtgcgattcctgcagtccagccattctaagttgccttatacagaggtggtaagatcagcttcattatgaggacagttttaaatccagccgattcttaaataattagcaaaggccaatcctgtactcatcattgcttgtggcattcctcacaactgactgtgccacaacgagcgtatcacaacacagatgctgaaacccacagaggaaatcctccaaacacacttccgaagacgcaagaggttcagaatatctttattgtcatatatcaccattagggtcagtaaagatacactgcaaaaatgcaatgccatttagagagacagattgcaggtttgcttaccttgccttacatttggaaaagaaaattccagagatttcttaaagacagaggaaatctattggtaagcctcataaaatcaacggatggccagtgaagtataaattcactaacggaacatcatgtagtgacagctcatgacattcttactataataaaattccaaaattaaataaatttttaaaagctcaccattatgctatattttttcattgaaagtgttatttttacatagatcacaaaaagaatatggctgtgaaatatctactcttaccctcaacataagggccttctttgggatgctcacggactctcaaattgaaggttttagatgacttccgccgaagtagatctctcacacgttcgttataaatttctaagtagctaaaaatttaaaataaaattgaattcagaaaaatgatttcagacattaatatcagtaacaacacataacagcagcaacctgctgacataaatggccacagcagcagttaccatttatgagtggtgactgtgtatcaggtacaatgagtcctcacttaaggtcattgacaggttcttggaaagtgcaactttaagggaaaggacatacagtgggtcctcaaataacaatgcttccttcaacatcatattgctataatgttgacgagaaaaagaactggtttcattatatgttgtttcacttaaagtcacgatttccaagactgtatcaagaagcgacattaggccaggggtggtggctcacgtctgtaatacactttgggaggccgaggcagatggatcacttgaggtcaggagttcaagaccagcctgaccaacacggtgaaaccccacatctactaaaaatataaaaattagctgggtgtggtagcggacacctgtaatcccagctactcaggaggctgatgcaggagaatcacttgaacctgggaggtggaggttgcaatgagccaagagtgtgccactgcaccccagcctgggtgacagagtaagactccatctccaaaaaaaaaaaggaaggtacattaagtgaggacttcctgtaccatgctaagtactagacatggattatttcattgaatctccacaatacccagagataggtaccactactatcctcattttataggttaggcaagggaggtttagtgtgattcaaataacttgtccaagaccacaaagcagtcaagtaggtgtaaaaatcctatattgccatgtctgcccttgaaactaccgaagagactggctcccctcacaggtttaatttcaaggaggaaaaagcacctcaaccactcagatttacttgtagattagatttataatgatccaaccaacacaaagaataatataaaccttactaagctaaaagaatgaagcaagtaattggtatacacttaaaagtcagaagctcactccatttgagatgaacatcccacattagtttctgcccaagctgttatttctgccagctcccaaatctttatccaaactgtacccaagaaaatcactaaaaacttatgtgttttaagctttatccccaaaccataatcacaggaggggaaaagggaagactttttctttaggaatctaaagaccttatccatttccagcacctaaatgcaggccaaccagcattgactctaatcaagctcacacacagttacccaggccacaggccctacctgacttcagttcgaaaagaagcttcatcccatctggtggtttcatttatccgactgaagagtccttcacagatccgaggtattaagccagaatctccctgcatgggaaagaccaatgtcacagctgtcactcaaaataaaagcaactgatgactgaatttgcaatttgctggcatgaagttagactcaagtgacctgtatgccaacccctggcctaccacagcccacgccatataccccctccagggctgctttctactctctgaaatgagatgattgagccttctgatttatacaggctgggactctgataatatacggttatcagttgttagttaaatcatggcttacaaacaaggaaacttaatttctaacatttaaataagacagtttataactgtacaataaatgttaaaaatacatgctcaaatgaacaaggtaggtgaaatacacaccaggcaaaaaaacaccaagaaaaacttagcaatccccacggtagttaataattgccttaaaaacttaggtaacaagaccacattaaaatccatgctggccgggtgcggtggttcacacttgtaatcccagcactttgggaggccgaggcgggtggatcacctgaggtcaggagtttgagaccagcctggccaacatggtgaaactgtgtctctactaaaaacccaaaaagttagctgagtgtggtggcacatgcctgtaatcccagctactgggtaggctgaggcaggagaatcgcttgaacctgggaggcagaggttgcagtgagccaagattgcgccattgcattccagcctaggcaacaagagcaaaactacgtttaaaaaaaaaaaaaaaaaaaaaaaaccacatgctatgtccctcctttgacagagtaacccctaccctggccttcctcgatggaaaattttaatacaccatattatttatacaatgtgggtataacgttcaataatgttcatgtttcagtcaaccttaaaaagctgatgaacctcagaatatagtaaaaatcaggcaaaatgatcttgctaggaaaccaaggcagagcatcaatgctttattcacatgttccctccctaccttcactcaacccccacacccaaaaaaataaaagaaagcatgactgtgttcagagattgttttttctttgtaccattaaatcagtactaattcttaacaaggaaaaatgagtcttacgtcgtatttttggttcttactttaaaatgaagaaaggatacccaagcagcactcaactataagattggagaaaaacacttgtaatttgtgagtgctttataaatgtttgacttacataaaatagttactagggaatcaacatacaaatttcacttttggaagttttgttttttttttccaaaggcacagtaggaaaggaggaagtgagaagtaatgataaaaggaaatgtgaaactctcgaaattagctgtttgttcctctcatttgttcttcccttttcggagaagacttcccgaacagcacttactgacttcttgtgtaaaggaagagcctggatgtaagcagtgaggttacatgtcctgaaataatttattctggaaagatctgtcttctaacacacgacttccatgaacctccaaaccttcagcattacagacaccacatgtgtgccagcaggaagccctcaatcatcttccactagtgtctctacatctcaaaaatgccacaggtttggcaggcaatgaacagagctctcactaagaaataagaaaaaaaaaaaaaaaaaaaaaaaacaggccaggcacagtggctcacgcctgtaatcccagcactttgggaggccgaggcaggcgggtcatctaaggtcagaagttcgagaccagcctcgccaacatggtgaaaccccgtctctactaaaaatacaaaaattagcagggcgtggtggtgcacacctgtaatctacttgggaggctgaggcaggagaatcacttgaaaccaggaggcagagcttgcagcgagctgagatcgcaccactgccctctagcctgggcgacggagtgagattccatctcaaaaaaaaaaaaaaaaaaaaaaaaaaaaagaaaacagaagaatgatctaaatctggagaaaacacagaacaagaaagttcttgcaataattcctagtttttactcctctgtattttggggcaagtataacattaatatcagttaacttacatagcttataaaactgcatacggtgtgtttataaatatgtaaattatataaactatataattctaactttttaatgtattttcaggatttatgtagtacctttctatcaaagagttagaattttttttacatttttcttggggaaaaatgttttgaataattttaaaaagaacagacttcagtaattttattcaaactgttgtgttggcagaaaagaagaataaattacttacgggcccaacacacttttttgataagattataaggcctttaaaaacagaaaatgagcagggacttgcatccattattcatgcttatatacttaaaactatttctaatttaaaatctctcaaaggaaatttagtccaacttattactgagttttatcttattactaaagaataatcagaacatgaaaagttagtacagaccaaatagataaaagagatcattctaccagtccagagaaagataatgagaaatttccttcccacacagtataaacaacgtacagaatttcccatcatagtgtatgactttccagatccagtttgcccatatgcaaagacacaagcattataaccttcaaatgcagacttcacgacatctgtgccgagggttttgaaaacctgaaagccaaaaagaacacacaaaagatacaattatcatagattttaataatagccccttcagtgttgacaatgttcttgaatgatactttcagctcttaaggattagaccatataaataaatcactgcagaaccattcacaacaacatatgtagacaccacagtttttaatcaaaaataaactttttaagcaaacaaaaagcagccccatcctctttcctacttaagtttaccaaaaaatatcatgaagtataaaaatgtaaacaaggcaaagtgaaaatcatgtttagaagcaaagactattttaaagcatgatgattagccattcagaattatataaatatataaagctattcattctatcagagtttccagaaacaaaatactcaaaacctgaaggtcacagaaattactgcccaagccaagccaaatcaatgccatcattttaagggtccagctagtcatcaaaatcaacctctgcaggtgctcatgcagctgagtgacgggtggctgtagatgaggatggggtgctgggctcccccatgtcagtgtccagatgctttttcctatttggacatttgcccaggatggagagggcagggagacaagctgtgtggggctggggtgggggtcacacacatggcctgaatccacgtccgatgttccatataattacagtttgggtagtgaaaggaggtgaagtacaaatgcttcacccagacaactgatggtaaatgaaggaaatcaaggttcaaagtcttagttatagccagctggaaacagacaacaaaagctttcatgtagtctcctgtcctctcagcccagcacactaagggcacataaagcatctccctgcttcaaaaagtaggcacaacagcagctgaggagatgccaaacaaggaagctctgtcagctccagatgaagggctcctctgtggtgtcaccaacgtccaaggtggggcctcagcatccctacaggagcattcggtctatgagtgacaccacatcagccaactcatgggacccagacggatcaaccaaatagtcatctccagctactgccaaatcaagagcagcaggtctcaaactttgcagcccattacaatcacttgggaggctttgaaaagtccaatggccaggccagtaacccagcccagtgaaatatgaatctaagggggtgtgaacctaggaatccatattcttctaaactccctatgtgatttcaaagcgtggcaacatttgaggagtaacctagagcactcacatctgccagtcagcacaggcagtacagggaccctgcatggaagccagattcccattaggatgtgcacatggcccacatcagtgcagacatatggagacaactcccctctggccacaacacccacaccctagacagggccagtaaacctggccatctccatctcagctgcacctcaaccatccctgctgataacacagcctgtcatccaaggacaagatgaaaatacagccaactggaactcagctgtcttcagatccatcttcccactgacttctacagactttgtttcctcagcctcatcagtaaaagatttcaacaaactgttatttccattgggtcatttccacaaattgccagtctcactcattctgagttaattcttaaccattttagctttaagagctgacagttttcaatcttgctctcaaattctgatgacttactcaagtctcaaccataatggcaactcacacttactccggtctttctaagcactttcgtgtgttcatgtataattctcatcaaaacgctacagggagagtagtgttacaagacccattgatgaggaagctgaatggggagaagtcaggtaactgggaacacaccagggagtgccagagctgggactgcatgcaggacttagttatcactgtgatgtgtcctcttcccacaccctcgaaagcaacaaccaggccccaatcctacctggaagggcccctccctgaacttctcttaagaagcaaaagtcaggaaccccaggggcactcaggactccagaccaccagttggaggctcattttcaccactgtatatggaatatgagtaaaaattaaatatttccccaattctctcagattaaacaaaacacaaaaggcaaataccattttttatgaattcactagtaaggaaaaaagtcttctaaaaacttttcaaagaataaagaaggactgtttctcatagtttggcctggggctaaaccaaagtcatggaaaatatcacatttaaaccaaacccaaaggttttcagaataaaattattccctagggttaaaatctatgcctaccactttgctattacttcattgcccagaaagttaacccaggcggttttccggttcaggggctcagggggtttggggccaggagacatgactgcaaacgggtctagaaaatccaggtctggaggcgcagagacccagggctggctcagactcagactcattctcagtgagtctcaaataacccacccaaacttggcgctatgacctggaaaagcagccggcactgcctgcatctctccagaggtcttggcaaggaaatcgagatacccccatcacagctcccacagaggatgcaccgagcatcgcccccacaaccaaggtgggaagcggggcctgctttatgagactgacaactgctcttccccgctggcatcagaacctggctggcctggttacctgaaatccaccttgctgcctgtcagagcacagatttgaaagctgatttcctgggtaatccaaggcatcactggggcctcacttgaggggaactgcccacaagagggcactgttaaaataaaaactcgctcatcgggcatgtcaactgggagatgttaggtttcaagtttctcctgggttgaattaaggaacaggttgtgtgagatcaaagcctccctttggagttctgaagaaccattaagaaaatcagaccttgtttaatgatctttaatttacatgactgtagatttaagttgctcattgattttttttctaattctaaaattaatttgggagaaaaaatattaacggtcatcttacttggtatttgttcaaggttaagggaaaattgaactatagtagtagacatgatatattttctcaatatgcctttacattcaaatcacacacacacacaccatgctacactagcatcttcccctatttatagcagggatgcgacctgccagccacttcctgtgcctgatccatctgtcatcgtgaacacaccactccttctcgtccacatccttaagaccttccagtggcatctccagcacccgtacagccccatggtccaattctgctactattaaaagtcaattaggtctacaaacctgagcaagttccttaagcttactgaatctcttcaacaaagaaaaatagagttaaaatttaacacatttgattcctgtgaggattaaacaacatagcacatatgaacaccaagcagagtttctgacaacaatggaagttcaaccaacatcagtttatctttcctctcccaggccttctttcagaccaggcaccacctctctctgtgaggctcccattcccatcactgccattccttcctatctttccctaattttttaagagacagggactcgctatattgcccaggctggacttgtcctggcctcaagtaatcctcccacctcagctccccaagtagctgggactacaagtgcgcaacactgcacccagctcctatttttcccagatgtttgattcagtatcttctggatatagtcgctccagtcctccaactttaacatttacattgtctcagaaagccaacttcctccacaaaccatttacaaatggactacatttctcaaatgttaaggtgcacacagagaactggggatcttgctaaaaaaaaattcagatctaattcagtaggtcttggaataagacctgagatttcacatttctaacaagttcccaggcggtactgatgattctggtgcatggacacatttcaaactgcaagaaacaagtacttttggtggctggcaagatggccaaataggaacagctctggtctgcagctcccagcaagatcaatgcagaaggcaagtgatttctggattttcaattgaagtacccggctggctcatctcactgggactggttagacagtgggtgtagcccacagagggtgagcagatgcagggttgagcaccgcctcaccccgggaagtgcaaggggtcagggaactccctcccctagccaagggaagccatgagggactgtgccgtgagggatggtgcattcaggcccaaatattacgcttttcccacagtcttcgcaactcgcagaccaggagattccttcgggtacctacaccaccagggtcctgggtttcaagcacaaaactgggtggctgttcaggcagacatcgagctagctgcaggagtttttttttttttttcataccctggtggcacctggaacaccaatgagacagaaccgttcattcccctggaaaggaagctgaagccagggagccaagtggtctagctcagcaaatcccacccccacagagcacagaaagctaagatccactggcttgaaattctcgctgccagcaaagcagtctgaagtggacctgggatgcttgagcttagtggggggaggggcatccaccattactgagactcgagtgggtggttttaccctcacagtgtaaacaaagccgccaggaatttcaagctgagcagagcccaccacagcttggcaaagccgctgtagccagactgcctctctaaattcctcccctctgggcctggcatctctgaaagaaaggcagtagccccagtcaggggcttattgataaaattcccattttcctgggacagagcacctgggagaaggggtggctgtgggcacagcttcggcagacttaaacgttcctgcctcccaggtctgaagagagcagcagatctcccagcacagcactcacgctctgctaagggacaggctgcctcctcaagtgggtccctgacccctgtgcctcctgactgagagacacctcccagcaggggttgacagacacctcatacgggagagctccgggtggcatctggtgggtgcccctctgtgacaaagcttccagaggaaggaacaggcagcatatttcctgttctgcagcctccgctggtgatacccaggcaaacagggtctggagtgggcctccagcaaactccagcagacctgcagcagaggggcctgactgttagaaggaaaacaaacaaacagaaagaaacagcatcaacatcaacaaaaacgacatccacacaaaggtcaccaacatcaaagaccaaagatagataaatccacgaagatgaggaaaaaccagtgcaaaaaggctgaaaattccaaaaaccagaacgactcctctcctccaaagaattacaactcctcaccagcaagggaacaaaactggacagagaatgagtttgatgaattggcagaagtaggcttcagaaggtgggtaaaaacaaactcctctgagctaaaggagtatgttctaacccaatgcaaggaagctaagaaccttgaaaaagggttagacgaattgctaactagaataaccagttttgagaaaaacataaatgacctgatcgagctgaaagacacagcacaagaacttcgtgaagcacacacaggtattaatagctgagtagaccaagcagaagaaaggatatcagagattgaagaacaacttaatgaaataaagcatgaagacaagattggagaaaaaagaatgaaaaggaatgaacagagcctccaagaaatatgggactatgtgaaaagaccaaacctatgtttgattggtgtacctcaaactgacggggagaatggaaccaagttggaaaacactcttcaggctattatccaggagaacttccccaacctagcaagacaggccaacattcaaattcaggaaatacagagaacaccacaaaaatactcctcgagtagagcaaaacccaagacacataatcgtcagattcaccaaggtggaaatgaaggaaaaaatgttaagggcagccagagagaaatgtcaggtcacccacaaagggaagcccatcagactaacagtgaatctctcagcagaaaccctacgtgccagaagagattgggggccaatattaaacattcttaaagaaaagaattttcaacccagaatttcatatccagccaaactaagcttcataagcaaagaagaaataaaatcctttacagacaagcaaatgctgagagattttgccaccaccaggcctgccttacacgagctcctgaaggaagcacaaaatatggaaaggaacaactggtaccagccactgcaaaaacataccaaattgtaaagaccatcgacaccatgaagaaactgcatcaactaatgggcaaaataaccagcttagcatcatgatgacaggatcgaatacagacataacaatattaaccttaagtataaacgggctaaatgccccaattaaaagacacagactggcaaattagatagagtcaagacccattggtgtgctgtattcaggagacccatctcacatgcaaagacaacaaaggctcaaaataaagggagagaagaatattcaccaagcaaatggaaagcaaaaaatagcaggggttgcaatcctagtctctgataaaacagactttaagccaacaaagatcaaaaattacaaagaagggcattacataatgttaaagggattaatgcaacaagaagagctaactatcctaaatatatatgcacccaatacaggagcacccagattcataaagcaagttctcagagacctacaaagagacttagactcccacacaataatagtgggagactttaacaccccactgtcaatattagacagatcaacgtgacagaaaattaacaaggatattcaggacttgaactcagctctggaccaaacggacctaatagatagctatagaactctccaccccaaataacagaacacacattcttctctgcactacatcacacttactctaaaattgaccacataattggaagtaaaacactcctcagcaaatgcaaaagaatggatatcctaacaaacagtctctcaaaccacactgcaatcaaattagaagtcaggattgagaaattcactcaaaaccgcacaatcacatggaaactgaacaatccatcacataaacagaacgaatgacaaaaaccacatgattatctcaacagacgcagaaaaggccttcgaaaaaactcaacacccttcatgctaaaaactctcaataaactaggtattgatggaaggtatctcaaaataataacagctatttatgacaaacccacagccaatatcatactgaatgggcaaaagtcggaagcattccctttgaaaaccagcacaagacaaggatgccctctctcacaactcctattcaacacagtgttggaaattctggccagggcaatcaaggcaagagaaagaaacaatgggtattcgaataagaagagagaaagtcaaattgtctctgtttcacatgacatgattgtatatttagaaaaccccatcatctcagcccaaaatctccttaagctgataagcaacttcagcaaagtctcaggatacaaaatcaatgtgcaagaatctcaagcattcctatacaccaataacagacaaacagagagccaaatcatgagtgaactcccattcacaattgctacaaagagaataaaatacctaggaatacaacttacaagggatgtgaaggaccccttcaaggagaagtacaaaccactgctcaaagaaataagagaggacacaaacaaatggaaaaacattccatgctcatggatagaagaatcaatatcgtgaaaatggccatactgcccaaagttacttatagattcaatgctatccccatcaagctaccattgactttcttcatagaattagaaaaaaactactttaaatttcatatggaaccaaaaaaacagactgtatagccaagacaatcctaagcaaaaagaacaaagctggaggcatcacactacctgacttcaaactatactacaaggctacagtaaccaaaacagcatggtactgatatcaaaacagatatatagacaaatggaacagaacagaggccgcagaaatgacatcacccatctgatctttgacaacctgacaaaaacaagcaatggggaaaggattccctatttaataaatggtgttgggaaaactggctagccatatgcagaaaactgaaactggaccccttccttacaccttatacaaaattaattcaagatggattaaagacttaaacctaagacctaggaccataaaaaccatagaagaaaacctaggcaatgccattcaggacataggcatgggcaaagatttcacgactaaaacaccaaaagcaatggcaacaaaagcaaaaggtgacaaatgggatctaattaaactaaagagcttctgcccagcaatataaactatcatcagagtgaacaggcaacttacagaataggagaaaatttttgcaatctatccatctgacaaagggctaatatccagaatctacaaggaacttaaacaaatttacaagaaaaaaacaaacaaccccatcaaaaagtgggcaaaggatatgaacagacacttctcaaaagaagacatttatgcagccaacaaacatacgaaaaaaaagctcatcatcactggtcattagagaaatgcaaatcaaaaccacaatgagataccatctcacgccagttagaatggcgatcattaaaaagtcaggaaacaacagatgatagagaggatgtggagaaataggaacgcttttacactgttagtgggagtgtaaattatttcaaccattgtggaagacagtgtggcgattcctcaaggatctagaaccagaaatgccatttgacccagcaatcccattactggttatatacccaaaggattataaatcattctactataaagacacatgcacacgtatgtttattgcagcactattcacaatagcaaagacttggaaccaacccgaatgcccatcaatgatagactggataaagaaaatgtggcacatataaaccatggaatactatgcagccataaaaaaggatgagttgatgtcctttgcagggactcggatgaagctggaaaccatcattctcagcaaaccaacacaggaacagaaaaccaaacaccagatgttctcactcataaatgggagctgaacaatgagaacaaatggacacagggaggggaacatcacataccaaagcctgtcagggggtagggagctacgggagggatagcattaggagaaatacctaatgtagatgtcgggttgatgggtgcagcaaaccgccatggcacgtgtatacctatgtaacaaatctgcacattctgcacatgtatcccagaattaaagcataatttaaaaaagaaagaaagaaagaaacaagcactttttcataccctacttttcgagatgccattgcatggattacaacccaggccaggcaggacaggaattcttatccccgttttaacatatggagacttaaagcaatgttatctaaagaagctgtcaacgagccaggaagaggcccagcaatgaagcctgcgtttttccttctatactggtgctccccatttctaacctcactctgctcaaataagcagcttttccccaccccgagaaatatacttgtccctctgctcacctgaaatgtcaacatcagtgtcttgataggcttttgggggcacctttgtgtctgttattatctgtccacttcacatctacattttagcccttaaaagcctacaggcaagatttcttggacaaattccagcatcattctagactctagaaagattctgaatgaacgttctttctttctagaatccactctaaaacctgtaatgatccacacaacctgggaacacatgacttgggtttgaagtttcctcctaaatctccgcactgaataggactcaaggttaagtggcttctttactgtgcttcgcagcatacacatgtctccccagaaatgctttctatgtagagctccttctaaacaggaaccatatccaagttttgaaacaaattaaaaattatcatcattatgctcaaaggtgaaaaaaaaatcaatcttttgagaactgaattcttctcaggcttaaatagatactcctacataacactcagaaaggtaagttagcaaaggctaattttatacaaaaattacattcagaaagaaattggcaagatattttaaagtattttagggtaggcatgtttttctcaatgtgaaaataaatcaacataaatattttgaaaatatcatataccatttcttgtgaaacgtaatctgggctttttgtatcagcagaataaaaagaaaagtcataggtgaaggtcttggtccgttctcttcctgagtccccagtgcctccttctggtatctagaaagaaatgattagaataataatgataatgtaaagagcactgccatttgacccaaatttccatgtttataccctgactaaaaaccatttcattcctgctggcttctctaaaaaaataaataaataaaatttaaatataaactaaactccttgcagcaatccaagttctctgtgatatgacccaagaatactattctgaccttttctttttatcactattaactcctaagaacccaacactccagccagactctgtatttccaccttcagtgattttttactgttccctccacctaaatccaccagagttgggctttgcacaactacaagggtggtattcacatagatcatgataagattggcaccttctaaagctgtatgatttggtggcctcactgaaaattctaggtcagatgtctcctctttcatgacacttcccttggacactccatggagaagtaatttctcctacctctgacagcctagactcttccaggacacatcatattgtgagtttattgcggatgtttgcatatatcttgtcccccttgctatatgcttaaagtgcacctcagaaccatgttttaacatcttcatatgctcccaaagcctgcttattggacatatgctgaataacttcaatgagcaccacgttttccacatgattcacatattataaaaaaattgttatgattcttatgaaaacactaaaagtctaggcatctgttctggttactcaaacatcagatgataaaatgtttaaaaaactcaaaaagcaacagagtaatcgaggaaaatagattccataacgcacaaagaaaggagactcatccagagtcagcggtcttttaccaaagcactgtgagcgtagaaagacacatgaaggaaagacaaggtaattaccagcagggaatggacaagtgacaactgggtagaaacatgagaatatgcgagaggccaaaggaagggaaagaagcacagtgcaggccagatagagctggaaggcacaagggttgtgctaagcagaggaagaaaggcatccagtggagaatgcctcaggcaaaggacaccagcgccttaatggaggaaatgaaatgatccagaggctgcccagttggaagatgggagcatttcccagcttctaccattggagatcaactcgcactactttgaaattggatctcaaagtacccaatcctttgagccataaattaatagaaatctccacagatgtgaacaggagatagatctgacttggccatggagcatcatgtctcagaaacccagacctaaaagttaatgacaaatatcaaaggagaaaggcattgaacccataaagtacttcatttctttcttttttgttgttgtttttttgtttgtttgtttgagatggggtcttgctctgttgcccaggctggagtgcagtggcacaaacagggctcactgtagccttgatctcctgggctcaagtgatcctcccatctcagcctctcgagtagctaggaccacaggtgtgcaccaccaagcccagctctgatttcttcaatattaattttatacccccgttaccctcctcagcgaaaagcattcagtgccctttaaaaatttcctaaccaaataaacaaacaggatatttttcagtgccaaaggagaaacttgccatcttgaaaattttttttaactttttttccagaaaagaaatttggtggttttttttaatctttcctccctgagttttgaataatagtatcagttcttcttcaaggattaccaaacatgatcctcttcattaaaaatggaaaaaaatataggggcaaagcttatttaatgttcacagaacacagtcaattgccaggctaagtccctactacgaggacacaggatgaaaatgcccgaatctgggatagactcaggagctcctggaccagagcaacagcttggatttggcttccagatcaaataaagccaggaatgggaaaggaaacgggatcaactcttctgcttcaagactgagcccaagccaggtgcaagctgacgtggctaactgcactggaaaggagggtgtggaaacagcagacaggctttatttactcattagtcatccccacagtaaagcaatcatggggctcttggaacttaagcaaggccaggtcatgacttgcctttaagtttgtgattgtcgttttgcttttctccatctgaataatgaacttggcctccaagtccttttccctgcaatacaaataattcagtagtggttagaagagaaaagattattaaaaacaaaacaaaactaaacccatttgttttatttactttttacgttaggagtttattttcaaatggcatctgaggagcaatcccagacacggctcctcccaaatccttactaatataacatgaagatacgcaaaatgatgccaccatcaacaattatggctgatacacagtgtgttgttaaaccctgaaagaatttccaattgtaagccaaaagaagagtaaatgaaataacagacaccacaaagagctaagactcaccaaaaaaaagtagcccccctcaccttgttacaaagagaaagagaccttagccccctacccaagatgaaaaccaaagagaaaactggagtggttacaagcaggtgctgcttccagaagcagccagggcactgttccctcctcctaccttctttctacatctgttcagaaactgcatttctcagaaaacagcagaacaggaggactcctaaagagtacagttccctagaataaatgaccatacatttacccaatggagtgtgacgccactgaacaaggaatgaggaagatccctatatctgttatggcgtggccactgggatatactgggatatactgttcagtggagacaaaagatggagaaaatctatgtagaaaaatacaaattatatttaaacacttttttaaaacctatgtatttttcaaaaggctacctaggaaaaaaagggaaattgaggataaggatttggggcagacaagggaagtggacaaggatagaagctagatttctgcaaatatactttgatctggaggtcatctttagaacgataaaaatgatttatgcaaaaataaaacaagagtttcaaaaaacaagctataatttagaagtaagttgaagcgaatgaatctagctgtgtaccacaaagtgagaaactatttcaattacgactctatagaggaatttgactgtatactataatgagatatatcctaaaaagaaaaagaactacaaagaaatcttaaagcatttttagtaatcatatttttggtggtaatgtaagtgccattattctgagatttctgtctgtgtactgtgggacattacaagagtaatgatgttggtgccctagagaaccaaggtttttgaagtggctgaatgagatacaaacataagtttgatgaggttaagtaaaaactgtagtcctggccgagcacggtggctcacgcctgtaatccctgcacttcaggaggcagaggcgggcagatcacctgaggtcgggagttcaagaccagcctgatcaacacggagaaaccccatctctactaaaaatagaaaattagccggccatggtggcgcatgcctgtaatcccagctactcgggaggctgaggcaggagaatcacttgaatccaagaggcagaggttgcagtgagccaagatcacgccactgcactcactccaacctgggcaacaagagtgaaattctgtcccagaaaaaactgtagtcctgaatctaattggaaggagtagcagaaacttcatctttcatccaaaatttaaaaaacaaacaactcccttgctttgtccattgaaaaggcctagaatcttacactcaaattatagcctataaataacattttccactaaaataagtcagggttccttggagaagtgattcaatccaaatactgaaccatctcttcacactataaagcaggaacactaacacaggtcactagggctgtggcgggcaccttctaacacggctcccagtgattgcccggcactcacaccctgtcgtgtgcgatccttgcccttgactatgggctggacctggtgagtcacttctaatgactacaacacaaacacacccaagtgatggtctgtcacttcccaggcgggctttcaagactgtgacttctgtcttgctggctctctcttctgccctctctgtttgagccctggcagtgtgaaaagtcagggacgacagagtgaggacccctgtggacagacccagccagcaggaaacaggggcccgctagcagcacgccagacagcctggcagggcacgctccccaagcccgcaccgggacatgatgatgagagatgactgggaagccgtctggcaccctgactgcagcgctaggggagagccggagtcagaggaccctgctcaaccccacccagattcctgacccacagaaactctgagataatacatgctgtgttttgttgttgttgtttggttttttttgagacagggtttcgctcctgccacccaggctggagtgcaatggcatgatctcagctcactgcaacctccacctcctaggctcaagcgattatcctgccatagcctcccaagtagctttgactacaggcacgcaccactgcacctgcctatttttgtattttttgtagagatggagttttgctgtgttgctcaggctggtctcaaactcctgagctcaagcaatccacccgcctcgacctcccaaattgctgggattacacacacgagccaccatgcctggtcaatacatattgttttaagcccctaagttttggggtaatttgttatacactaaaagaaaactaatacaaggaccctgtcaaaaggactcaggaaccaacctgcataagttcctgctgcccaaagttgagaaatctggacagcaaagaaactaaaaaccaactgaaatagatagaatatatttaagcacataaactcataacttaaaaataaaaactcagtggtcccctctgaaagatcaaaggatctgtctcattattttgaaaactgttaaaagaaagaatcaagcatttatcttgcatttccaaaactatctatacttcaagtaaccaaacaactgtgaaagaaagtttctcctttagagatattccagctaaaaaaataaagaagtaataacaaaatatcatttcgtcacccctggtgaattaatggctctagggagggaccaccgatggttaccaggccagccactgtgagaaaaccaggtacgaggtgtattctacctgaagtaccaacgcgactgccccagggttcctgtccttccctcccagggatggcctgactctgacctagagctgccctatagggaaccagcaggaatgacaagtgtaagtgggaacacgccaatgttctcaggtgggggaatcggtaaaatccagcctgtgggaaaggcagcagggtaaatgactcagcatattccaaattatgacaaattgcaaagaatataacgatgaaagggaaatctaaagctagaaaagacattaaagacatatcaaccaactggatcccaattcaaacagaaaaagcactttgaaaattataaccatttgggaggccgaggcaagtggatcatctgaagtcagggttcgagaccagcctggccaacatggcaaaaccccgcctctactaaaaagacaaaaaatagccgggtgtggtggcgggcacctgtaatcccagttacttgggaggctgaggcaagagaatcggttgaatccaggaggcggaggttacagtaagccgagattgtgccattgcactccagactggacgacaagagcaaaactccgtctcaaaaaaaaaaaaaaaaaaattataacttacgtagggaaatgttaacactgactagatatttgatgatattaaggaattattgctaatattgtaggtatgataatagtattatgacttaaaaaaccttttagagatacatattgaaatatttacaaatcaaatgatatgttacctgggatttactttaaaataatccaggtatggggaaaccagctaaggggtaacatcttggccagctcagacgaacagagacaaaataaatatcagttgtgaacaaacccaaaaagcatttgcagtaaacaccatttgggaactacagcagattcccagggccaagtttaacatttccaagcctgaaaaatgcttccactccaacccaccaggagttgggcaattccattgtggacccaaaagtaagaactgcttcagggacaccccatgttcatgtggctacaaaacaaatacttcataaaattaaacctttcctacagcattcaattaccaaagcatgtcctgctcaacaagagaacaaaccacctgggtttatttatatcacagaacaccaaacccagattcctcccattcccacagtgggtccttttttctcaatcaatcactaacctaatgcatctagagctttcatcttaaaaccactattatcaacaaatacctctcaggaacacaaaattatccagctacatagaaatattagaagtgatcgtggtaatgctcacattgacttgtcaattcttgcctagaaaacaaagtaatgtggctcatacaatgcccaccactcctgctggaagccagagactccataactccccatctcagaaccttacacctttggagcagctaaatttaaagggccctccacatgatcatgtattctaacctgcaggtaaccagggcagtgcgttcctagttctaaattaacatccattctataaaagcactaagtgagatactgactgaaaggctgttatgcaatatgactgtctttttattagctacttctaaaatgaaaactgaagatgcaggtaggttttgaaggtttcaccacctccctgaaatcctatgtactgggatgactggctgggaagggggatcaggagcaggaggcagtttcactattctgagggtctaccacattcctcagtttctcaaagagttccatcaccccaaaagataggaatccctgctctgactcttaatactcaaaatatgctccagagaccagcaacatcagtggctccagggaagcttgacagaaatgaaggttctcagtccccacctaaaacctacagaataggaacctgcattttaacaactgtaaatgattctgatgaacgttaaaatttaaaaagcactgctctgatgctgtacttaatatgacatagtaatagatgggtcttaggtttacccttatgaaataaactacttcttacactggaaaactcactaacctttgttctttgacttttaaattttatttttaaaatcacatgacagaatatgaatggatataccataagtcagctaatactgtctccattctatgctcttaagttgtaagtggcttctgaccaagagcaataactgctgacataatctgatgagagatgtcatgtgaatgtcatgacactcaggttccctcattctcaccctgccaaaccatgagtgagtttccagccctttctcttcccagactgtgtttctcaatgtcaatctaaggctacagccaataatttaaaatcatatcaaaagataattacaggtcatcaacattaagatcgaggccatctatttcagaaaagaaatttcacaaataatttcctaacttgcttccttctttaagcatacaaactgaaacagtttaaaaaaaaataaaaaataaaaaataaagatgtggctgggcacaatggctcccgcctgtaatcccagcactttgggaggctgaggtgggtggatcacaggtcaggagttcaagaccaacctggccaacatggcgaaaccccatctctactaaaaatacaaaaattagccgagcatggtggcaggctcctataattcctactcgggaggctgaggcaggagaatcacttgagcccgggggacagaggttgcagtgagctgagatcgcgccacttcactccagcctaggtgaaagagcaaagctctgtctcaaataaaaaaaaaaaattaatctaaaattactcttagtatttataacacagatactggctagaatttcagccataaagagcaaatctcttcctagttcctgaaaacacttatagaaaagccaatatattttttactgttgagttccttgtatattctggatatgagtcccctatcaaatgagtagcttacaaaaatgttctcctattcaacaggttgtctcttcactgtttcttttgctgtgtaaatgtttttcagtttaacatagccccttctgtctgtttttggttttgttgtctgtgcttctgaagtctcatccataaagtctttgtccagaacaatgtcctgaagagctttccctatgttctcttctagtagttttgtaatttcaggtcttacattaaagtgttcaatccatctggagttgacttttgtatacagtgagagatggaggtcatgtttctttcctctgcatattcttatccagttttcccagcatcatgaagagagccccaatgtacgttcttggtggctttgtcaaagatcagttgaaaatatgtggatttatttctgggttctctgttctgctccattggtccatgtgtctatttttatataataccaataccatgctgttttggttactacagacttttaatgtattttgaagtcaggtagtatgatgccttcagctttgtttttgcttagggttgctgtggctatttaggctcttttttggttccatacaaattttagaattttttttttatttctctgaaaaacaatgttggtattttgatagggattgcactgaaattgtagattgctttgagcagtatggtcattttaacaatattaattcttctgatccatgagcatgagatgtctttccacctgtttgtgtcctcctcaatttctttcatcagtattttgcagttttccttgaagagatctttcaccttcttggttaaatttattcccaagtatttttctttgatagctacagtaaataggattgccttcttcatttctttctcagctatttcattattggtatatacaaatgctattgacttttgtatgttgatttatcctgcaactttattaaattcattcatcagttctaagagtttttaggtgaagtctttggtttttctaaatataagatcatgtcatctgcaaagaaggacaatttgacttcctcttttccaatctggacgccttgtatttctttctcttgcctcattgctctgactagggcttacagtattatcttcaatatgagtggtaaaagtgggtatccttgtcttcttccagttctaagagaaaaaaaattcaccttttccccattcgctacaatgttagcagtgggtttgtcatatatagtctttattatttcaataactaatcctattaaaaatgggcaaaggacatgaagagacatttctcaaaagcagacacagaaatgaccaacagatatatgaaaaaaatgctcagtatcactaattatcagggaaatgcaaatcaaaaccacaaagagatatcattttaccccagttagaatggctgttattaaaaagacaagaaataacagatgctggcaagcatgctaagaaaagagaactcttatacactgttggtgggaatctaaattagtgctatggaaaacagaatggagatttctttaaaaattaaaaatagaaccaccatacaatccagaaatctgactactgggtatttatccaaaggaaaagaaatcaatatatcaaagggaaacctgcactcccatgtttattgaagcactattcacaatagcaaagatattatcaacgtaagtgtccaacaatgaatgaacggatcaagaaaatgtagtatatacacacactatggaatactactgagccataaaaaacaatgaagttatgtcatttgcagcaacgtggacagaactaggggtcattatgtttagtaaaataagccaggcacagaaaggtaagtatcacaagctctcactcatatgtgggagattaaaaaatggatcatatggagatagagagtagaatgatagatatcagaggctggaatgggtgtacgggggtggggggagtgaagagaagtaggttaatgggtacaaacataaagttagatagaaataagttctaatgcttgtaagcaaagcaagctgactacagttaacaacaatgtattgtggttttcagaatagctagaaaagaggacttgaaatgtacccaacacatagaaatgatactccagtgatggatatcccaaatactttattacatattctaatacacataccccataaatatgtacacaaatataaagtttgtcaaaaaaatgtttaggagaagtaaaaccaaaaccagcgtgatatctatgatggttggagctattaagtgttgcaactaattctttgttacatgtcttcctttgcagattcctggagaactgtcaaacttccaaatatttcaaagatgaaagaaaggaggaaggcagactccagtacttccttcccatccacaccctgtggaccaaccctactcagcctccttcatccactgcagactctggcttctgctcttggccttctcttcacccctaggggctttaactgtcataggtgacttcagagtccatgtgacactccatcaaacaaccttacccccaacccccctacccaacattcagttacctagtcccttccaatctaccacctgttgaactagaccagatctccccactttgtaggccctgtcccaggtcaggctacccccacctctagtctctttgcctccagcctcatcctctctcacacacactccatcgtctgctgccagagagagccttccataaaacacatctcaccacgaggctcccctgctttaaactccttcagtgacttcccaaaggctacaggataaagtccaactctcagtgctactatacaaagtccttcatgatctgaccctagttgacatttctattccagcactatatcctgccccatcctcttcccacggtcaactcccaaccattcctctaaattcagctcagacttcacatcctctgtagggccttcaccaagccctctatcctatcccctagttagatggcactcctgcttgtctcatccaccagactcttaactttttaagagcaaggactctgcctgtctgggtttatagccctccccagcctctggcacattgcctgcaactttgtggtgctcctaaaatggctgttaaatgtgatgaacttcctgaaatattaaacaaatggctcttaccccagtgtactctttaccacactcatcctcttcccacgtgggtctccctatgtgccccctacattcctggttcttgccttcccacatactaaagtatcttcccacttcccacccacatgttctttttctttttttctttttttcgttttttttttttttttttgagacagggtctggctccgtcactgggctaaagtgcagtgacacaatcttggctcactgcaacctctgtctcctgggctcaagcaattctcgtgcctcagcttcctgagtagctgggattacagatgtgcaccacgatgcctagctaatttttgtatttttagtagagacggggtttctccatgttggccaggctggtctcgaactcctggcctcaagtaatccacacaccttggcctcccaaagtgttagggttacaggcatgagccaccatgcccagccctacccacattttcaagtaaggcttgtcttgggtccagtttgactcacctcctcctgataaaccattagaaacaacaccccctcatacacctacctagttcatctcacctgcatagctttattcctgctgatgtcatctctccaattagtccagagaacctcagagaagcccagcttccttcacatccacactgagtccaccaagcacaagggcaccacccacaatcagcactgagtgctttgtcttgtaattcttcagctgaaaactacaacgccaggcactgagattacccagcctctcaggtcaatttcctctgacatttaagaaacacagcaaataaatcctgacattcttcttatattgtagaaaataaataatcctaagatattatttgacattaatttgataatagggaaaaatgaactatgcctctccctggccactttggtgaattggatttctcaaccgaaaagccaattatgggtccttcatatagataagtaatttatttgaaaggtctggaaactagatgataagatgctacaaatgaaccagctggagtacatatacttagttatagatcaatatggggggaggaggacgaaaggaaaggaaaagatttaaaatactctaccaggaaaagagataaattatgtcagcattcagatacatgagttagaagaacatttatttttaaaaaaatcctattgacatagtttctacatttgtccccacacaaatctcatgatgaattgtaatctccaatgctggtggtgtggcctggtgggaggtgattggatcacaggagtggatttctcatgaatggttcagcaccatcctgttggtgttgtccttgccctgaatgagttcttgtgagatctggctgtttaaaagtacatgacacctccgctcgccgcactcttgctccattctcactatgtgatgtgcctgctcccactttaccttcagccatgagtaatagcttcctgaggcctcctgagaagcagatgccactatgcttcctgtatagccatcagtgcaaatgatgagccaatttaacctcttgtcttataaattacccaatcttaggtatttctttagagtaatccaagaatggcccaacacgaaaaattggtaccaagcagtagggcattgctatagagatacctgaaaagatgcacacagctttgcaactgggtaacaagcagaggttggaagagtctggagagctcagaagacagaagatgaggaaaagttcggaatttcctagagactggttaaatagttgtgaccaaaatgctgatagtgatacaaacagtgagagccaggctgctgaggtctcaggtggaaatcaggaagttactaggaactgaagcaaaggtcatccttgttatgccttagcaaagaacttggctgcattgtgtccatgccctagagatctgtgggagtttaaacttgagcgtgatgacctagggatctggcagagaaaatttctaagcagtgagtaacttctcgtgagatctggctgttcaaaagtgtatgacacctcccccgacccttgctctcattctttccatgtgatgtgcctgctccggctttgccttccaccatgagtaaaagcttcctgaggcctccccagaagcagatgctgctatgcttcctgtacagcctgcagaaccatgagccaattaaacctcttttcttataaattacccagtctcaggtatttctttattgcaatggaagaacagcctaacatacctatgttaattcaaatatcttgaagatgtttttaagttattcagcaattcaaattgattccattccctcagctgatgacatctggtcaatccataataaacagctagactgggtgatgttgggatctccaaactgagacattagcctggaagattctaaagagtgacttatttaccatgagttctgaaataaaccggcatcccaagtgcaccttaaaagttacatactatgaaccaatatttaactgccttcattttagtggcaagacacttgatagcaaaaatgaaaataaaaactatacttttaaaaataatacatgagctccatgtatactaatatggaaagaagtccaaggaagcctgtaagtggaagagcaagcagcaaaacagtgtgcagatgacaatcaagtttgcagctcaataaatagattaataaagccaaaataatatgcgcgtctatgattctagatgcacaaaacatttctgaacatttctgaaaggataaatagcaagccattcacagtggtgacctctggagagtgagtgggagcagggcttcaggggatgagaaaataaacatttcactgttggaattcattttagcaagatttgatattccttctacagttaaaataaatttagttaattaaaagacaaaaagtccctgctttgaaattctgggtggctcttcatgctctagaacaagtctacatccttacgtggcatgaaagcaaaagctactgaccctcttctcctgatgacatggccatgaaacagacagctcctcgtgcccttgcactttcacaccttcccatggtactgagtatcctcatgcactgcctagatctgcctctccccgtcgccatccctctgcatttccaccaggcaaaatgatacccacattcaaaactagtcccagtacccctttctcacaaagcattctaataccctggctccatgaattagtttctctgttccacccaagagcacttctcttttcctcttgtattaggttccaaataaaatataggaagcccgattaaactgaatttcccataatagttaattttatattatgactgtgtcccaaatattgcaatatttttgcttgctaagtctgacacactgtttcttacccaatggtttgcactcatcaagggcttccacagttagatgcagatgtattcgcctccctaccccaagcccagaaagcaagcaacccaagtcttcagtaacacctgcaccctcagtacccagcaaagtggcagaagctccataagtttgtgtcacctcacctgtctcagggcctgaagacaaactcagggagggctagtctcctccccgaaaccatgtcttcctgctgttccttatcctttcctattagaaaaagaaatctgtgcacagcctgtgactccaaccactcctcgctgttctccatgaaatcatgaaagcctccatctcaagtttttgagaaacacccagggaacacagatagtaaaaaattctggaatgggtttttcaggcaatcaccctgacttcattttggcttctgagaacacagctcaccacacagcagtcagctagaggtcagtggcaccatgacctacatccaaatgccaacctcgagcggcagcttgtgagaaactggcacagcctccactccgtcccccatgggctgccagtacggaagtacggatgagccaaggacaacgatgctatcacagccttatgagtctcccatgctaagtgaaatcctcacttgacctctgtctgccacaacaggaggccattaagctgagcctttcattgtcttccctggcctagggaaacagtaataaacctaaaaaattaggcaaagcaccaactcttacggtttacaggttgggatcccagagaagcagacatctgtgggagtatagcaagcagggtgttcattaagttatgtctttgggatcaactcctgggaaaagaaggagactgaggcaggcccaggcagagggagaagtggagctgcagcaccgacccatggacagccttggccaactccacaggcagtcctggggctagcgtggcccttcagagttgccacaggttgggcacagatggccaggcttttatacccctgctttgagcaatcagggactgtgggctgcggtggaaagagctggcagctgaaggctgggccaaccatgctgcagcaacaagccctcaaagacagaggatctgggtggcaagcacggtgcctactgtaccaacctcccctttaaaatgatgctttataggatgcaccacacccaagtggcagcattcaccactacaccaactccccagcagaggcagagaggcctgagctggggctaccgagctagacagaaggcagatactttatttttttcagctgaaaggagaatagcctaacaatcagaagtgcctcagtacaaaatgagttaccttaagatgtgcagaaccattactgaagaggtttagttagaagctagagaaatccttatctgggatgttgtatggggagatttatatattcattcattcattccataaatatttagtgagaattaatgctttcacataccagataatagcctcagtgcaggaataaaatggtaaacaatacagtcccagcctgcatttcacagagaggcttagaagaaaaacaaaataatactctatcattttagattgtggtaaatgctataaagaaataaaggtatgtcatggaaaaggactaacaggcagaggcaaaggaaggcaagcagccagaaaagacctctctaagggggtgagatatgaacaaacacctgaacggggccaggcaaatggcccagataaaaaaacagcaggtgtaaaggccctgaggcaagaaccagccagagactttgggggaagggcaagaaggtcactgtgactgcagaagagagaaacggaaacaaagtagaagaagaggtcagaaaagccttgaggtggaggccaaatcatgccagttcttgcaggctttggctaaatggctaagacttcgaaacttaaatgtaataggaagccacagccaccaggttttgtgtacaggggagtggcaaagtcgtatttatatttttaaaaggcccctctggttggtgtgcatagactctagagggatggcagtctagcaaggagaccactcagaaggctacacaaaggatgctgggccagggtacaggaatggagatgcatccagatgactggggtggatcagaaagttccccaggcctgctgacaaacactactctctgaggagcccaaacccggacctaccaagtaagaatctccaggacactgtattttaaccacctaggaggttctgatggtcaactgggtttgggaccactgcgctagtttatctgtgttgtcctctgaggaactgggattctataagaatgtgaaagctttcacagttttcacattgtgagatgctgtttcaggtccctgtgagatgctgtttcactagaaggtggtttcatcccttcttctgaatggagcccaacccacctatccccaattccagaacaaaaatccagaacagactatgcctttagggttatcaccactgacttccaaccgaggtgctcctcttctgagtcctagaacaccaaagttatttgagtgactattttcccacttttcctaaagaaagtatataactagaattattccagaagcataggacagaagtcaactcattacacataacagatgccttactcaaggtattaggacttaattctatcttggaaccctggttctagttgagaaaatctggtggacaactgaaaaatttcatacattacaaaattcatgtcccaaaccataaaggactaaattttgctcaagaccaaagataataatgacactttcatggggaattttggatactccgcagaaaggagatttagggtcaagcaagatggtaagcggcctgagagtcaagctgaggctcaaggaatgcagcacttgacaagagatggacttggaagaaggagacttagcccatgacatcacctcacatgtaaagaaatgcaggtccagaaaggttaagtgacttactcaaagctcccactacagagtcagcattgtaaaaggaactcaggaactcagtaagcgatcaatacttcaaagccacaaagaactgctgagagcaaagctggcactcctaatctgatttcagctacatcttcctggagagggtatgtaagcttgggatcccaggggaacacaatgagccagccagtatatttagagaatccacacgattgctctccaaacagggtggaagtcatcaaatgcatcaggcactggacaggagaatcgagacgcgcacttagcctcatttcccaccacacgacccagaggcacccaggctcccctgtcccattccaaactgttccttcttgcaggtctcacaaagacccgcctctgtgagtcctgggccttgctcatgctggtccttctgcctggaatgtacctatctaatccaagtgacttatccttcaaagcccataaaaatgcttcctcagccgggcactgtggctcacgcctgtaatcccagcactttgggaggccaaggcaggtgaatgattggaggtcaagaattcgagaccagcctggccaccacggtgaaaccccgtctctactaaaaatacaaaaattagccaggtgtggcaggtgtctataatcccagctccttgggaggctgagacaggagagtcgcttgaacctggaaggcagaggttgcagtgagccaagatcacaccattgcactccagcctgggtgacaagagtgaaaagccatctcaaaaaaaaaaaaaaaaaaaaaaaacttcctcttccaggaagccttctcagacctctcctagccagtatcttctgggtgacattccataacacaccacagcagttaccacatttgacctgcttactgatgggctactatacatttgtcttccccaccagtgtacatgcttcctgaggccaaagatgatgtcctgctcttcatatatttcacaacacctagcactgtcctcatatacagcaaacacttgatgaatgaatgaatgaatgaatgaatgtataagcacatgaaagatcaaatgaaacagctaaaacaagatactattcttaaactcgagcactaaagttaaactcatacttcaaagcttaaacttttaatttttaaatgcagatagattttccccaaaaatatcaattaacttggcaaatgttaactccaaagacagaaatgaagcttgtttctccctgcagtcacagctgctgactctgactccaggagcaaagcgttgggggccttccatctccttctgagtatcttcttttgagtcatggaaaaaagatacggctgtgcacgtggccaaacttctttgatatgcttcctcaaaagacacaaacaacatactcatttttaaaaatggaaatttaggccgggtgcagtggcacacacctgtaatcccagtactttgggaagctgagacaggcagatcacttgagtccaggagtttaagaccagcctggccaacatggcgacacctcatctctatttaaaaaaaaaaaaaggccaggagaggtggctcccgcctgtaatcccagcactttgggaggctgaggtgggtggatcacttgaggtcaggagcttgagaccagcctggccaacatagtgaaaccccaactctactgaaaatacaaaaattagccaggtgtggtggcaagcgcctataatctcaactactcaggaggctgaggcaggagaattgcttaaacccgggaggcagaggttgtagtgagccgagatcgcaccactgcactccagcctgggtgacagagtgagactctgtctcaaaagaaaaacgtggaaatgtaaaagaggtattgcagaacataagaacattcatacttatttttgttttcctggattcagacattaaatcgactattcaatgcccaaagacatcctagtttagtgctgcagcactatgaaacacaaagaagtgtgttttctctgctcttcatccacatcactataaccctcttcccagttttatctctattctagaaaaatgttctcagtggcagcttacaaaaaaaaaaaatacaattttggcctataaaatggagttgattccttttgtaacaccaccagctaaatgccatataccagctagggaagggatactggtataattcaaactaaattgcaagactttttcttcaaaaagacttcaaatcatagtggaacaagatggaattttggtttcttgtcactttttcaccaagcatagtgcctaacatgtatattgccaagcacagtggtttaataattgggagagggggcactaggtttgggggacctggattgaaatcctgagtcttagtagctttgcgactttgggtacattacataactttgctaagccatggtgtactaattacacagcaacactgtggttattgagctgcactgatgtacaattttttgctgaaagatgtgatagaagaaaacagacaatataaggccagctatggagtcgatactcaatctatgtgttcatcttcatcatgaaatcaagatccctccatttattcagttaatgtttaccgtgtctctactatgtgccagctactatttgcagcacctggagataaaccagtggacaaaaccaacaaaatgatctctgggagcttacattctggtgtggagattcactttaacataacctttctgaccctttcccaaaataggtgcaagtggaatctagaaaataaatgttgccaagtcttctgcccagatatcatgaaaatacagaagcaccacacagctgactttgtaaaaatcttcaaaagctttgttcatgaaatgctttatctacatcaactcaatgcagaggcacaattcataaagataaggctaacagaaacacaaaaattctttcacttatttttatttaattatttatttatttatttacttcagatggagtctcactctgttgcccaggctggagtgcagtggtgcaatcttgactcactgcaacttctgcctgccaggttcaagcgattctcctgactcagcctcctgagtagctgggattacagatgcccaccaccaggcctggctaatttttgtatttttagtagagacagggttttgccattttgcccaggctggtctcgaactcctgacctcaggggatctgccggcctcggtctcccaaagtcctgggattacaggtgtgagccaccgcacccagctttcacttatttttaaattcttgtgaattatgtccagttattctgacgacatacagactgtcccacctaaagacacataagcatgctgtgtccttcctgtcccatgctcagcgtccgcatccatcacctctcctaaggcaagctggccatgcccactcacgataaatgacagagccaccatggccagaggcaggacaaacacatgcctcccctttacaaggctgtgagggatacagaaacattaatatcatggctcatgcccttagatggcccacaatcaccccacatgggtgacagcaaatggctagtgctgtcaatcaggcatgggtgcccacaccaaggagagacctgactttggtaagtgaaacaaagttagtccaaaaaagaagcgcaatcacattttttattctgggggaaaaggagtatgtcaccagaaagttcctttccagaatattctttgaaactgtgtcatatcaccttctccagtgcctccacgacctcagcttgataaagaactgctccccacctgcctctggtctcactctgagcatgctgctcagacacagagaatgctattccccacctgcactttctgaggagcgctgcaactcacgcaacacaaagaaacaaaacaggaagaaatagcaacactctaaacacatgcattattttcattttgctgtcatccaggaaacatcagggcatcaactgaaggcaagcacgctgaccatggtccacggcatgctgcatctggtgcatgtccggtaaaccaaatcccagcagggacccccaaccctggagttctccagctctgctgctcacaggaatctcctggggctttaaaaaccctgatgcccaggctgcaccccaaaccaattaaatctgactctctggcagagggaagcgagtgtcagctgagaagggtgagaatcagcgtcctaattcttgtttctctagctcccccattaaatgtttcagaggcacaattagtggcttatcccataatgagatgtcactaccaaagcctaaaggagaaaacaaactatgacacagatctgatcccaacagccagtttcaggtcttctattaaagaactgaccaaggctttgacaaccgctcagcctctgtctactcatccataaaatgaggatgagtcttgcctgctctaccacgtcagagggagctacaaggttcggaggatggattcagagtgcacatagaacgataaagctgacacagacacacgtcaccattcagcactaccagcccaggctgcagaagctcctttcagagctgtatcttgtagaacaggcatcccaaagccccaggtcatgaagcagtactggtctatgggcagtaaggaaccgggccacacaggaggaggtcagcggcaggcaagcgagcattactgcctgagctccgcctcctgtcatatcagcagcattacattctcataggagagcaaaccctatcgtaaatggcgcgtgcaagggatctaggttgcaacctccttattagaatctaactaatgcctaatgcctaactcctgacagcctgagagtgggcacattgcaaaaccatcctcaccactgtgccctgtccatggaaaaactgtcttcacaaaaccggtccctggtgccaagaagtctcaggaccactgctgtagaagatccagattcctggctatttccataccccaggagacagacccactttcctgatcttagtgaccagaacaggaccagcttgtttatgcagtaagtgagatgcaaggctgcttgtggcacaacgagacgaagaccactggaagatgcctccccaaaatactgaaaacactaatgctgtagaaaagcagcaaagggaaatggtctaaagtaaataaggagttttaaataaagtaaataaaggaaaagaattttaaaatactcattttcggttttttttttttatgtttttttttcgttagttttttttttaattatactttaagttttagggtacatgtgcacattgtgcaggttagttacatatgtatacatgtgccatgctggtgcactgcacccactaactcgtcatctagcattaggtatatctcccaatgccatccctcccccctccccctaccccaccacagtccccagagtgtgatattccccctcctgtgtccatgtgatctcattgttcaattcccacctatgagtgagaatatgcggtgtttggtttttcgatcttgcgatagtttactgagaatgatgatttccaatttcatccatgtccctacaaaggacatgaactcatcattttttatggctgcatagtatcccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtaaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcagtcattaaaaagtcaggaaacaacaggtgctggagaggatgtggagaaataggaacactattacactgttggtgggactgtaaactagttcaaccattgtggaagtcagtgtggcgattcctcagggatctagatctagaactagaaatatcattttcgttttttttccccctagagagcttgttaaaacacatgaaacattctttttttttttttttttttttttgacacagggttcactcagtcacccaggctggagtgcagtggtgcgatcagagctcactgtagcctcaacctccctaagctcagatgatcctcccacctcagcctcccaagtagctaagactacaggtacatgccaccatgtccagctaattttttctattttttgtagagacgggttttcaccacattgctcaggctggactcaaactcctgggttcaagtgatccaccatgacctcccaaagtcctgggattacaggcatgagccaccacgcctggccgaaacatgcattctaaactagaagttttaaaatagcatcccagggctagaacgggtgttctaaaacatttttaattagttgccaacatatttaaaataatattttacatgagagcctggatttcccacttctctcaaaacacaggaatgaaaatgctggctgatgtgatgaaaataatcaagcttactttgaacaaaacatgatttaacccagctaggagcacattaggtttgactgtccaggttttctaatttcttatttaggatttagtgaagaaaccaccagtgaggggctttctcttcttttttttttttttttgagatgcagttttgctcttgttgcctaggctggagtgcaatggcacgatctcagctcactgcaacctccgcctcctggttcaagcaattctcctgcctcagcctcctaagtagcggagattacaggcactcgccaccatgcccggctagttttgtatttttagtagagatggggtttcaccatgttggtcaagctggtctcagtctcctgacctcaggtgatctcccgcctcagcctcccaaagtgctgggattacaggcatgagccactgtgcctggccgaggcgctttctctctcctttcctcctgtctttccagtgtgggccgcatctctccagctttcattccttctgactccttgctggtgcctgtacctcccaaggccctaaaggtgtgcaacttttgaagaatgaggctgccaatccctggagctgtaaagcagggacaataatagcaggttcttatcattgaagaattcatcccagaatccttgaaatcgaatacactaccacagtttgcagacagaaatgaaagaaataaccttgtccttaagccagaagggcttgaggtaagaaagccctctgatatcatcagtgttccttgcaatcaagcatagacagagagcaacacaggcctggcctcatttctgtggctcagctgaccaaacagtctgtgcccaagaaagcaggcccccctcccacgacagctacaggagggcaaaggaaggctcaagttgcacctggtgggacagttacacctctaatttagacatcatttcaaagaaggagggtgggcgtgggggcgcggagctaacatataatgtaatgctacccactgtctgaggccaagagggctcatcttgagataacgtgatgacatcaaatgagcagttctacttctgttttactcacgtcctcaactctcaagcatcactcttccactcttttgtgattaatcatgccttttaattcagccttgtctctcctgcacatggacacttcctctgagtcccccttaggtttcatggctctgtctgcattttcaaagcttgacaaacccagctcagcacttgaaataggaagctccctaacacaaggaagcctttagcttcctataagtcatacagagaagggaattgagaacagctacatgtgcctctgaaaataaacaagtggataaaatcatatcacgctgaagccagagaactcaaactgctggtatcatcccagcatatgcaatattaacacgcagccattatgagcttcgttgaggttttcaggtgaggcctctgggcctcccacatgctgctccatccaccactacacctgttgtcccaggctagtctccacttcaggtctgtctctccaagtacccttcctgatgccacaagtctgttagacccaaccccccaccatgggcttccacagcaccacagcatccagtacaacaaaggcaagaactgtgcctagcttggagaccactgtatcctgacacgcagcccagaggtttttaaaggtcttggggggctctgcaaggttaaaattattttcattatgacaccagcatattatttgtctttttcacactcacatttctgatagctaaggaaatatgtgcttatatattcctatgttttaactttctattttaatttattatttttttttaagacagagtgcagtggtgtgatcttggctccctgcaaccttctgggttcaagcaattctcctgcctcagcctcctgagtagctgggattacaggtgcctgccactacacccagctaatttttgtattttcagtagagacagggtttcatcgtgttggtcaggctggtctcgaactcctgacctcaagtgatccacccacctcggcctcccaaagtgctgggattacaggcatgagccaccgtacccggcctctattttaatttctaatgtggcctcccacctctccagtctccactctcaccacccatctgaagtttcagccatttcgtgagactttgtagctcacagtcatactccagagcctggggtctctgtacgctttctgcttaaaatgctactgccagccttgtctgttggctgactcatcctgccagggagccctgccctcagtgctgatgtcctctagggtgtttctccagccctcccaaggagctctactcaatgcctcctgacccccacgctgtcacgccttgaatgcaacattattaactagagaacttgtgaggctttctttgtttctgttgttcccacaagatcatgagctacttgagggtggggatcgtacccttactcatctctagccaagaaaagctctgtggcttttattgagcccaatggagagacagacattgagcctaagagagtatctactgttcaccagctaagcctatttggacctcaatagctcaacttcccccaaaacaccttgcttgtaaacataagctcacattgatgttcctttctccagacacctactgtactttactatctacacagcagaacttagaactcagtgactagtagactttgtctattcattatttagttatgtaagattcttctccacattcatagcaacagtggtccacctgcagcaaccgctaccaagacgctggctacagcgggggaggtgcagctgggctgcatgctccacagagccagcaggagccaggagcagacaggagcagacaggagcagacaggagcccaaagcaggaaggagtcctgcactgtcgcagcccagccaggtgtgcgcacacttagggaagcactgacatgccagtccacagccacttcagccccctccagacttttagcactgatgagcatgggagggaggctgaggtggggctgagggcagctcagcgccggcctgcaggcaccccttggcatgaacagcctgggcaccatgaacagcagcaggagacaggcaggctcctgggtagaaagaaggaggtgggtcctgggtgaagccccagcttcaaactgaggaggacatgaagcctgcggaccaggctgccaatcctgcagagtggagtgggaacttgtggttttttgccgggcccacccatagccacctatggaccaatctgcacatatttcctcccctatgaggcccataaaagcccaggattcagccagactcgaaaagacaatgacctgccagctgccgagaggatttacccactccagggtctcctctctgctgagagctgaacattcaacagatgacctgcctgcagagtggagctacccactccagggtctcctctctgctgagcgctgaacgctcatcgggacaccctgcctgctacccagtgcgggtctcctttgagctgtctgtcgctcaataaagctcctctttgccttgctcaccctccactttcccatgtaccttattctttctggacacaggacaggaacttgggacccatcaaatggtggggctaaaacagctgtagcatgaacagggccaaaacatgtcccttgctcaccacgttgcaggcaacaaaaaggagagaagaggggagagaagagctgtggccctctagggagcccaggcctaggagctccctgagccagggctgtcacaccctctttggggctctgtggtttctggtgtctccgaacttccaggtgctaccacattccccagtgccagccacggaagctgtttgcagtacatctggtccagctgcagccttgcagggagctggcgcccatgccagcacctggagttgcccaccccactgcagtcagcacgcctggctgtgagcagtagctggaccccacactcgctcacacaccctttgccgctccatgcctggcttgcccttggcaggcatgggatccaggctggtagcacaagctgagcacagcctgccaggctgagtggacagaatgagcctgagcaaaacttgggcaaaggtgccactggccacaaaggtttccagctggcaaaatgacaccccaaggatcccataccaacatcaccacaatattcatgtaaaaccctaggtacaagacaaaattgtaatgttgcattcattgtgcttactctgtgcaagcacttcacagccattaattccttaagtcctcaaaataaccctatgaataaggaacatatgatcctcctcactgtacagaagaggatatgagacgaaatcagaagacagagtgccacgtataaaacaatgcaggtggttagtggcaatggcaagatgtaacctgagaacctacccttccacatgcatgcctctgccacactctgcactgtactgggcatgatgcaaaagttcgggattatgaggctaatgacatccccaaagaaaccttactgacttaatcaagccatagaccaaaggccatcctccaaggaaaagctcataaaaggaaaaagcagtttctcacatgcagaaagcacttaatgtctgctgaccagatgaataaacaaataaaaacaaagcaaatcaataaatacaaatatgcttcaagggcttaagaagatggtatagaaaaatacatcacctttattcagtactgattagtgatagctacctctcaaaagtcagagaagggaaaagggaaaagggggaagatggcaaaaacaaaaacaaccacaaaattttctcattcttcaaaatcaaaacagaaaggaattcaagccaagatcaaatcaaagacaatcaaatcagtttcatgagcacttaggctctagagaaggaggaatggattatttctactgactcattaattcatttattagtcattagaaagggcagaaaatctgaaaactatttgttggtagaaaacataggctatgttaccctggaaacaaggttcccttggggaaaagcttgccttggagtattcctaaattccctcctttaccatcctcccccttccaacactgggccactcattagacactgataacatcagcccccacctccccagctcatcttcagaggtggtccagtaccaacagaataaaggctgttcatctcagcactagaagaaacttacaggtcacttgggtgcaacttctttacatgacactctagctggtgatcagcctcaccaaaaacaaaaacaaagaaacagcacaaccaggtggtatcacacctgtctcctcaacagaatggctctccacattctcacaccgctctgccatgaaccaactggtcactaactggctacccggagactccagagagcaaggactatgcccactgtggcctcgatgcaaaacacgatgctttgcactctatatgtggtcagtaaatgcttgctgagtgaataatcatgactgtatacatccatgcctcttgcgcaaatcactgtgtgtctattcttgccccctgggattctgttctccattagcagcacaagtgaccttttgacaacatatgtcaggccaacacatgttctcactcctccaatggccctaccacacttaaaacctaagactttaggtggcttaataggccctatatgagccacacttccctattctgggcccacagacctccctgcacccattgcatgttccaggcatgctcctgacacacagcctctgcactggctgttacttctgcctagaatattcttcccagatattcccacggttcattaccttacttccttcaccaatcacctacacagccagtccttccctgaccactgttatctgtggttagctacccctttactgtgctttattttctttatagaatgttcccacttaccactaccttatgatcttttgttcactcactagacctgtgctgtccaatatggcagctactagccacatgtggctactgaacacctgatatgtgactaatccaaattgagctgtgctgtaagtacaaaatcatgccagattttaaagatgtatttaccatgaaaaatgtaaaatatctcattaatactatatatagtattaatattaatcattaatattaatcattaatactatatatattaatactatatatatatacacacacacacacatactaatactatatatatgttttttgagatggagtctctctctgtcacccaggctggagtgcagtggcgcaatctcggctcactgcaacctccgcctcccaggttcatgcgactctcctgcctcagtctccaactagctgagattacaggcgcctgctactacgcccggctaatttttgtaattttagtagagatggggtttcaccatgttggccaggctggtctcaaactcctaatctcaagtgatccacctgcctcagcctcccaaagtgctgggattacaggcatgagtcactgcacctagcccactgtgcattttttatgtataatctaccccatatagtcatcacagtaacaccagaggaagagggcaagaagggaggactattaaagtcatgtttcagaagaagaatctgaggctcagagaagtacaataatacatccaagctcacaaaatgagcaagtggcagactcagaatgcaaacccatgtcttccagcctcagcccctggcacctggtcctccactcgaagcccaggctggcagccagcagacagcatcatacccagagagagtatctgtttggcctgcatggtttccttgtttggttgtttgtttccgctaaaatccttgccaatatttgaaaatttagggattttaacagtacgggttcccatttttcattcaacacctgaacacttggtacacgccaagcacaaggagcataatccaagaacaagacagaaatggtcccagtgctcacagagggactcagactataaaccagtaagtaaggaaaatacctaagaggccaaattttgataagtgctgtaaacgaggaaaaatagaggggggacaggaaacaccagcaatagggggcactattttcaatggaataactgagaaagcccacattgaagaagcgacatttgaacaaaaactcaagagagaaggagtgggagatgcggacatctggagaaagaacacctccagcagacgagtggcaggtgccgaggtcctgaatggcatcactgatcagaatggagaaacatcatctctctagacacagagtgtggcagaaagagacaacttcccctgttgggtatagaattgttactggaacgtggctcctagccagtaacaacaggttcccagccttccctgcatccggcgtggccatgtgactattctcaccaatgaagggtgagcattattgatgtgtctctcccacaccaaagcagccaagaagaaggtgtgcctcctccaccctctcccctcttccgctggctaagcagagaagactgtgaggccccagaggtataaaagaggctccaggatatagaagaaaaaccacctgctgaccaggaactgcagatcatcatctgtttacatggcaaaagataaacttctttggtatctttagtgagagccacgaaaatgtgggggtagggtgggtgcgatggctcacgcctgtaatcccaacactttgggaggccaaggcgggaggattcacttgaggccaggagttccagaccagcctggccaacatggcaaaaccctgtttccattaaaaatacaaaatttagctgggtgcggtggtaggcgcctgtaatcccagctactctggagtctgaagcacaagaatcgcctgaacctgagaggcagaggctgcagtgagcccagatcatgtcactgcactccaacctaggcaacagagcaagactcaaaaaaaaaaaaaaaaaaaaaaaaccaagtgggggtaaatttgttatggaagctagcaagtgccctccacagcctattatctccctgattgtgaagatgaaaatatatttatttttatttattttctcctctctgctcacggtttctaatgtggaattattccaggtctgcctggtccctataggcattgagtttgcaacccttgtactatatatttaactaattctgcctaaaaccaatacttgccacaccactgagacctgtcttcctccaactcactctaaactccaaccctttccatcccaccaagaatcaaaatgccccacgtctcatttgataagtgaaagtaaacaattaatccaatcaaggtgttaacagcccaaattgcctatccatagtccatcaaaggatgccaggaggcataattcctcaatcttttgaatggacagaggtattctggaggaaatgccgtctactcttaccctaaatatggttatcagcataggcaaagttgcccctaataccaaaaaaagtcttaactaagaatgtttcacacagctgggtttaacaaaaacaaaacagcaacaacaacaacaaagactgtttatgcctgtaatccccacatgctgggaaggccaacacagaaggatcacttgagcccaaggattcaagaccagcctgggcaacataaggagaccccatctctacaaaaaaaaaaatttaaattactaatagctgggtgtggtggtgcatgattgtagtcccggctcctcaggaggctgaggcaggaggttcacttgagcccagcaggctgaggctacagtgagctgtgatcatgccactatactccagcctgggtgacagagcaaaaaagaccttgtctcaaaaaaaaaatgctttacatgataataaaatgaattttgttatcttggactggatcctggaccagataaaagacattgctggggcaatctgagaaatctgaataaagtctattcagatttgtattcaaataatgatacaacattcaaataatgttgtatcaatattactttccggttttgataattataagatagttatagaagaaaagaacattcaaagaagttgggtaaaaggtacatgggaactctgtattatttttgcaaattcttataaatacttcaaaataaaaagttaaaaatatttttaaaaaaagaaagaaaagcaccttaattgaatcatcacatgtgagcaccagccaaggaccactgataccttctcacaagggcccatctacctcgtcaaatgaaaacaccaactttagggaaaaggatgagaacagaccagatattttcgtaaagccttatctggcaaattgattgaatttgagctagtctccatcacctagaatcattttttcttgacagttccctggggaacttttaagtcctgctctgaggaagttcacacagtgacttaactgtgtcccaggcagaatccctgtgatggcttagactttgtcaataagaatcagcaggtgcagtgaggtgagaccacaggcccctggggcaaaggacaccaagttcctgagagcaggcatcccatggagggttcagaatcctacactcttaaaagtttaaaatcttgatctgagcaatggctcaagcctgtaattccaacactttgggaggccaaggcaggcggatcacctgagctcaggagttcaagaccaacctaggcaacatggtgaaaccccttgtctaaaagaaatacaaaaatcactcagctacttggggggctgaggctgaggtgggaggatcgcttgggcctgggaggtcaacgctgcagtgagccattttcgtgccactgcactcaagcctgggtgacaaagtgagatattatctcaaaaaaaaagaaaaaaagctctaaccagctaacaagaggaaacggaattggcagtcactctgacggcatgatgtctcagtgttgtctcgagtaacaaaatcagattttaccaacttcttctctggataataaattcacttcatcagtgtttttttcaaactatgaatcataaaatcattttagtgagtaacaatcatctttttttaaaaaaatataatagagaggccgggcgcagtggctcatgcctgtaatccctgcgctttgggaggctgaggtgggtgggtcacctgaggtcaggagttcaagaccagcctagccaacatggtgaaaccccgtctctactaaaactgcaaaaaaaaattagctgggcgtggtggcgggtatctgtaatgccagctactcaagaggctgaggcataagaattgcttgaacccgggaggtggaggttacagtgggcagagatggagctgctgcactccagcctgggccacagagcaagactctgtctcaaaaaaaagtagtagagagtagaaaatatcagcatgcattgagcagatgaatgtcttactgtggatcttgtttgaagcacatagttctatacaatcatcatcagccttccaaaacataagcgcccttcatttcaaataatatgacaaatcctttctcactaagtcagtgggaaaaaaaaagttttaaatagttcttatattcacaataacttttattagaaaatctgaggtgtgttgccatgaggggaaaattcttttgcaaactgaagtcaaaaattttaagtatctcccccaagatatttattaattacaaacaggaaaaaaaaaataaaacattacagtggagaaaccctgcagataccaccttaaccacgtaatcaaggtcaacatcaccagtagtaagacatattgacatcacataccccagtaacatatgaaggacacaaaatcacttttgtggtattattgtcaaaaattgcttaacttcaacgtatttgtgataaaacatcagagaaagccacactgagaaccattctaaaaaataactgaccagtactcttcaaaaattaaggttatgaaaaacaaggaaagacttacaaactgtcacgtaccagagaagactcaggagacatgctacatttagatgcaatgtgggatcccggattggatgctgaaccagaaggaagacattagtgggaaaactggtgaaatctagataaaatttagttaatttcttcgttttgatcattgtgctgtggttacataaggcataatattacgggaagttcggtgaagagtttatatatgggaactctctactattttgcaactttactataaatctacaattatttcaaaataaaaattttttaaaatatcttttctgaagaaagaaacaagagtattctgccctataaactgtgtatcatttaaacacagtaaagtgttgtaccatagtgctgtacctccaactctctaaccttaagggataaacataatgtgcattggtgtgtaatatgaagtaatcttaatcttcattgggagtgtaatattaagtaaacttaatacacgggaaagagctgaagctgtccttgtttacccaggctcttgctcagccctccgtcacccctcacgtcttcctaatacccaataggaggattgtcaagatgctcttttcctcctcacggagaacaatgtgagacatgcaacaaacgccgtgactacggatcccaatccctcacgagcaaccacagaaagtaagaggcatgtgtggagggtgagtggagatacttataaatgtaacaaatactttctgagtgctcaggtcttcccggcacagttccaggccccggggaaacagccatgaacaagatctacacggtgactggctctcagagagtttaagagataataagcaaacaaaaatatattcacacatacacacacgtatacattcataaaatggggaatgttagcaagccagaaaaccagagtgaggtaataaagccttctctgaagacgggcatatgagacagaacctgatccttctttgagactcagtttcccatctataagacggatctaatgatgttcacccctgtagaactgttgtgaagaagtgaattagatagtacagcgcaggatttagcagaattcctagcaagtgaatgagtggccagaaatagtaatgagtgaccaaattactgatcaacaattacattgaaagcattaactttctcaatttactttaaattctacatatcccactgaaatgtacttaaagtgtctataaataaatgactgatcacagaaacagctatttcctatctcatggacagcaacaatgaaaaatgaatacatttggaaatggacagagcaaaaaacacaaatgctccgcccagggataataggagtgaccgaaggcaagcttcctggccccactggtggttacctcctttgtgcttggatgaatgtgcgggctaagtccaagccagtgctgaccaacctccctggaaggattttttcccctgtctttttataacctgaacgtgaggaaaggcagtcaaagccaccaaaataaatctctcagtcctcaggaaggagctaaaacactattacttcttttcccaggctacaggtctaagtataattaacatattctctttcacaaaacaagcttcagtaagatggcatcccaattccagaatctgcaaaaacagccaaagctatcaaaataacttagaaaaacagtcaagaaacaaggaagtatcacatcaatcaactttagaccaaactgctatatatcacacaactggacatttctaaataacttctctctctctgacaggcaaaaagaaacacatacacactcgatctctgccactccactctctcccactccactctcatgctcacacagtttccatgtttaaaataaagcaacagaagtttaaaaccaaattatgtgacccaagtcactcaagagcaccttttaaactactaatacaccttgtataagtgtattttgcacacaaagatattttaaaatattgtataaggaaaaataccagacatttgcatcatattacttataaagttcacctaaaagaaagaaaaaacttccatgcgctcccaactcaaggtgtcagcaacagcagcaactctcccctcctttctctttccagccagcagccccttccctcccttgctcctccagccttctttcaccaaccccaaactccctgttttctttttctcttcttcaaaacaaaaagagacaaacaaaaaaatctgtcttctgctgagcctgggtttgtcatgtccaggtaagggctgggatccagggatgcagaccaggccatgcctcaaacatggagtaaaaaagtttcaaaagattacaggagtccttgcggtaatttgctgagaatgatggtttccagcttcacccatgtccctacaaaggacaggaactcaaccttttttatggctgcatagtattccatggtgtatatgtgccacattttcttaatccagtctatcactgttggacatttggcttggttccaagtctttgctattgtgaatagtgccgcaataaacatacgtgtgcatcgcaaggacaaaaaaccaaacaccgcatgttctcactcataggtgggaattgaacaatgagaacacttggacacaggaaggggaacatcacacaccggggcctgttgtgaggtggggggagaggggagggatagcattaggagatatacctaatgttaaatgacgagttaatgggtgcagcacaccaacatggcacatgtataccatatgtaactaacctgcacgttgtgcacatgtaccctaaaacttaaagtataataaaaaaaaaaaaactgaaagaaaaaaaagattacaggagtcaacctctgcttagatgaacggaaatgaggctccctccttcctttcatctctccattaactggaagggcagcaacaggctacctccaatgccctcacagcccaatcacactgcacaagcctcccacaaccatggcactgcctcccacccctccacagacttgagcccgaccacctgactgtgcagcctctcacactggcgaccttccctcctcccaagccttgagccccctggtcaggcgtgacattctactctcctgccttcctcccttcctctctccatgccccttctctctccaacttgatcctccactcctacctcctgaaatctggctgtcagtaaccatagtgagtataaaagataatagtaactatgatttagtggacagttattatatatttatttatttcatctgatctcaactacttatacagcattattttatggaagtggttctcaaatgttgtggcctcaggacgcttttataggcttaaaaaattactgaggaggctcaagagcttttattaacatcaattatatctactgatagttaccatgttagaaattaaaactgtgaaaattttaaacaaaatgcacagcccatagagccgtgacatcatcacacaccatgtagtttctggaaaatttgactgtaccttcatgagagaatgaaaaaatggaatataacatcttagtagtactgtgaaaacagttctgacgttgtgaaccccctataaaagagtctcactgatacccagttgtccctggaccacacttggagaatcactgttttacaaaacagaacctgagccttaaagaggaaaatcaacttgcccagtcactcggctagcccactgaagagctccagcctgaacccggctcatgcagcactgctgttaccctttctctttctgctttacccttcctgagagacagaattcacttccaccacagcaactatcaccttccagtgacccatctgcaaatgcgcatccgcagagctgataactcacctgagtttctactgcccggagttcccaccagcaccccgaaacaaatcaacagaccaacacgcccttctacccaccccaacccgcgtagggccagcatcactgcctttgggaaaggtcattcttccacttaataaggccccaagccactcagagtcatctttgactccccacttctctatgtcctgctgactggtctttagaatgtctcttgcaactgcaaaaagcaggatatagaagtgtgtacatgacgacgttcctacacaaacaggaaaaagactaggtgcaaacgcaccaaaagtttatgagtagttagctccagatcgtgggattatgagcaatttgcgatttgatttcttcggtatatttttctgcataacacatacgtttcataagcatacattattttcataatcagaaaatacagtgattgcttcttcagggctttgtttataagttttgtcccttgcctctgccttttccaattataaccatgcccagaatccaatcgccatgggtcatatttcagttctctttactgtcttcctgcactggttgtcagcactcagacagacatcttgaacctcagtcttgcgtcacggagtggtggcaggaaagtcagggagataataatgcataaaaggcactttgcacagcccttggcaaatggtaaataaaagttcaccattactggtgctagtattattatttccctacactactattagatgaaacttcagaaaacactaattggcgaaagacagccctgttttagaaccatcagtagctcacaatgcctaataatatacctgatatttacagaacgcttacttttgggcccagcactgtacgaaatgctacctcattaaattaccattccagccccacgaggtgggtcctatggagatctccattttacagatgaagaaactgaggcacagacatgttcaataaagtgccaaggtatggaggtagaaagtaaaagagctggaattcaagcctttattcagacttgctgcacaagagaattttccaggatggtggatatatttatatctacattattgaatatgtgtctgttgagcatttgaaatgtgcctaatgcaattaactaaaatcctttttttattttattttatgttaacttaaatagtcacataggtggccgacagttatactggccagcatagggatctagagatcaaaaacccaaatgcccaggcttcacaaagaaaagtcctcacaacaccctgtctacctgccttgcaactaattcttacaaaatcttcaatttgtctaaaatcattagtgaaataaacatgttcctaccttccaaccaccccctgcccacctctcaactaagtcttctgtataatgaaaggactttaggaagttagagtaggggagacttggattcaaatccagcatcatagtatctagctatgtgaccttgggcggtcttatttcttatttctgaataagagacctccttattacagtctctgagcccttgttcctcatctgtagaatgggctgacaatgccaacttccaaagagtatcagccaagcacctaacagaaattatctatatggtcgctggcaatatcccttcagggctcaactcaagttccaccctcttatctaaagagatggcagaagcactggagatctcttcctctagcctctagaatcccctagaggttccatctcaaccgtacacagattctattgttatttttgtgtgttgtgtattctctgatcggcatttccctgaggccatgggcttctgtcatctgtaagcccagaggcaacgtcactacataaagggctctgaagggaaccgaagcagctggctcaacccagcattattatctgaggggtctcagtctcccctggcttttataggtcagtcaattggtgagaggaggaaatgcaattgccaaggtaaagaaataagcatagggctggcagctcacgcctgtaataccagcacttggggaggctgaggcgggcggatcatgaggtcgggagatcaagaccatcctggctaacacagtgaaaccctgtctctactaaaaatacaaacaaaattagccgggcgtggtggcgggcgcctgtagtcccagctactcgggaggctgaggcaggagaatggcatgaacccgggaggcggagcttgcagtgaaccgagatcgcgccactgcactccagcctgggcaacagagcgagacttcgtctcaaaaaaaagaaataagtgtagtacctggtacctggcagtgccttgacagatacttcccgtccttaatacaagacatgtctgtcctcatcatcacagacctaagaggctaaccatgaactactttccctttgacctatcttctttttaaaagaggaagacgtcagtacaccctaaagatatcaaatccaggcaaaatgccactggtggttttttttcttctttttctctcctgaacttgatagacttgatactagattctacctgagaggctaatcaggaagaaaggctaggaacagtcagaaaagagaaagaatggggtggatttgccctatcagataagcaagcacattatacaacatagctataaagctggcacatcaccagcactcagtaaatattttttggcattttttaaatacttgtttttgaataaagttacaattattaaactgtaaaaataatagtaatgacaacaagcactcttcagggagcccctgctgaatgccaggctctgtgtggagagctttatccacatgcgttatctcacttgaacccacaacagtgtttttcacacccaactgcagctctttcgtggatcacacctgtaatcccagcattctgggaggccaaggtgggaggatcacttgagcccaggagtttgagaccagcctgggcgacacagggagaccccgtctctacaaataattttaaaaattagccaagtgtggtggtgtgcaccaatagtcccagctactcaggagcctgaggcagggagatcacctgagcccaccaggaggttgaggcttcagtgagccacgactctgcgccactgcactctagcctagacaacagggtaagaccctgtctcaaaaaaaaaaaaaaaaaaaaaaaaaaaaaaaaaggcatagctgtgactgtcttaagaaactgactttgactttgagcaagttaactatgtgctatgatctgaatgtttgtctccccctaaaattcaaatattgaaacctaacccctcactgagatagtattaagaggtagggcctttgggaggtgattaggtcatgaggtccttgtgaatgggattagtacccttataaaacaggcccaagggagtctgtttgctcctgccacgtgagtacacagcaagaacctaccatgtatgaggacctggctctcagaagacagccagacagcctatctgctggcaccttgatcttggatatcccaagcttcagaactacgagaagtaaatgcttgttgtttataagccacccagtttacagtattttgttagagcagtccaaacacactaagaaactctgtctcccaatctgtaaaatggcataacaataatgtctctacctgccaagatggctgcaaagattaaactggattttgtacctggagctaggaccagagagtctggcacagagtcaagtctcaataaaggtggctaccattttgcctacgtaacagaatcacttccgcatttgaaatgagtattactgccacataattgaaagccataaggcaataaaaataaactcatcacatcttggcctgaatcaagcactcatattccttacaaggctgactgattactgcaaaggcccctagtttagaaactcagtcaaactcaatactccaccaccagcagtccttactttccaataactctgggacttgtttttctgtaggttgctttccctttgcctgaggctccactactctaaaaataaacattaaaaacattaacaacttccttcaatcctcctcacaaccaactgaaacttctccagtgccaatgaattttgtaggtgactttttaaaattacctaaataagcactgctgggttaataattaattctaagtattaattataaaactacgcatgaggaaagtaaaaacaaacagtaaaaaaaaagcctttcatctttgcctaatggattcatcatcagtcctcctctttagaggtatcagtgttaggtttcttacaaaccattacatatagatgaatctgtgtgtgtgtgtgtgtgtgtgtgtacatttgttagcacacacaaacacacaactttactccactgtggatatcttgcttttctcaatcctctaccttggaactcttttaagatcaacaccctctttttaagacttgcataataatccaccaaatgatttacgctataacttaacaaatttcccaattttgtatattaaggtcacttatgattttttgttatcaatgatgatgcaaaaatcatcatctttacacatatatctttgtaggcagcaatataatccatataataaaaattagaaattagaaaaagtagaaatgaaatggtcaaatcaaaaagtttatagatttccaattttttaagggaagcattttctgcttaagtatacagatttctaatcttgacagctactgtcaaatttcccaatatgaaagtttcagatgttttgatcccttatgcttccgtgatcaatgcagaggcgtctgtttcatcactcctgtaccagcaattggtgctcagttaatatttatcaatctcactggtaaaaaaatggcattttatcactattatagtatgcatgtctttccttataaattaggtcaagtatattcagttgccaatttatatatctctttctactcactgccaacttctgaatcattgactctccttaaaagtactgttgggaaggttatcaactagccttgtcttcaagaccaaggacaccatcttattctcatcatcctggcaatatttgacactaacccccaccacctccttcaggatgctcttctccctttcctgccatgaccatttgctgtgctggttctcctttacggactgcaagccaatcttctccctgaaatcctaaagaggggcatatcccaatgtccaatccctggctcccttttcttctcacgtaacatccttaaattgtggtttatgtgcaaaagatttccaaatgtcgatcctcaaatcacctgagacctaaacccacattttcagctttctgctgaacatctctagcagagggatggatgtccttcccacacttcagataatgaacaaggtcaacatgcgtgaaacacttgctctgtgcttgtacttgacacttaatacatctcatgtaactctccacatccaagagagaacataccaacttcattgtccaccttcctcaaacctgttcacctccttcagcatcaaacctcagttaatgactctacactcgcattcttcccccttcttcccatccagtgagctgccaaatcctgccaattctgccagtgagtggtcttcctgtaactatcctgccttccaatttcatctctggctcaaactgctaatcacctgcctcttacctcaatcttgacaccaccagagttctctactgagaatataaataacatcacgcgaatctgcctccccaaagcccatggcctctggacttatttcctgccatccctccatgtacctgggctccaggcctacactggcaaggcactgaactcacagttcctgtcccagcaggcccaatacttcacaagattcatgccagtacataatccctctctcaccatggctcaccaggtctcattccccttgtatcccagacagcaccctgaggaatgctatgtgtttggtaggtgcttaacaaatacttttttttttttttttgagagggagtctcgctctgtcactgatgctggagtgcagaggcacggtgtcggctcactgccagctctgcctcctgggttcacaccattctcctgcctcaacctcacgagtagctgggactacaggcgtccaccaccacgcccggctaattttttgtagttttagtagagaaggggtttcaccgtgttagccaggatggtctccatctcttgaccttgtgatccgcccgcctcggcctcccaaagtggctcccaggcatgagccaccgcgcccagcctaacaaatactttctaaagttacacaatacaattttctagcatgtgttcacctttttccaaaaaagaaaaagaacttctatacacatgaaaatccataataaagaaaaatcgttctaaagtttatcttctatgatggaatgtacacagaaacaaaaatattcccttagagcaaaaaagtcaaactcttactctaaacagctttagaaataactcaaaagtcacaaaaagcagattctgaaaacactgggttttaatgattacaaaccaaaataatgattccctacttgccaagagaagaaacagatttagatgagtcaaataaggttctggaaatcttttgattttatggccttcggctgccccaatcaggcatcagaactaccaaacattaacctccacaagttgatatgacaaaagcaaaaaggccctatggtaagtcaaatatccaccaacttggtagagaagtcaataaaatcaaatggctctgtgtgaaccttgcctgtcaccttggaggacacatcccatttctacctcattctttgaagtcaaaccaatttaaaaagtaacttttccaaagaaactttctaaacggattaaaaagaggtcattgaaaagggagcacaggctatttttcagtgaatgaagagaaggattctgaaaaagcattacttcgtagaaatatataacaagattaaattttgtgtgtaacactcttcctctctcttaatatcagagtatttcaaacacgtgtaaagcgtccctgacttttttctaggagtcaggactttgtcaaagttttcccatccactctctaacatgaagttaggaactgctaagttatcgattagacattcagggaatcaaaatcatctctaactgaaagattaaaaagtagcatggttaattgttaagagaacttctgagttggtagaaatgaggggttcacctgacagttcgtggtgccccccctcagcactctcaccttccccccaactattttacatcttcatggtaacgttcccttgatgcttttttaaagggggaacaagaacatctcaagttaatacgatggagagagttaatagaatcttctcctttaccaccagggtcctctccagggcaatgtgaacgggacagcagtgcacgaagtcctccaggcccccagaggccacagcctgggcccggtgggccagggaccagccggtgacacttttaagtccaggctggctttgggggagctggaaacaggcttcctctgggtgggggcgcgacgagggggcggggcgcgggcggccccactcacctgcgattcatgggccggaccctcacggccaccttgaccgatgccatcgctcatcccgaaccagcccgcgcggggtcccactagcccagaactccgcggtcgccggcgacgctggctactcagatcgcggctcccgcccacttccctctcgcccccgcccctctgctcccggccggacctggagttccgcggcagccccacctgccaggccactgagcatgcccagaacggctccggcccgcgtgatccatgcgccacggtttggcggcggccgggcggtgcagaggggcggggccgcggggcctggaagcagcctccgggatctgcaagtctggaaaggccacgttgtggaccttggcgcagaggttatgggggcgacccggagcggatggtttcaggaaaactagaacccaccctcatggcctgaacaactggagagaagaggatcgcagcaatttaaagccagcggcaaggatcacagtcctggggtcaggtgaccaaagccagtttttcagcccttaacaagaacctggcttcacccagccaaacatgagttaacgtatccattttacacacgaacaaactgaggcgcagagatgatcacagcttgttggtggcaaactccgctagggccttctctgctaccctaaggaggtccgaccgtatgttttggaccccttaactcgggataccgataaacgaaaattaatagggtgttggatgttttaaatgtgtgcgggaatgtcattatattggctagaatcaaaccttatttagacttgttttgcacttttgtacactttagtaatttttagttttaatcataagggagttaaaggcgaacacaactggtatttttttttttttttttttttttttgagacagggtctcgctcggtcacccaggctggagtgtaatgctgcgatctcggctcactgcaacgtccgcctcccgggttcaagagattctcctgcctcagcctcccgaatagctgggcgtgccaccacgcccggctgatttttgtatttttagtagagacggggtttcaccatgttggccaggttggtctcgaactcctgacctcaaatgatccgcccgccttggcctcccagaatgctgggattacaggcgtgagccaccgcgccaggccgacaactggtatcttaaggcttagggcctctggtagaagtgagctccacctcccttcctgtgtagaaggtaaatgcattcattcattcagtgaatcgagcatgcatgaaatcgtttgcgcacacccagaagcccacctgcgagccacaggagcagccattccaggaagccaagctataatgggagacgcaaggaatggaggcggaactcctgtttttaagtcctagctccaacactagccttgtcagcctgtaattctgaattactgggcgcctctgaggcttcttgtctcatctgcaaatcaggaacaacggcatagagtggtgaatgcatcaagtgggatgatgtctgcaagtacgcaacccgcttacacaaagaattatctttccataaccttccctggacccctagggccagcagggaatcatagcctccctttgtttctagagcccggaaatcactgggttttccctctgtctggagcagagctgggtgcgaatttgaccaacgggtggcaggaacagccggagcaggatattaaggagcgggcgagcttgccaagcatgcgcagtagcggcgggttggtttgagaagccgccagggagccagcgcggcgacctagctggctggggcaggggaggggcccgccttatatgggagctgcgtggggacaaactgttcgggcccaacgcgcgggtctgagagacagccacgcctgctccgggtcactccggccacctggggggcgtcggcgcgcagactctggccagttcagtattcaaactcttcaggagtgctaacttactcatgacagcgattttctgtatcggggtttcattggtcggtggtttagaaggttttgctcattcattcgttaatgtaattccaacaacctacacgtgtttataagccccctttccatccacgactttgctgtctgacacaaaacggaccatcgcagcccggcagacgctttagacaacaaacagcatgcctggagcttttcaataggaagcagtaaggcttgatcatcacagacgatacggaacgggcactttcttagcagaaaatatttctattggggcgtgaaggaagtttctgaaagggaagattattataagataaggggtttgctcatctcagactttagtgtgcctgctttaaagtgttttgcaaacttgaatgtttaaaggaatcacctggcggtcttgtgaaactgcagcttctaatgggcaagtcagaggggaagcctgagacatggcatttccagcacgttcggggagtgaagatgctgtcggctgccaccctccctgcaaggagccaggggatagatgacctctacgcaaactgtgagagcttaaaataactgatagtgaaaaacagttacagaagctctaggccgggcacggtggctaatgcctgtaatcccagcactttgggaggccgaggaggatggattgccagaactcaggagtttgagaccagcctgggcaacacggtaaaaccctgtctctacgacaaaataaaacaaacaaaaataaaagccacgcatggtggcgtgtgcttgtagtcccagctactcaggaggctcaggtgggacaatcgcttgagcatggaaggaggaggttgcagtgagccaagatcgcaccactgtactccaacctgagtgacagagtgagacccaatctcaaaaaaaaaaaaaagcagtaaatccagggcccaaaaggtcagtaagaattcagggatccaaatcagttatgtactgatgcataaaaataatggccaaaaatgtggaggcttaaaacaaaaaccggttattatttctctcaattctttgggttgctggtgtcacccgggctttgtggctgggctctaggctcacctggggtgaggaaaagttggtgcattttgctttttcatcctcaaaaagtttagaccaggttccagatttcttgcggcggcgagacacctcgccaggagagcaccgcactatgcacaagcctttgctggacttccattgaccaaaggcagtcacatggtcacgcccaggcaatgtgggagggccccgcaaaggaggggtgggtactcaagagagccactaaataacaaacctaccttaagatcacatttatttctaacattttaatagttatagttcagtataattgattttcctggtaatcccatttattttattttatgcattttaaaatgttattctgaaaatgttactctcaccaaacaaccaaaagggtccacggcataaaaaaggtttaagaatctatgattttaaaattcaattggatggataaaagacatttttatttttattgtgtatatatacatatatatgtgtgtatatatatatatatatatatatatatatatatttttttttttttttttttttttttttttttttgagacagagttttgctcttgttgcccaggctggagtgcagtggcgcgatctcggctcactgcaacctccaccttccggtttcaagcgattctcctgcctcagcctcctgagtagctgggattacaggtgcccaccaccaagcccggctaatttttgtatttttagtagagatggggggtttcaccatgttggacaggctgatctcgaactcctgacctcgtgatccacccacctctgcctcccaaggtgctgggattacaggcgtgagccaccaagcccggccgacatttttattttctaagaaggttgaattgtgatgggaaggagaagagaaaattctgaaatctgggttaaaacccaaatggtctcaagatgcatatgtgcatggcgggactgtggggtgggggatgtggttgtttagtttgttttgatgtagtttattttggtcttcatttattattgaaatttttttctgatgtttagcaatctcttttttaaaacgttttttcaaatctttttttaatctctattttgaaaacttttttaatggacgaaaacttttgagtgacttaagctctctgagtcttagcttcttcatttccacgcaaaatagcactgtaatagaatgttcactccaccgcaaaatatttgaatcatcagggaatactgttatcagaagaaaaatactgtatttctcatgagctgtgctttttcttcatcctagcctctgaggaataaaattgatttactttcttacaaacatgacttttaaaaaatcttgatgaacatcagactggcacgcttaaattgggacgaaggatataactgacacctcataaacccatcgatttccctatgtgctagaagcactcaccagaagcattatatcacatgatacacttagtgtctcctacaggagtgccttacaccaagggacttaagttgaatttaagagctatgtggtgagccaatgagaaaaacaagtgttttcctggttttcaaataaatgtataataaatagtagtaccagagacaggaatcacagataccaagtccaaacccagcaccaatttttttttttttttttttttttttgatacagagtcttgttctgtcccccacgctggagtccagtggcgctattttggctcactgcaacctccacctcccgggttcaagtgattctcctgcctcagcctcccaagctgctgagattacaggtgcctgccaccacacctggctaatttttgtatttttaatagagacaggatttcaccatgttggccaggctggtctcaaactcctggcctgaagtgattcacctgctttggcctcccaaagtgctggggttacaggtgtgagccactgcgtctggcctacgattttcattttctaagtcacaaaatttaaagtatatttagaatcttctaaaatactaaacattaaaagcaggaataatttgaaaaagtatactttggggctagagagaaaatctgagctccaaaatcacagtaaagataattgcaaaaatcgtactaagtaattttagtaaagctttaggcaggtaaccatgaatgcctgctttcttttatagcaaaagtgaataaagaaatcacattagattcaatttaatagacgctatcaccctaaatcatagtcattttatatactaagataaaaatgattgttttcaattgcatataactgtatgcaaccatatatataaaactatgtggtcataaatagttcagaactgatagactgtagagtctgtggcctcattttaacttcgaaagagtgagaaaccatgtttatttaaagtgattgggaaaagtttcatggatgaattagttttggagatcggtcttgcaggagggacagatttgaacccagaaaatggtgaggaggtgacttctaaagcagaggaaattccttgaacaaatgtttagtgttggaaaagcgagtcctgcttctggaatagtgagaaagcctctttacctgaagcacagtgtaaagtttaaaaatagttgtaaatgcttctcttccctggactcataccttgcgatgtcattttgcagctcccctcaatgggaagtagaatctctttctccacctcttcaatatggctggccctggaacttcccttggcacacagaatgcagcagaattggcttcatgttgtttctaagccttggcctcagaggccttgcatgcttcctaaccctggctctaggaaacttgctgctgtcatgtaagcaagcccaggctaacctactgaatgttggtgtgtcccagtcaaatccagcactgcaaccaatagccaggcagccaccagacatgtgagtggggccacctcacaccagccaacctccaccaagtcatcagatgtatgagtgagaacagcccagaacaactgagcccgtccagaccagcggaacaaccaagctgaccagtagacttaggagcagtaaacagatgattgttatggaagccattctgtttagggtgtgtgtgttattgcttgcatccaaatacatcctatctcatctaatgagaaaaggccctgctcaagggcttttgcagctgtagttgggcgccggaagtgtctttgtggtcatttcttactccatacacggggagatcaaggctcagaccaggtagtgtgactgtggacaacactttccttacccctctgtgacacttaaatcaatgaagcagattcacagaagcatgcatgctcactgaacacagtatttgcattcctacctccaaacctttgctccacccatgcatccagtaagaatgcctacttccctcctctcctccatcgagttctttctttgagttctaccttccctagtcttcctccactgcaccaacccacggtgatccctgtctcttccaaatgctttgtaacatggtaggcatcactcacttgtgactcattggaccattttaaaacttggttttctgtgtctcttttccaacaaaattacaaattctttgagggtaaaagtcaggcctaatagttctctgtactcctagtagtgccagtgtggtaaaaatttaacttgacaattagcaaaaccaataaattccttacactattctgttcctgtaggtaatcagtatatgaatatggattcctatgtgatgattttctggtctattttgtcccttttttttttttgttactttaaccaggccataacataaaggttatgccatttgttactgtcaagcttaattaagcccattataattcgttaacccctgtgcttgctttgtaattaacattgattaacacaaacaagtacaaaataggccatcagcactttccagaagtgctgattacaattacattggtaattcaatacggtatagaagatggcaggatagtaacttgcactctgtttacataaggagacaaatgctaccatgcaaaactaagccaagaaacaaaatactttcctcatccaactcactgattaaacccttaccctgttaactcaccctatgactgtgtaaacctccagtaagattattgaaggcacagctccaagtaacttgcttaattgcattcctgggacaaaagagggaagcgcttcaaagctgacagacagatggtagagtgtccagtcacagcaaagcaggccccgaggctcatgacagacaactccagggctgagatctcatttgtagctctgggataaagtccagggtttgatggcagcaggctgaagtgtaaagatgctcaacaatgcgcaccccagagacactgaatctgaaaaagcttagagtgaataaaaatctggaaatgaactctgtctgtctattcaccattccccccataaaaaaattcctatattccggatggtgttcaagttccctttccacaggacctcagcagtcagggaggtgctcctgcaatctatgtgaaggagatttcaccatgcccacatgggaatacagtagattgccagtagggatgccacacctttgcatttcctcgtatttccaggaacaaagctggggtgcctaggagctgcagcagtttttcttctgtgtaaaataagcaagcaggactctgccccactgcactccagggaaggattaagagaattgatatcatccaaatcaattggccctgtgcagatgacttgataatgaggccattgagtttttatggttcactattattgctacaaaaattatgctgcagaaatcattcaaatgctcaaaaaggagcattagtacgaaactgggtgttccaaagttgttgctgagaggtgtgtaatgttcctgaagatccccaaggcactaagacttctctgtacatgaatgactcatagagaagaaatacaccagatgaaaatatatggagaagtttgccgaatgtcatataacttgtaagtattagagccgaggtctgaaccctgatatctgtgtccttatagctcaggccttttccttcagcccctccttctcagcagagatgtgttggagaaatcactagaaatggaagagcagctgtcagaagcagaattgaatgaagtgataggggaaaaacatacatgttgatacaaatggtcagccttaagcaagactgtgacattgatgcagcacagggaagcctcaaaattgggacttagcccaggagggttcttggcttcacccaggaaagaattcaagggtgagctggtggtgttagaatgcaactattactgaagtggcagtgtacggcagtagcagaggcactgcttgcggagcagggataccccagaggcactgtgcccagagtagcagctcagaggcagttctgcactcatatttatatccacttttaattatatgcaaattaaggggtggtttatgcagaaatgtctaggaaagtgtggtaacttctgggttgttgggttgttgccatggaaaggggtgataacttctggatgttgccatggcacactgatgggtgtgccttatggaaagctggtcctcaatttggtccagtgtcccagccccacactggagttgagtcctgccttctacctcaactttggtgacatttgtctttggtggccatagcctttctttctgccattatcaagcaccatacccaaggtctcatatccatcccaacagggttgtagacagtcatttgatccttttcctcagcatcctattttctctccctcatacacacacacacacacacacacacacacacactctctctctctctctctctctctctctctctctctctgttgttgctagtataaggtacaaccagactttttttatcatttattttttaaaataagatgtgaaatacattcaatggtgcatataaagtgtacaaatattaaatgttcaactggatgaattatttcatatgtatatacccatgtaaccaccacagattcagaatgtttctaccttcctagaaagctccctggaagtacaggctttttattttaaagtcaggtgtattgggatatcagtttcatatagttatattcagagttcttagtgtacagttttatgagttttaacaaatacatacatttgtgtagctaccaatatagtcaaaatatagaacagtatcatcaccccagaaatgtccctgcacccctttgtagtaaatctctcctagcccctgccaaccactaatctgctttctgttcctacagtttgtcttttataggatgtcatataaatggaatcatatattttgtgtctgacttctttcacttagtataatacatttgagattcatccatgtttcaatagttccttttattactgagtagtatttaatttaccgcggtctgtatgtccattcacaagttaaaggacatttgggtgtttccaacttttgacaattatgaaaaaagccactacaaacattcacatatagggttttgtttgaacctaagttttcatttcttctgggcaaaaaccaaggaaatcaaatttcttggtctattccaagtacatgtttaactcagaaaaaaaaaaaaaagcaaaaacattccctggagtgggtataccattttgcatttacaccagcaatgtacaagaatcttccttctccatattctcaccagcagttgggattgccaattttttaaagtcattttaccaggtgtgcacagatttttgaagctgcataacatgttcatagattttattgccatcttcagagaagacttaagatcagtcttaaacatctatttatataagagcaacttggctcatactaattaggcagttcatattaacattcctaactagagttacttttacttattcagtcaaattgattagttgtttatatcttaagcagtatctatgccaatttccctaacacacttaaaggcaaaacttctgattcacacctgctgctgtcctacaaggtatgcctgaaagttatggctcctcacttctttttggcacctctaaaaccctcaacaaccttcccctaatcacccttgtttaggtgtgttttctgtaccaagaaaatgaaacatccctccagcttctacgttcaaaaatacatctatcatggaaatccattggggtgtccccataaaaatacgtgtatgtacacacacacacacacacacacac

SEQ ID NO: 1230 - DNA, 70751 bp, Homo sapiens
agtgggtgctccagcatcccagggggcttagatgaagcaaaaatgggggatgtgataggggtggaggatgatccagcatgcatatgagctctaaggcaggacagagtggcactttggagaaccctccaccgtccttaaaccagccccacttcccacttccagttctacccactcttggcttaggaaattttctcctctttttgccctgaaaattagccttggtggctgagttttgcttttcaggttctcattgctagtgcttattttgacgcttagtgaccatctcattcctactattggcccgcagtagggaatcagacctttagtagacacggagctcttcaaatacagagtgaacttggggcatctgatcatgtgggtcaagatgaacactacagaatacaactgagagccacatgtgagtgaagctgtactcgagctgacaatactgacattcaaaaagcaacaggatgatgagaatgttctggaattagagggtagtgatagttacacaaccttgtgaatatactactgcacaccttaacatggtgaattttatggtacgtaaattacatctcaataacatttaaaaaaaaaaaaaaaagcagcagcagatggctgctggaggaggctgagcttaaatacccctggttacacttcctcctttccttgtatttactggaaggagaaggatttgtcctaagatgaatagttttttcatcttcagaaattcctgacaagctactaccctgtcaaggcatgaaaaatttcattagtgctgacttggtacacagtctattaattagtacctaaataattgcatgttgcctctgtgtcatgatttataattgtatgcatgctttgatctttctcatcacaggcagcactgagaagtgaaggaatatttgggaggatcagaagcttggtcctgattttgccatcaacaggaacttgatgacttcaagggagtccccaaaccctgggtttctgttttctcaactctaacatgaggggctagatgcatctggtttagttagtctccatgatggtttagttcgtctccatgatcctgtgaatttcagatgttgaaaatcttcggaaaagccctgaaagatgaacaggtaggagttattgtctatattttacccatgaggaaactaaggacctgggaatctagagggctcattagcttttgaaccagtactagcaatgagttcatctgaattctggtcccaaactcctagcatgagagaaatgtggacctttcattccaggagtttagcatgtaggaggtattcagctggtgagggattaaggcaagattacaggttcttgagaaacataagcgacagagacaagaacatcagaaagggccgctgtgactcgggtcgtggctgccgatggagctcgtaagtcaggagaggttgtttgctgagaagcttgcattccctagagcccaagtgggtgttgccaggaaaccctgagttttccaacttggcaatcagtgcacagctgagtttttataggaaattgcccagctctttggaaattgtatgtggtataaatatggttttgaaattctatatattagcttagcaaaaggcggaaatattttgaaacccatggatttgggagatctgccggcattgctattaaaattactttcagcagaattgtacaatatgacattatattgctcaaaatgactcaattttctaatctttgagacttcttaaaaagaaatgaaccccaagtagagtaaaggtggactgcaaaaaacagcttagtctgaatgaaaaaaattcatccttggctctgcatctaagaaactggctgtgtgtcctcagacaattcacttaatgtctcagatcctcaacgtcttcaactgcaaataaaggggttagaggagatcatctttaaagcccaactcagctctaacatactatgattggataccatacacttgtccacattcttttctctagcacttggggatttctgctcttccagcctttacaaatacaacctttcactgtcacactcattcttccttgtccttaaaacagaaagcccaggcatagtctgatgccacttctgagggctatagcaggtggcatctagtgtctctatagtaactatttacactcctagggaaaattatctcacagaagcatagagagcctgaccttgtctataaagacagtaaggtacaatgattaaaagaataggctctaaagtcaggcagacctgggtaaatctgccacctactagagagcttgggcaagcaagttcaccatgcctggtacctagtgagtgctgtgggcctctattctggagggacagcagggccttacgaaaccagcatgagattgtaaatgccttgcaggctggattttcaagaggaaatgctaccccctttttctccaacatctctggcaaaattgctaacccaaaggtactaggcccagctagttatgaaggggatggaagtgatctctatccaagggaagaacatttgaattgatgtttaaaggagttgtttagattcttatgaaggaatagaggaagagtagaggcaaagacagagaaggggatggatgagaataaagaacaagaaaagaagcagtaggagacaaatgagaaggttaaagctgataatttttacttttatgataaaaggaatttctaagcaaattctaaccattttatcaagaagaaacaaattcactaacttatatttctgcttaaagaaatgcatgggcattttcttcgcatgtgcagtttgtttaaaaattaggcattgaatgctttttaaaaaatatctagatctattctggacatgcacattccaattgatagatagatcaaaatgtctgattttcttactggtaacttggcaccagttgccagtggcttcatatgaacctatcagctgctgtgggatggcagagcagttaagagtccaagactagtccacgcaggcctgcagctcccacattctgatgcatcaaagccacagcaagttcctaaaacataggctctggatccagatgcttttggttcaaattttcacttcattatttctcagatgtgtgacttatggcaattacttacttctctaaggctcactttccacatctgtaaaatagggctaatgatagtatttgcttcataagattggggattgaatgggataatgcacttagctcaatactcacccataaactttttttttttttttttttttttttttgagacagagtcttgctctgttgcccaggctggagtgcagtcgtgcgatcttggctcactgaaatctccacctcccaggttcaagcaattctcctgcctcggcctcccatgtagctgggatttcaggcacacaccaacacccccgactaatttttttgaatttttagtagagacaggattttaccatgttagtcaggctggtctcaaactcctggcctcaagtaatccgcccaccttggcctcccaaagggctgggattacaggcgtgagccaccactcccagccaacaatattcaattacatactcaattactatgttctttttctggtaactagaatgtaggatcttatgattggccccaagttcaaagatatgggcaagtaagtataatataagagtgtagatacagattttgtaggatatatgccatggcctctgtcccatatcagtttaatacctattttccaatgtaatgccctgaaatcccagaagaggaaaaaagaatttttttctaacaattagaaacatgataaaaaaaactatcaaaggtatattcattcagccatgcaaattgtaaaaccatagcaatcattctatttgtttggtcacagtttaaaaaaggaaatttgctataagaaaaataaatacaaacaaacacaaaaagagttgaatgccacctgcagaagaagcaccaatccaactattttaccctgcccacattcaccatgtttctcacaattgcctataaaaagtagtcaccatttattgtaccaggcagtgagctaagtgctttatggaccctgtctcgtttaactgtccccagagtcctatgagtaggtatgttagtgccatgcccatatcacggataaggagatatgccaggtcagagaggcgagttgggattcacacgcagcagacttgctccagggcctgtgttctcaacactgcatggtgccgcttctgatctggattgttaaatctcagcacccagcactcctggcttgggtagaagggaatgggcccagaggtgctgagaatggatctcatgtacacctagggtcgaagttggaacagagagtatgtggagagcctgggctaagactgaagccgccatgatgaaaaccaaactcaagcagtcttgttttttaaaaccaatgggagtagtaaagtataaatgtaaatctcagttatcttatcatgccaccctataggtgtttccagtagttactttagagctatcaaagatacatctgaaataacggtactgtgtatatacttgagtcctcttccccagcttgacactcctaggagtcaggtgttctctgggccagatcatttgcccacaaacatagcaatatgcctagccttctcattatataaggtcccccattatatgggggaccttatataatttcatcatatggatgaaaaatgggattattttattatttgactcttctctctaggattcaaagtgcttttatttatagattttcatgatttaaccaattcacccaagaagtaggaagagggcagctttattattttcaaattgtggactgagaaactgagatatgcagaaagaaataaagctgctctgcaatttggaaaaccatctgtgatgctataaaaacgtctcactgtactctcaaccacataaatcactatttttattgccttctctctggatgagatgtggcttaatttgagagagctgtttatcatttggcaagctgaaagaacctaatttcaagtctccattctagtgggtggtaagaataaagggaatttgctttaagggaagaggaaatgataagaatgggaaggaaacggttagacctaaaaaaaatcgattttgaaaccctttggattatcatggatttaatttgccaagcatgggtgaggggtcacatggaatgggtttgaattctaagccaccattatgaccactcacttaatgtttcttcctaccactcccattctacagtgagcccatgattaagataacaacagcttaaatgagttagtgcatagtatggtttggctctgggtccccacccaaatcccgtgttaaattgtaatcttgagtgttggacgtggggcttggtgagaggtgatttgatcatgagggtgatttctaatggtttagcaccatccccacagtgctgccttatgatagagttctcaggcgatctggttgtttgaaagcatgtagcacttccgctgcccttctcctgctggccatgtgaaggtgtgcctgtttctcctttaccttctgccatgattgtaagtttcctgaggcctccccaaaagcagaagcctttacagcccacagaactgtgagctgattaaacatctttctttataaattacccagtctcaggtagtttttatagcaatgcaagaacagactaatgaagaaaattggtaccagagaagtgaggcattactacaaagatacctgaaaatgtggaagcagctttggaactggataatgggcagagggtggaacagtttggaaagctcagaagaagacaggaagatgaggaaatgtttggaatttcctagagacttgtttaatggttttgaccaaaatgctcatagtgatatgggcagagatggccaggctgatgaggtctcagatggagatgaggaacttattgagaactggagtaaaggtcactcttgctatgctttagcaaagagactggtggcattgtgctcctgctctagggatctgttgaactttgaccttgagagatgatttagggtatctggcagaagaaatttctaagcatcaaagtgctcaagatgtggcctggctgcttccaaaagcctaactcatctgcataaacaaagaaatgacctgaaaagggaggcaaagcataaaagatagataggaaaatttgcagcctagccatgtggtagaaaagaaaaacccattttctggggagaaattcaagcccaatacagaaatttgcataagtaaagaggagccaaatattagcagtcaagacaatggggaaaatgcctatgaggcattccagagacctttggggcagcccctcccatcacaggcctggaggcctaggagggaaaaatggtttcatggggccaggcccagggccctgctgctttgtgcagccttggggcatggcaccctgcatcccacttgctccagctacagctgtggccaaaagggccccagatacttctcagactgctgctccagagagtgcaagccacaagccttggtggcttccatgtggtgttaagcctgcaagtacaaagaggatgagagttgaggcttgggaacctccacctagatttcagaggatgtatggaaaggcctggatgtccaggcgggagtctcctgcaggggcagagccttcatggagaatatctagtagggcagtgcaaaggggaaatgtggggttggagcccccacacagagtccccactggggcactgcctagtggagctctgaaaagaaggtcatcctcctccagaccccagcttgcactgtgtacctggaaaatccacaggcactcacatcagtccatgaaagcagccacaggggatgtaccctgcagagctgcccaaggccttggaagcccaccccctccatcagcatggcctggatgtgagacacagagtcaagattattttggagctttaagatttaatgaccgtcctgctgggtttcggacttgcatggggcctgtagcccctgtgttgtggctgagttctcctttctggaaatggagtatttacccaatgcctgtactcccattgtatcttggaagtagctaacttgtttttgattttacaggctcataggtggaagggacttgccttgtctccgattagactttggacttggacttttgagttaattctggaatgagttaagactttgggggactgttgagaagggatggttatattttacaatgtgagaggatatgagatttgggaggggccaagggtggaatggtatggtggggctttgtgtccctacccaaatctcatgttgaactgtgatcccgagtgctggagggagggtttggtgggaggtgattggatcacaggggtggtttttaatggtttagcgccattcccccaatttcttaggaaatctgcttgtttgaaagtgtgtagcatctcctttgcccctctcctgctgctaatggcctgtttccccttcaccttgtgccacgattgtaagtttcctgaggcctcccccagaagcagaagcctgtacagcccacaggaaccatgagctgactaaccatcttttctttataaattacccagttctttatggcaacgtaagaatggaccaatagagcacatcactagggtagcacaaaggagagggcccagaagcagaggagagataaacagctcatttttttcatctttctcaatgtttcttgctcactctctgttgtttgcatccatttttcatttcatcccatttcctcttttttccctttcatttcctcattttgggacagcaagaggtcatgttcttgctgccaacagttacgacattttcagtagtcatgacagccacaaagccagggctggacttgtccagaagtctgatctgcagcaggagggagtctgtagtgtgcaggggctctccagctgtcacttagatcccaagctgccccttcacttttaattttgctgatggtggcttttgtcaaaggcaatttaaaatttagggctaggtagtctaatctgtcaatcttttcttttctttgtggtttccaggtttgtgtcttacttaggagggccttcccaatgctaaaattatatatataaacagatataccacaattgcctaaacagaaatttgggcaagctggcacatttgaaacagggctgtctcctaaaatttggaacgtgtggatagcgtgcatatgcttggactctaggacttactttctctggaaaaatccgtctagcttcctcactcactgcctctgcctcccagctccagcctagccatttcatcttatggtgggggagcactcagttgctagggccagaaacccactcagagtaacttaagtaaatggggattacttgcacagtgataacggaatactgtgaaacccagtttgaagaattgcacctggatcactgaagggctagagtctggagctgcccttcctcctccctttctctcagttatctttgtctctgctccatcctcccccttcgtcaagcatactctgttaccacatgaccttaaatgactgtctaactcagtccttgagcccacagaatcttgtgagtctagcactcacagataaaaaaacaccctcaggctttctgtgtcccaactccaagttctagataaagatgtctgattggttaaagtgggtcatgtttaaagtgggtctactcccaattcagttattggtggccagggccatgagccacatggttgccccttggggcagtgggcaaggtaaagttcacaagatgtggtggggaggaaatgaccactgtaactctgtggtccagttcccacacccatattgtgatttttgctccccttcaagtttgcccttgatgttgtctgtaactgaattctgttttctcccatggttagatttataccagatccaggaccttttagggagggctgtggtcctgtccccttggggaggctctgatctaagactgctccctcatggaaattaaggagaaggggaaagcctaggctacagatggagaaggatgagtcattccagcagccatggccaagggaactcctggagacgtagggactgtttatgtggccactcaccatcatgcaggcccccaatgggggtgaggcaaggaaggacatagaaagactgctcaagtgcatttctggttttgcttcctaccgcaaacgactcttgtcatatgactgggggagtgtggtggtggcaataagcagaaaaatttgagtctaagagttgctttctgaattctattagggtcaatgtagtctaaagaagttgacttttgaggaaataaatcttttctgttttctgcagccagactaaggatttagtggtgaatggtaggtgggaacatagtgggactctgactgctcatacggcctctgtgaggctcaattcttttatctctaaaagagagaactgtctacctggtaagagaagatcttttgggagcccactaaactctaacataatgttattatacagtaagttctcacttaatgtcatcgacagtttcttggaaactatagctttaagcaaaatgacatgtaacaaaagcgtttttttctcatcaacgttataacaaaacgttaaaggaagtgacattatttatgaacctgctgcatgttgttttgcttaaagttacagattccaagaacctatcgatgacattaagtgaggacttactgtactagtatcatttataacttataaaaatgacttaattaatataccacaaaatatgcagctttcatgttagagaccagataaatatgaatattttgttaaaatgtctctcttctctactttaccagtcttcaccaacctcctccctccagaatattcctcaagaatataaaatgcctcatcaacatgagacaacagcaggaagcacccattcgtagtaatcctctgtatggaggaggctgttacataaccacaaaggcacaaagctgcagttttgagaacatcttcccacgccagttctaagcattgacttcaactatggttgctaacacaagaatcggcactggtgacttttgagccatcaatcatcctttcctaacacatgaatcttttggaaaagtatgtgagattggagattacctgtgatggtttggatttagattttgcctccaggtttaggcaatggtaaataggcaggagtttaataggaactaaggttatttgataattcctgggccactgcaaatagaaagtgttggcaattttgtcttttgggctgcctctgattgaaggcacaggcctgtttcatgaagttctgaaacatgaaccggctgtatctgcgtcaaagtcagtggtaaccaggttaatagcactgacaaccatgttctttttacaggaaacacaaacgtgaatcacttgttcttacttttcttttacagtggtctcaaatagtcaagaccccctgctgggaggagcttctatcctgctctgtggaagaaatgggcatgccagatgcctggaagatcagaggctcacattccaggtgggtcaccctggttcttctcatcagaatcaactagagagatgggctccctctccatccctacccacgggcattggtcaggctgaaagcaaagaaagacaatccattgcccccaggagaactggtcttactctaaatcagtggcctgcaaactgtttatgtggatgtccggatagtacattttttgcctgtgtgggccttccagtctgtcttagttactcaactctgtgatttttgagcaaccattagacagtatgtaaatgaatgagcatggccccatctggccctccacccacaggccatagtttgctgactcctgcaagagtaaaaccctttatgaactagagagttccaggcttgaacatgggtccagaaaatatgggaaggcaaacctcacacatttgtggttgtgtgcctcctaagtgctttgtgtcactgttggcttccaattcctaggaagggccttgggcaccaaccgtatgttgacccagggagaaaaggacttttgggagtgagagtcagagaatgggtaccacgtacccttcagatccctcagctttcagattgacacagcaacagatcatagtctcctaaattctctggcttaaagcatggagccacacttatcctgccaggctgggtccccagttcttagatgaggctagcagtagccatgaggagtgggcatgtggctagtacaagagaaggaatgctaggtggcacttggtcagcaactttccaatatcatgtttcttaattgtatcaccaaatgtgtattatcgtcctgtctttttttttttttaattattatactttaagttttagggtacatgtgcacaacatgcaggtttgttacatatatacacatgtgccatgttggtgtgctgtacccattaactcgtcacttagcattaggtatatatcctaatgctatccctcccccctccccacaccccacaacagtccccggtgtgtgatgttccccttcctgtgtccatgtgttctcattgttcaattcccacctatgagtgagaacatggggtgttcggttttctgtccttgcaatagtttgctgagaatgatggtttccagtttcatccatgtccctacaaaggacatgaactcattattttttagggctgcatagtattccatggtgtatatgtgccacattttcttaatccagtctatcattgttggacatttaggttggttctaagtctttgctattgtgaatagtgccactataaacatacgtgtgcatgtgtctttaaagcagcatgacttataatctttggctatatacccagtaatgggtcaaatggctgggtcaaatggtatttctagttctagatcccttaggaatcgccacactgacttgcacaatggttgaactagtttacagtcccaccaacagtgtaaaagtgttcctatttctccacatcctctccagcacctgttgtttcctgactttttaatgattgccattctaactggtgtgagatggtgtctcattgtggttttgatttgcatttctctgatggccagtgatgatgagcattttttcatgtgtcttttggctgcataaatgtcttcttttgagaagtgtctgttcatatcctgtgcccactttttgatggggttgtttgtttttttcttataaatttgtttgagttcattgtagattctggaggttagccctttgtcagatgagtaggttgcgaaaattttctcccattctgtaggttgcttgttcactctgatggtagtttcttttgctgtgcagaagctctttagtttcattagatcccatttgtgaattttggcttttgttgtcattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaagtaggggatcatttccccatttcttgtttttgtcaggtttgtcaaagatcagatggttgtagatatgcagcattatttctgagggctctgttctgttccattgatctatatctctggtttggtaccagtaccatgctgttttggtgactgtagccttgtagtatagtttgaagtcaggtagcgtgatgcctccagctttgttcttttggcttaggattgacttggcaatgcgggctcttttttggttccatatgaactttaaagtagttttttccagttctgtgaagaaagtcattggtagcttgatggggatggcattgaatctgtaaattactttgggcagtatggccattttcacgatattgattcttcctacccatgagcatggaatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtttgtctgttattcgtgtataagaatgcttgtgatttttgtacattgattttgtatcctgagactttgctgaagttgcttatcagcttgaggagattttgggctgagacaatggggttttctagatatacaatcatgtcatctgcaaacagggacaatttgacttcctcttttcctaattgaataccctttatttccttctcctgcctaatttccctggccagaacttccaacactatgttgaataggagtggtgagagagggcatccctgtcttgtgccccttttcaaagggaatgcttccagtttttgcccattcagtatgatattggctgtgggtttgtcatagatagctcttattattttgagatacatcccatcaatacctaatttattgggagtttttagcatgaagggttgttgaattttgtcaaaggtcttttctgcatctattgagataatcatgtggtttttgtctttggttctgtttatatgttgaattacatttattgatttgcatatgttgaaccagccttgcatcccagggatgaagcccacttgatcatggtagataagctttttgatgtgctgctggattaggtttgccagtattttattgaggatttttgcttcagtgttcatcaaggatattggtctaaagttctctttttttgttgtatctctgccaggctttggtatgaggatgatgctggcctcataaaatgagttagggaggattccttctttttctattgattggaatagttttagaaggaatggtaccagctcctctttgtaactctggtagaattcgactgtgaatccatctggtcctggactttttttggttggtaagctattgattattgcctcaatttcagagcctgttattggtctattcagagattcaacttcttcctggtttagtcttgggaggatggatgtgtttgaggaatttatccatttcttctagattttctagtttatttgcgtagaggtgtttatagtattctctgatggtagtttgtatttctgtgggatcggtggtgatatctcctttatcattttttattgcatctatgcagttcttctctcttttcttctttattagtcttgctagcggtctatcaattttgttgatcttttcaaaaagccagctcctggattcattaattttttgaaggattttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagactctggtatgttgtgtctttgttctctttggtttcaaagcacatctttatttctgccttcatttcattatttgcccagtagtcattcaggagcaagttgttcagtttccatgtagttgaggggttttgagtgagtttcttaatcctgagttctaatttgattgcactgtggtctgagagacagttagttataatttctgttcttttacatttgctgaggagtgctttacttccaactatgtggtcaattttggagtaggtgtggtgtggtactgaaaagaatgtatattctgttgatttggggtggagagttctgtagatgtctattcggtctgtttggtgcagagctgagttcaattcctgagtatccttgttaactttctgtctcgttgatctgtctaatgttgacagtggggtgttaaagtctcccattattattgtttgggagtctaagtctttttgtaagtcactaaggacttgctttatgaatctgggtgctcctgtattgggtgcatatatatttaggatagtttgctctccttgttgaattgatccctttaccattatgtaatggccttctttgtctcttttgatctttgttggtttaaagtctgttttctcagaggctaggattgcaacccctgcctttttttgttttccatttgcttggtagatcttcctccatccctttattttgagcctatgtgtgtctctgcacgtgagatggatttcctgaatacagcagactgatgggtcttgactctttatccaattggccagtctgtgtcttttaattggagcatttagcccatttacatttaaagttaatattgttatgtgtgaatttgatcctgtcattatgatgttagctggttattttgctcgtacagttttttcctagccttgatggtctttacaatttggcatgtttttgcagtggctggtaccggttgttcctttccatgtttagtgcttccttcaggagctcttttagggcaggtctggtggtgacaaaatctctcagcatttgcctgtctgtaaagtattttatttctccttcacttatgaagcttagtttggctggatatgagattctgggttgaacattcttttctttaagaatgttgaatattggtccccactctcttctggcctgtagagtttctgctgagagatcagctgttagtctgatgggcttcccgagagatcagctgttagtctgatgggcttcccttgtgggtaacccgtcctttctctctggctgcccttaacattttttccttcatttcaactttggtgaatctgacaattatgtgtcttggagttgctcttctggaggattttctttgtggcattctctgtatttcctgaatttgaatgttggcctgccttgctagattggggaagttctcctggataatatcctgcagagtgttttccaacttggttccattctccccgtcacgtcactttcaggtacaccaatcagatgtagatttggtcttttcacatagtcccatgtttcttggaggcttggtccatttctttttattttttttctctaaacttctcttctcgcttcatttcattcattttgtcttccatcactgataccctttcttccagttgatcgcatcagctactgaggcttgtgcattcatcacatagttctcgtgccttggttttcagctccatcaggtcctttaaggacttctctgcattggttattctagttatccattcgtctaatttttttttcaaagcttttaacttctttgccattggttcgaatttcctcctgtagctcggagtagtttgatcatctgaagccttcttctctcaactcgtcaaagtcattctctgtccagctttgtgccattgctggtgaggagctgcgttcctttggaggaggagaggcactctgagttttagagtttccagtttttctgctctgttttttccccatctttgtggttttatctacctttggtcttcgatgatggtgacgtacagatgggtttttggtgtggatgtcctttgtttgttagttttccttctaacaggcaggaccctcagctgcaggtctgttggaggttgctagaggtccactccagaccctgtttgcctgggtatcagcagcagtggctgcagaacagtggatattggtgaactgcagatgctgctgcctgatccttcctctggaagttttgtcttagaggagtacccagccatgtgaggtgtcagtccgcccctactggggggtgcctcccagttaggctactcaggggtcagggacccacttgaggaggcagtctgcccattctcagatctcaagctgcgtgctgggagaaccactactctcttcaaagctgtcagagaggaacatttaagtctgcggaggttagtgctatcttttcatttgtctgtgccctgcccccagagttggagcctacagagggaggcaggcaggcctccttgagctgtggtgggctccacccagatcgagcttcccggctgctttgtttgcttaatcaaacaactaactgggccacggctggcgcccctcccccagcctcgctgccgccttgcagtttgatcttggactgctgtgctagcaatgagcaagactctgtgggcgtaggaccctctgagccatgcgcgggatataatctccttgtgtgccgtttgttaagcccattggaaaagtgcagtcttagggtgggagtgacccgattttccaggtgctgtctgtcactgctttctttgactaggaaagggaattccctgaccccttgcgcttcccaggtgaggcgatgccttgccctgctttggctcgtgcatggtgtgctgcacccactgtccggcactccccagtgagatgaacccggtacctcagttggaaatgcagaaatcacccgtcttctgcatcgctcacgctgggagctgtggaccgaagctgttcctattcggtcatcttggctcctcccccgtcctgtcttaaagagaagaaatatgagtctctcctgcctgacagaaagtaagttccaggcagcagaagcatgaccttggcattatggcagacagagaggtgtcctttgcttgtgcctttccttcaacctgcctgaccccggctctgctcagcagtgacccatgctctcttgaccacttgtctccagcagacctgtgatttgtccaccttgctgcatcctgggctggtggaactaccctgtttggggcttctcctccaggggttcacccaagtttagaaaagcagtaaaacagccaccatgcagaccagcctatccttttaacaaacgtctttgaagctaccatgttctaaaacattttcagcatgttttgaagctttttattattactatagggaacactctgaaactaatgctatggttataaggaactcggagccatccccagtatgattccatttcccaacaagttcaagaaacagaatccaggcacgtagtatatgaacaatgccaaaagatgcaaccgatacagtgaaacttcatggtgttagagacaggaaggaggttggaaattaccctctaagtttgttcttttagctcattatttacttttaaagtactgcttgtgcagaacccaaggacagctgcgcatttattgcacatttatattcactgcttcctgatgacattaaatgtaagcacctgcagcagggtattggtgaactgtccaggggaagcacaaattagaaaaaatacaaaatacgcttccctgagcccatgaatttaccgtatcaggaatatgtaagatacattaattagttcatcagtaggctccaagacagacattgcagatggtggggaaggtgggggtgggggcaggtgggtgggcaggcaccactgactcaaaagttattgcgtgtgggacactttgccaaactctggggcctgtgtgggttgaggcacatatgttggggcctccatcagggctgggtggaggccagggcaggacacagtggtctggagctgaggagtacgacacacaactccacaggagcctcagagtttagcacgtgtgcagggtagcatgtttgggcaatgtgtgtctgtctgagagtcttctacagctgagagcctggggtccccaaggaaatagggtgatgtcagcagggaagagcccaaaacgctcatcagccttcaaaattcagcatacgctagggacctcatgattccaagcagagaagctaaaagaaatgcagttcaccaaggcatgtagttcaggtgccttctcccaggacctatgtagcattgagacttccctggggtcctttaaattatgcaattatcaagccttttttgaagatcttttttaaaatgatttttctttttgcattgtcttttggttttcaaggaaacataggttctttggtgaactgttttataactacagcatttgctgtaaggaggtgttcatattctcttagtgtaataacatcaagaagctgaaagaagtccgagatctctaggagggaaatggcttcagaatatgcctctcaggctaccatagatctgacaccccagaaatatttggaagacagactggagttagattccataactcaggctatgtggcctacctgctggggctcctatggccttccctacctccactccccaagttgtggcagagagccccttccaaattgtcctcggtctgattaacctcagtatgttagaagacagggggttgtcaaaggccaggatgttctttgctgtctctcattgtgctgcagttgttgaagcctggagtaccaaccgggatttcagacagcttggatgatgtcccttctggttctgcaatgggttctcttatttgatgggtagctgagaaaaagagaggcaagggggctttagatcttctggaaatcttgattcgtcagagttgattgactcgtctcttccctggagtcagtgacaggcaaattcacaatttcactcaatgctcgcactgaatagctaaaaaatggccagtattctgggctagaacctgatgacagaaagagatatggaaggaaaacagtgtcctaccacaaagtagcaaagacacattgccttggtgtcaacacacttatacttaaagcttggttctgccatttataatgaagtgacctactgctaattgttaacttctctgagcctcagtttgctcatccataaaaataatgcctcagtgttgcagtgaaggcttactataaagtgaccagcaggcaagctagacatagtaagtggttggtgcaaagtagctgctgttgggctgcttttcattcggtttaagtactcatctagaactgatgcgctattagatctatttgactgtcctgtgaacaaaagataaattgtttcctaggagtattttatttttctaagctaaacacttggtgcataggagcttaccacttgcatgtaattttcttgttttgtataaaataaactgaaaaaccagttctttttttggctgaatttaatcatcaaacctatttttaaaatgctctttgtgtactttctttcctttttagaaaattccttttggtatttaggaaaatgtttaattttgttctaatggttacctttgtagtactctttattacctttttaagaattttttaaccttttaccatatcttttggctattacttatagtgtaaattcaatgatcttattctacgttcttacccacttctcccattttaaaaattgtactgtttctattctgttagaaaatgcaatgtttaactaccattcttatacccatatctccaaccttgtgttagtcctagatctatatatgaaatatgtagaagcccaccttcaatcctcctgctgaagtgtctgcagtcagctcttagttgaataaagtacacttaattctgcagtggattcgtcagaaaggacacgtgggcacagtattcttgtgttctttcgtcttcaaaactgcttttctatattgttaacatttgaagaacagcttggctagatataaagttcttgacttgcattttctcaagcttctcaaagagctgcttcactcacgtcttgctttatatgttgttgttgagaaatccaatgtcagccaaatcctcttctcctttcaagctattttatgtttcctccaaaaggccatatggatttttttctttctctttaaagcttagcagttctactaggatatggctctgatataataatgccaggtcaacttttataataatgccaggtcaactttttcaagtgaaccctttcacttgtagattcaattcctgatttatttccagaaagttttcttggattataattttaaataatagttatattccattgttttgctctcctcgttcaagaactccagttggacatccttggctggtcttccacttcgatcactttcctctgaccttttttctttttttctttacctcctttttgctctcttgttttctcctgctttccttcaatgtcttttgttaaatttccatttaaatttattctcccttgggcctcataattttgtctacatttctggtatgattttgccattttctttgatattcttcctatgttcaatgactatcatttcatttcttccttttcttctttcttgatctatttgtgttgctgagttttatatttctgattcagttttatatttctgattcagttttatatttctgattcagttttatatttctgatgctttttacgtatctccaaattctattttgaggaaaattaatttttgtgggagtattatgttacagttttcctcagctcattgttccccccaccacaccctgcccctgaggtgagggagtattttcttcagctgaattaccttggttcactttttacgacagttttatttggatatgactgcggtttttctgtacctcttcattctgtggagagagttcatcgtgtgacatcagcatttcctttcagttctgcccttttctgtgaagtttcttttatggaagatgttgatggtgaagttaggaagaaaaagaaagggactactgtgtctttcttcctagaaacattaattttatcttttcttttttctttcctttcattgctatttcaccgaggaataccaccacttctctgtatctcattctccctaagaagccgtgcttctccagggctgccacttctgggcctcactcatttcaaatcttttccctgcagctggtggtgtgaactgccaagttccaaattgcgtagagcatttcttaacgtagttgggctttcttttgagagtgtgcataccttatgtaagtccttaatgccctctactatttttgataccattctttaatacttccctacttcactttccatatccataggcttgaagcagtaaggcaaaaggtagctgttagaatatgatgcatttttctacttgctgatcatttacaacttgtagtattctccaattcttagtaatgctaaagccataatgttattttctattttcactctatttattttaagggtttttaaagttgtatggggagatttgaagtcaagcagctgccatcattttccattcctgtttggtgttcattgaacttcttggattttcatgttgatatttttcatcaaatttggaaaaaaattttgactgcatattttttcaaaacttttttatctccaatctctattctttttttttctcaaatctctctctcctctttttctgggactttaattacattaatatttgaacccttaataccatttcacagataacagagactacctctctagcctttcttctcttagcttcagtttggatagtttctactattctgtcttcaagttcactgatcctttctttttcagtgtccactgtgctgctaagcccatccagtgaactttttatttgagatattttattattattatcattttcatttctctactgagagtatccatttgtttactcattaggtttatcttatttaaacctgtaaacatatgcataatggctgttttaaagtcttcgtctattaattccaacatctctgggtctgtttctattttttgttaattttttttcctggacataggtaacattttgctactacttcacatatctagtaatttctgattgtgtgctggttattgtaaattcttgaaactcccttctcttggctcctgtgacacaatgatctctgggttttcctactacttctttgggattctgtccaccttctttaacactcattatcttctacttgatttttaaatgtcatagatcttcatggctcaatcttatatttgatcttttctcacactatattttctctttaggcagtctcatctacaccctatgcttcaatcaatcaccacctacacactgatgattcaaaatcatataaattcagatgagacctcttctttgactaacttcagactaattgctacttgtttgtttcaataacacatctatctcactatgtccagaaccaatattgtgatttctctggcctgcctgcatgtgcaaacacacacacacacacccacaatatgaaataggaaacttcttctagtgatataaatttcagtgaattacaccaccatcacttcaattatgcatgtttgaaatacagacactttgacacctcttccttcctcattccccatatacattccatcttgcaattttattgattttatacttccacttgtctccattgccatctctctctgccactatccagtttttagctcccaccacctctcacttgcattatgaaatagctccaaatttattgtgcacctctaatctttccctgctataatccattctccaaatcattgccagcattacattttagaaatgcaaatctaataatgcaaatctaattcattctctctctgtatttgtctctctctctctacatgcacacacacacacatacacacacacagttttaaagaaggctaaattgttgtccattgctttttggatgaaaacaaaaatcattaacatgggctgatccctacctgactcatgttaccatgctttccttgctctctcctatccctctctgttgtcttggtcctatatactgttctggatttcctggagtgtatctgcctctggtctttgcctgtgctattccatctgtattaactgctcttttctctcctcatcacctcctccaaacctgaaatcaattgtccttttcttgggggaagccttccctgaattccttggccagtcaatctcacacttatgctcacagtggcacagtgtacctctcatttgtagtccctataacatttgtaatttcacatctatttccgtgattctttcattcaggtatgacacccctactgaattataactgtcatgaaatcaagaattgtgtctgttttggcacactcatatttctagtatcaatcatagtgtagatgtttaataaatatttactgaatcagtgaataatgaataaaaagtactcttccatgaatctttcttatactcatgcttagctctcactctacctttctaacaaatggcctaagcagaggaagatgctaaaggggctgctaaggcagcaagaaaatcaagtaacacagaaacagagtcagttggttctttgcacttaggattctcagaagaattttttgcttctgccttcaaaattaaactggaatattaaaactgatcttttggtccctggaagatgaagtacaaaccatcatcaaaaagtatctactgttgggactggtgactcactttgtccttccctcctgtaagccatgagaaggaatcagaatgattctgtcatcaagagcatcacaaatcctggatcttcacctgattaatgcttcacgtctagcacaagcactttcattttcaagggattccatactgtattgtctagcccctggctgggttgggatatagttatcttggtggcataggatcagcatgtgtaagagcgggatattattgggcgctgtattgaaaagagtaaccctgggaaggtgagggtgattattaagaccaactctgaagcgatgactggtgaccagaaatgagttgatgtcagaaatttctacagagatggtgatagcttataaaggtgaaaatccagtaaatagtctggggtttaaaaactcaagtaagggatgaatcaagggatgatgcagaaattatgtgtagtagaaaaggcagatgtcaggggtagaaatacatcaccgggcaagtaaggccaagtacgtgcccatctggaacacagggcagaatctcttcagtaagttggctttattggttttagtcatttttatctattgctgatgctcatgtgatactttgtttcttgggtgaatttcggtatctcagacagacacatacaaggagaaagaacagaagttcttaggtagttttttagtaatagaagttcttagattttttttttttttttttttttttttagtaagaaagaaaagtgctgggagagattgatcgttccttataaaaaggccttcattcctcacaaaaatacaactttcagtcaagaatttggtcctttaaaaaagaaagaggaagaaaagaaagcatgagctctatccctcttttgactaaatactaccactgactttcctgtttagaactaaaggctgtctcttgttccacaggtcaaatgcatactttttaaaatgccacttgaccccttgggttccccattctcagtagaaaaacaaaatggtcattaatttattttgacatgcaaactcagctgaacattttttggtgattcaaccccacagatgtaaagtgaaagagtgccagaaaagcaagtgagagccatgagattaccacaagtctgtgagcacatttttttcaaggcttacagaatcccaaagcttgcccttgcttcaggaaaaagaactggttgacacctgagaggttttaagccacaagaagctgaggcccgttgtgaggagggcagggacagtggggccaggccacacgcgacgcgtcacccacctcctgcctcacctccccccactgagatgtctgctgggtgggaggaggcttattgccagagaacagtctggtgttttctgttcctgcttcaggaagtcccccttctcccgccacccccgcagctcctcagcctggaaacaacttttagagaggagaagggaagcaaagctttcaaaagcagatacctgtggggtttgaagggaggtgccccttgttcaagtatttctcccccaaaattgaaaggacacttcagattcattcattttagttttgatgtatcttcagtaattaagaagccactaagaaaactgaccctgggaaggcaaattcctgaagctgagtcagatacagccagctcttaccataccatctgaccctcagttccctctgacctcatctcttcccacctcctctctgtctgactcagcagtgaggccacacaggcctccctgctgattcgagaatggctcccacctgaggccttgggccccccttgttttcgcccccacatacccatctggcttccccttcactgcttccaaggctctcctcagagagcatcctgtcagaccagtctttcctggacatgctgagtgtacctttcccctatttcattttccttcgtggcaccttttaccacctgatatgttcaatggctctatgtttgtttgtagtaagtctcgcctgactagaatataagacccatgggagaagagactttctgctctacccttggcacataccgggtgctcaaaaaatattcaagtgctcgcttcggcagtacatgtactaaaactggaacaatacagagaacattagcacggccccttcacaaggatgacacacaaatttatgcagcattccataatttcgagaaatacaaatcaaaaccacaatgagataacatctcacaccagtcagaatggctattattaaaaagacagaaaataagagttgctggtgaggctgcagaggaaaggggaaagcttatatgctcttaatggaaacacaaactagttgagccactgtggaagacagtttggagatttctcaaggaactcaaaatagaacaaccattagacccagcaatcccactactgagtatatacccaaaggaaagtaattcatcctatcttaaagacacatatgctcctatgttcactgcagcaccattcacaatagcaaggacatggaatcaacctaagagcccatcaacagtggattggagagagaaaatgaggtacaaatacaccatggaatactatgcagccataaaaaagaatgaaatcatgtcctttcgcaacatggatggaggtggaaggcattatgacctccataaatgacctaatgtaagaacctaaaacaaaatattgcatgttatcacttgtaagtggggcctaaacgttgaagacacatgatcacgaagatgggaacaataggcactggggatcactagatggggaaggaagggagcagggggcatgggctggagtgccacctgttgcgtcctatacttattccctgggtgatgggatcattgggatcccaagcctcagggtgatgcaatttacccatgtaataaacctgcatgtgtaccctttaatctatgataaaagttgaaattaaaacataaacaaataaaatcctgagtactgtttcaaaaaatatatttgaggaaagaaggaaggaaagagggatggagagatggaggaagactaaaggaaggatcgtggccctgagagaatagagcacaggccaggggtgagatacagagtgagatgggagctgaatggggtctctgaaactagacatggaagacaccaaaagaaacattcctacttcatctttccctgtgcctgggataatttactcctggatggtaaagatatgtcttggtttcatctgtgttaaataaacctgcacgatgttacaagctggcattgcttcataagcttgaccttagctttcaaataggacctcgatcattgctcaatgaccaagtcacaaagttgcctaatgatattggcccacagccatgttattgcaaacatggcaatgactggccaaaaccaggtgtgctccttacatttctgcccgggtgatactctcagagagctcctcgccatgagaactaagtcagtctcccagtgccaggagccaggacaattacggggctttccctattgtgtgttcttgctgctaaccagctcccaggcctaggcttctgagaaacagtgtaggcacacaagctgcagatctctcctccctttattctctctccccttccccaaacccacaatagcctctaccatagtgcttattcttttgacctgttctgatctgctagcctaactattccccaacacctttaggaagataggtcttccctgaccctcagtctgaggtctagaagcccttctgccttgcctcacaggcatcttccctcctcccccgtcccctagaccagtccaacagcagcccgtgcagcctctgaagtccactcccagtgctagctgatgggaaccccatgggctcctgtctgctatacaaatggaacagactttcttcagagccaaccccagctgccccactgaagctggttgccacagtgattttcagtctcataccagattctgatctcttctcttgcccacctttggtgctgcagagtggatcatcttgttttatactcaagtcatcattaaaatttatagaaaaagagagaatttaaaaaaaaaaacactaaaaaatcaccttgtacgcatatacctcagaagatctttggcctaatggtaatctgtgacattaaggcaaataaccaaaaatatgtaatttttctatttatttctttgagtgggctcagttgcagatatatgaatctgaccagggtcctgatcacttcctgctcccaaagaccaccctttgagcctgtaagatccaaagtcaactcagtggattaatgtgcaagtctagcctgagccagtaagacatggttccctctaagatgccaggaaaggacctagggcttccctgggctgagctcttaggtaagccatggcctggcctggcctcttagaggttgtgcaagaccagcctctgtgatctgcgaaggccctgagtcccagacatcgtctccaacactgacctagatccagtgccagcaggacaagaaagtcccctctgctttaacctttacatgaaaagaaactttgaaatgaccaatccacattttttttgtttgtttttttctgctttccacagcccttttctgtctgtaaaaccaacctcctcttcttggctcatcagaacactcattctattttatggaataaagtgctgcccaattgtagaatcaaaaatacagcaaattaatgttttttatataaagtttttgatacataataattacacatatttatggggtatctgtgatatcttgacacagccatagaatgtgtaatgatcaaatcagggtatttaggatatccatcgccttgaacatgtatcatttctttgagctaggaacatttcaaattttctcttctggctattttgagatactcaatatgtttttgttaactatagtcaccctactttgaggctgaatactagcgcttattccgtctaactatatgtctgtacctattaaccaacctctcttcatcccacacacccttcatagcctctagtagctaccattcttttctctacctccatgagatccatctttttagctcccacatatgagtaagaatatgcaatatttgtctttcggtgcctggctgattttacttaacaagatgcccttcaattccatacatgttcctgcaaatgatagaatttcattcttttttacggcttaatagtattccattgtgtgtgtgtgtgtgtgtgtgtgtgtgtgtgtgtatcacatttgctttatccattcatctgttgatggacacttagattgatactgtatcttggctattgtgaatagtgctgcaataaacatgggagtgcaggtctccctttgatatattgattttttttcctttggataaatacccagcagtgggatttctggatcacatggtagttctatttttaattttttgagaaacttccatagtgttttctataatggctatactgataaatgaatttaacaaggttgcagaatacaaaatcaacatacataatcaatagcatttctatataccaataattaacttgctgaagaagaaatcaagaaagtaatcccatttaaaatagctataaaaaattaattgtctaggaataaatttaatcaaatttaataaattctttccgatgaaagaaattgaagaagacacaaacaaatagacgttccatgctcatgaattggaagaattaatattgttaaaatgaccatactacccaaagtaatctacagattcaatctcttatcaaaataccaataacattcttcacagaaatagaaaaataatcctgaagtttatatggaactacaaaacaccccaaatagccaagcaatactgagtagaaagaacaaagtggtaggcattacacaatctgacttcaaaatatactatatttggttacatatagtaaccaaaatggcatgatatttagtataaaaagacatatagaccagtgaaacagaatagagaacccagaaataaatccacgtatttatagcaaactattttcaacaaaggtgccaagaacatacactggggaaaaaatactctcttcaatatacggtgttggaaaaactggatatccatatccggaagaatgaaattggatccctatttctcaccatatacaaaaatcaacacaacatggattaaagacgtaaatgtaagatctgaaactataacactactagaggaaaacacaggagaaatgcttcaggacattgatctaggcaaagattttatggctaagacctcaaaaacacaggcagcaattaagatctttaaaccaaatttgttgtaattttgtcttatgacactagcaacacaagtgaatttagaaccatttgtctggtcacttaccgtagaattaaccaccttcaaaacatgtaacgactttaccacttaaacccttaccattttgttatggtcagggatactgtgggccaggtattcaataaggacacagtagaaatggcttgtctctgttccacaatgtcttggaccttagctggaaagaagcaaaggccaatggttacttgatggccgggagcaaatatcatctcaaggctcccttcctcacaggtctggttcctatgctaataggactcaaagacgaggataggtgactcattacctacccatggcctctatacatgggttggtgttttcacaacatggtggcctaggtattcagactcaaggctccaagaactagtgttctagaaaactaagaggaagctgcgtcactttttatgattgagcctcagaagtcaagcagtatcactttccctactctactgtttgaacaattacaagcccactcagattcaagtggactccacgtcttgatgagggggaactaaggtcacaacgtagaagagcacagacgataggagacactggccatctttggaaaatacaatttgccactcatcatgtgttaatgcacagatgaggaagtgctatctgctcttctcccctcctcagctcaccctgacttctgtgtttccagtcctgattatttataacacatgttcaatataacaaggatgttttgaagcccaaaggagtgaatcctttcctagcctttcaaaccaagataaggaaaaagtggaagaagacattaagacatgcagctctaaggaactatccaaattacactaggtagatgccctgcagatgtttaacttcaagatttccagaggccacgtgtgtgtcagtatcagagaatcaagtttacattctcaataagtagatgttgagaatatacagctgatccccactatttgaagatttttgcatttgtaaatttgcctactgactaaaatttatttgtaacccccaaatcagtattcagagtttttgcaggcatttgtaggcatgcaccaagtggcaaaatattgagttaccttatgtgcacgtcaacagacgaaggtgaacaaggcaatactctgccctcttgtttccattctcatactgtaaacaagtgaccttctgtggtcaacctagtgccttatttttcaaacttttgtggttttgttagcaatttcactctctaaaaatgaccctcaagtctagtattcctaaaaacaataaggctgtgatgtgccttacagagaaaatacatgtgttagatacaccttgctcaggcatgagttaaagtgctgttggctgtgagctcagtgctgatgaatcaacaatatatattaagtaaggcatctttaatcagaaacacacataaagtaaggttatctattgatcagttggcaaaaatgtaactagaggctcactggaacctaaacctgcatttcccttaggagcagtggttcaatatttgctaattcattgtttgcagtgactttatagagcataacttatattacaaataatgagaatcaactgtaccgtagatcaggacttttataagccctggagatacaacagtgaccaagcagaccaaaatccctgctgtcatagagtttatattctagaggagaggggaaaacataaatgaaataaataaataaaagatatgtatgttagaaggtgataagtgctatgggaaaaaataaagcaagtgatgggaggtgggagtgggcattcaaggtggccttttttgttgttgttactattgttttctgtttctttaccaaaaaaaatggccagggtggacctcaataacaatcagataacagttgagacagctggtgaaagagatgaggaagaacactaagcgatttcccggaagacagcagaaagaacaaccagtacacaggctgaggatgtaaacaaacccgccatgttgtggaaaccaggaggaggctcatgtgcccaaaatgcagtcagtaggagataaggtcagagaagtaagaaggtgtcaactcaatagggcctggcagcccattgtaatgactggggctttcacactgagtgaaagatggtaagcatccaagggagaaacaggagagcaattaaaagagtggcaaaaatctagacttggagagtaattaccaccgattataagaagtggtcaggttccagatgtcttcaaaggcagagccaacaggatttgccggtggattgcacgtgtaattgtgaaagaaatgatgatgtcaaacatgactccaaagtttttggcctgagaagctggaagttgccattctaagacagaaaagactgtagatcaagcaggttctggaggggatttcaattctactcattttaaggtgagatgtctacttaatatccaagtggaaaaataaggtaggcaactggatatacagggctggaattcaaagaagtccaaactggtaatatacattttgagtcctcagcataaagatggaatttagagacatgtaactgaatgagaccaccaaggaatcggtgtaggaagagaagaggttgaagaatggaatcctgaggcattccagtgtcaaaagaagaaattgagaaaagcagattgagaaatgtggcctcctggaagctggatgaagagagtcttcctagaaagagtgaatgattgttatgtcagcatgcccagaagtggggtaggatgaggactgggaagagagaaagtcctgatttgtagagtttgccaatttccatggcgaaaatactcccaccagagttgatttcaagctgttaatgtgatgtcattgaatgcagagtttagaagagatgcacacaattggctctcaggagatattgcaaactgatctcagcagacattgcaagctgatctcagcacacccctgacagctaatgatatccattgcctcagcaggctttggcatccaagagggaactaactgcccaagcaagtctgaacgtggcatggctgaatctctgtcatctggacagggccaagcaacatttatcttcaatatggtaggctggcaactttctcagagggcagcccaagctgggctgggcaagaggggctcagaaaaggatgtcatggtccttgcagccagactcatgctaacttttagcagagtgcatttcagtaatgaacagcctgagggatggtccctcagccaacacagaatgcagacctctttgcaggcttcccagatcttcctgagcacatctttggtgtctgattcaacaatgagagggtctgactagacagatttaagtctcagatggacttaccgagcaagtacactaaagtaatctggacactttaacaaataaaagcataatactctctctcaaagagttgttaaaacaaaatctgatgagaaaccttcttggaaataagtctcccggcttatgggaaccttgtttccaaatctgttagtattcccgcccacatcctgagaatccttttatgttctctcagactccagaccctacttcatacatttcctgctgcctagactttatcttgactggcctgattactgataccatttggttccagccacttaattcccagcagcctgaaatggccacatccctaaagcaaaataccatcggactaggaggaacatcaacctgcttaaattgtgggctctgcctttcatttacacacaggaagaattttccaaggaggtttttttttcccttccctctctggaagtctttaaatgtgagattttcatttttcataaaataataattaacaaacatacatcgattacctactgaatgcagcgcaccatacaggattctataaaacatacaaagaataattagatgtctacttataatgtagttgggaaatttgtcattttcttagataaaattctgaccaatgtgagtgcccagtgaatgtctcagaaaccaggtactggaggacagtgagacacaagaagcccacaaagctgcagtctacaggatggataagatcaaaggaaaggaaaaggaatctcctatttgcttgccacttctttgtgctagaactgttttagacactacatctgtttaattacatcgcaatacttcctattgctataaaaaaggattttcctacttctatgaaaagagagtgtcattcctttttacaaatgaatcacagagtggtaaagcacttaaccaaaatccacagagccagtcagtggcagaagtgggaccccaacagaggaaaacatctccaaagtcctatgtttaactcttactaccacttcacattgcttcccttagactgaggagtcagtcgaattgtgccgcccctcttcccaaagatacgtccgagtcctaaatccctgtatctgtaatgggatcttatctggaaatagtatttacagatgtaattaaagtgtcttgagatgagattatcctggaggtaggggctggactgaggagccaaatccaatgactggcatctttagaagagaagggaaaacagacccagagacccagagggagggccatgtgaagatgaaggcagacgttggagttctgcacccccaagcccaaaacaccaaagactgccagcaccccgcagaagtctggagaagggcgtggaatgaattctccttcaagccttcagaatgaaccaaccctgccaacaccttgatttttagacttttgaccttctcaactgtgagagaataaatttctgttgctttaagccaccaagttgttgtgatttattatggctgccctaggaaactaatacggacagtcaggatgaggtcagtctgcacagagacatgggggaagaaagagaagaaaagatcacgaaatgtgacttctaaagctgagccaaaatagggttcctgggaagagggagctatactctttttgctgccagtggcaagtcctgaactcccatgtcttggtttgattccaactagcgtgtcataaactattcggtttgactctgaatgctaacatctaatcagtttcctcagcttgctggttttgctggtttctattgtttgggcaagtttgagctacacagacacagctcctggtatacttgtcctcaaatatcagagaacatcgaatcattcaggtgcatctttgtgagcacactgaagagataagcttctaagaaataaaactgatatcactggcaatgcctaccattggtcaaaagtaacttcctcaatagctcttggtggtgcctagttctgtttttacatggaggcatcagataaaatgcaatgattccaataggattcagctatcatcacccattaacaggtcagttctgagggaagcagctctctggggatttattgtggaatgagagaggagagaaaactttatagccaaagcaaaacgcaaagagatagatctatttgagaatcctgggcattcaggaatgttagcaaggaattgaggaacagactgaaatgaagatgacaaggaatgagaataaatcatggttatgtccaattttttgtatgttggtgttcaagaaccataagtagccacttactgaattctgattcgagcttactaaggacctactaaggacaatgtaccccattaggtgggtgtactagagctataaggatgaatgagttcatctgctcatagcataaggaggcaaactttgggggttgggggaggtatatgttgggagtcagagtagaggaaagaaaaatgatgccatatccctcagcttctgggaggtgatcccatcaagagtgcagtggaatttttaatgttgagaactccatgaagttctgtaaccaagtaccccccattgtttctgagatagagaatgaattattttttattttctcttctctctttccccctactcccctgttccccacttcctatttagctctttagaaatgcaatgatgataatattttaccttccctccaccagacatccctacagggcaagcttatctgactatgtgcttacttaaaagctccaggacagaactctgtcctaccaggagatttcctcaaaagacaacagtcaatacgcaacctaaagtacgcccactatgaaaccctctcccacctggaaagtatctcgagacaaggccactttacaacctagttctgcccgggatggtgccagctcgaccacctggtagataaggcacaaatcgagtcatgcagacccccacctgctcacgccctcccttgcatgccattcatgccaagtccccttttaaaagtttctgctttctgctccaaaagcaaagtggtacccataaggcaggcagcctgtacttccctaagctagctttggaatacaaaatcacattccttataccagactccgctcttgttcattggactaagcaggtggcaagtgactaaacctgtattttggttacatttctactgagaggaatccagggacaccaataacaggctgagagttgtctggctgctcagagctccacacaaaggtcgggtatttgtcagaggaggaaaagtgtggcatctttatatagaccagggctcaccggcatatactttgccatttcctgggaaaggaagcttctggctcctggaaaaatggcagaaacttgaacagaggattggtgaagtcttttggtttatgtggccagatagtacaaggttcctatcaggaagaaaagcacatagtgtctttcttcactcctttgggtttgggaaacaaaaaaaatacaccaaaggcagtgaggccaccataaaacccagagtgggggcagaggacaggatgctggggagttcaggggaagggctcttctgaggtctgagtttccctgtatctgcgcatttatcccaactgaacttttccacgggagtgcttctggcctcctctcagcctaacctccccacctctccacatcctgagcaaaggttccatgtgaatgagcccagatggaaaaacactggaggagtttttctttgtcactacaggcaggaagaaaatggcaaatggagacaattatttgctgaatttggtctccgtagactcatactttttgcttagttttcattatttgaggataaagattgcttttaggcctaagagactcagctaactggacaatttttcagttcatttttgagaagtaggcatggccttgggagaacattttttaccctctccgcactctcattccatctcacatacaaatacattaagaaaatgaagccaactgaagcagaggtcaggagtgaaagaaaagttgatataagagcttcagcaacagcagctggccccaggcactagcggctgataaaggaaactctgggcagaagagcctgagatgaatgggatattagtgagaggagctgagccggtcacatagccaagttttgcaggaggaaaaaagagaatgggaaattaattataatcaattcctactaaaaccctgagaattggagacaacacataggctattgagagggcgatttctcctaattctttctgcaaggtcttagagtgcttcttacccacaacagaaggtacgagaacctctgccaagcatatggaattgccaacttcaagtcaggagaacttacttgtgagcctcctggagatggttatgtggacacagatgatgggttttctttctgtttagtaaggagttcagtaaggagtaaacctatgtttgtttggttctcatactcgtctctactccctgctgatatttcccttggcagaaaatgagtgcactgaccaagccaaatgcaagcaataaatccggtggcactttatatcgtattaactccagagaggagttagaaggcctcaagacaatcatgcctatcgtgatattggaggttcgctgtttggagggcagaccaaaacctggaggggtctagatatgaggatcagaggctgagaaagggtattggggtagggagtgactccaactttgctttcagccacccttctcagaggacagtgggcagaccagcaaaaccattctggagggaaagccaaaaaaattagggttccaggaaggctgaaaatgaaggcggccttttctaataaagtgaacaggatcaagaggctgccaaatgctgctcactccaaccccttttattggcagtgaagcaagtcaaatacttactaggaacactagccctttcttagaagcgactcttgttgaaaaaaacatcctgtgctttgcgaagtgatttgtccctgaagaactctatgagtaaaagagactctagctgtgactttggccaagtcaggtggtcttgctactgatgagggggctgaatcctgagcattctctttgatacggaaaataaaacggactaggggagaaggtatagaatgtaacgcactaggggttttttggagggaggataatctctgggcagttccctactcttgaaacctagcctggaatgggctttcacctctgtgctatttatactaaaactgaattggccttagggatgggatggaaagtaattaggattccctattacctgatgattttgaacccaaactattcccttgtggacacaaatgggtatggtggagtcaaatgcattccgtgaattcttcccctattgttttaatcaaagcaccgattttagcacagactcatgtgccaaacaaactattgaaaaactactgtgatacacatttaatgagatgatctaaagtgtttctgggggcttgtcatgggactgctgaggtggtctccagggatgcttagaggaaggatatgggaagtgagacatgtgggttgaattgccccactcctaataaggctgataaattgaaaaaccaaggtatagaagtgaccttttacgttctggggcaacttttcatctgtgcttaacgagagaaatgaaaatcggatggatttccactgaaaatttcatgtcacgatttcatgtgaatgatctaatatctagctttccccaggagccagtgaattatatatccagctgtggaaactgaaaacaccatgaggctgctcatgttaggcacctgctgtagagaaagacctttcgcatttgggaggaggggcagaaggcttgtttgtaaaacagcctggtgtgatgctcttttctgagcatttttctcttgctctctctgccttgcctgagttgtctcttctcagtgactttaggagacatacctttgggctatcttcataaatcttttgctatgaatcaggatttaaatcattagggttttcactcatgccatttaggatactgaaaacaagtgtgcacttttcagacattctgtcttacacctgtaggtcacaagtctttcatgcctatggtattttgttacagtctatatggtttactgttgcatctctcaatccattgaagtctattccctaaaaacttctaggcatggagtaaatgtcaattacaaatgaccagaatttaacaacaaaaaatttctaggcaggaatgttacagcccatcttcagttctggaggaaagctgggatagttcataaaataattctgtctgatttgtttctatgagaatctgtgtttagggtattttcaggagagaggaatacacttacttgctctaaggccacacatcttaaaccgagatacatctactctgggaggtttgcagctggagttttcagctgaacttttaaaaactttgtttaaaataagttgctttacattggaacttaatatcctcagtggattgagatcgacattctgggaattgaaattgtgtctggagaagagaaaggagcaatgttgcattttgcagtagaggcagatgggctaggcagggatgggggaagtcttctgaaaggaaagcagtgaacagttggggaggggttcagaaatggagctaggggaccaaccacagaaagggtggcctactttgggatttttctagctgcagcataaatctagtacatctttttatattgaaactaaatacagatatgaaatagagcttcatctggcaatggcctcatgagtgttgggcaaagctgccttcttctgaggctgtttccttcaggcacgggcttgggctcctcttctcattccctcaagccccactctctcaactcaggtgcctttgtcagcttgacataagatcctttaataaacctaatggcaaacatcaacgggaagcaaaaaatccagatctcaactatggcatgaatagttgcaaaagatctaactaaagccacccagccacagtgtggcttcctttctgcacaagtattcttgcttcctaaaaaaggaccaacctggctgggaacgctggctcacgcctgtaataccagcactttgggagcctgacgtgggtgaatcacgaggtatggagttcaagaccagcctggtcaagatgtgaaaacccgtctctactaaaactacaaaaatgagccaggtatggtggcgggcacccgtaatctcagctactcgggaggctgaggcagggaattgcttgaacccgggaggcggagcttgcagtgagccgagatcgcgccactgcactccaacctgggagacacagcgagactccgtctcaaaaaaaaaaaaaaaaaaaaaaaaaggaccatcctataccccattctcagcacgtcattcaggtactggacagaccttagtcttaaaaccagcatgcctggagtgggctcttaccctctatgggcctcagctatggggggaagaaaagaaaaaaaaaaaaaaaagcgttaaactagggactcaccaagggcccttccagctctagctctcttcaattctacatacagcattaaagaatttcaggatatatctccctggcttgttgttagtctctttttactttctccaactttccctaaagcagggaatagcaaagaatagcaaagaaacttggtgctgatctgcagagagagcctctcctcaatcagagattctgagccaaggggtttgtgtgacctttggaactcaaccacaaagccctggaagaactggttaccaccaggaccctagagaacaatcccaatataagccacactttctcttgttgttctcctatctccatttttgaacctctccccaaccttttactgccttgccatctaagtctactgtaaaaatacaacatttctcctttctcctctctgtcccaggcaaaatttctattcctaggatgttgatctcaatctgctaagaatattatgttctaatgtaaagcaactctttttaaacacagagctcaactcaaaacaatcttcagtgatctaccaaaaaggaagatattttgaataagagacttccttcagatgaaatcagtataattaattcaaatcccatccatcctctctttatataatcaaacttcacagcaggacagagataatatgggttagccaagaagagaaaagttttcagtcctagaagaaagaaggtctctgctatcacctcataatagctttggggctactccctccaagatcatagagctcgtcagcataaatcatagaggagctgtttgcatgcagcagagggacccagagtgccacctggcatggtccaacctaagaacctaggtgagaagcatgggaagccaggggttgccatgagaataaaggtaaagagacacagtttgtctaattcttgggtttgcttggggtcagctctgcgtgtcgaaatacccccttccaccaattttctaggcttggcttgactccacttacactcccgtagatttcagctatcatccctgcttccctcttgggagttttttttttcctcttgggagtgttatttaggctggggagaacttaatgcagtcatcatgttgattcattttcacaaatacttattaaatgtctgcttttgcacagctctgtggaagggccagagtggtatataatgcatgatctctgacttaaaggaacttgaaagtaacctgtgccctaactttgttaccgacagggaatgattttggaggttctgggagaagcaatctgttaggttggtgcaaatgcaattgctgtttttgtcattaaaagtaatggcaaaaactgcaattacatttgcacaaacctgacactcctgacacctgagagccaactgccaatcattccaggatacactgtgtgcactttgctttctcactgcaatcttctttaagcattcatctatctctcaatttccatctaattgaaactgtggcagcagcattagcagctggtggtggtggaagacctcctgattccagaaatttcccagggtggccccctacagtttggatctgctgaggagcatgtggaaattcaaaggcatgctctcttatggagaacagtttgttggcaaaacattgcccgtttgctgcacatctgtaaactgaagtagacctgtctttctcgacacattaaaaactggtcaaaagcttcactggctaattaggttagtgatatggtttagctgtgtccccacccaaatttcatcttgaactgtagcccccataatccccacatgtcatgggagggacccagtgggaggtaactgaatcacagtggcaggtttttcccgtgctgttgccatgacagtgaataagtctcaccagatctgagggctttataaagggcagttcctctgcatatgccctcttgcctatcgccatgtaagacatggctttgctcctcctttgccttctgccatgattatgaggcctccccagccatgtcgaaatgtgaatctgttaaacttctttttctttataaatcacccagtctcgggtatttcttcacagccgtaggaaaatggactaatacaattagttgcaaaattaggttaatcaccttctcattgaatgtaacttcatcacatatatataaatgatatatagtgtacttcatataaaaatggttatatatacatacacacatatatatatatatatatatatatataatggtttgtgtaccttccctgagaatgtgggcaactggagaactctggccatgggtgcaaaagggcctcccttgctgttccatgatggtgctccctcaggcccctcttcatctctcctctccagcccctcaccctctgcctgggctcaggccctcatcttctttttcttagattacctattccaacagcctccaagcctgtctgctgcaaatccagtctgtttacaacttacatctgaccatgtttctcccctgcctcagagctccctgagactccccattccccagaagagaacatctgagaagccttacaaagtgctgtctgcctcttcaatatcacttctgccaacctgctgccttgcagatgggcaagaagtccctcacacaccccaagctgttgctcagctttgtggctttgcaactgctgtcaccttttgccctctgcctatgcttcatttggttaaccctactcatccgtgaaggctcggccaggggacttccctggctgattgctcccaaaatatgctgtgatggatagcaccatcagtgtgcttccatgaggtatcgtaactaactgtgcaatggttctctcctcaccgaggactgtgagatcctagagaacagggaatgggtattagtcatcacatccccaacattaaggacagtgattttgccccccaggggatatctggccatgtctggagactttttggttgtcataactagatgggggtactactaataccaactaagtggaggccagggatgctgttcaacagcctccaatgcacaggacagcctgcataaccaaaagttatctggccccaaaccgtcaatagaaatcttaatctaggacaaagactacaaacttaacgctgcttaatgaatgataaagtgaatatattttactgaatgaaactctgcccttaagtaaggtccacgtgacaattgttggatcatgggaaagaattcaagtaaatgtactccttctttagaacaagtaatggcataagcctagtcttttattgtggatttaagtttggctccagttaacaaggtatttcacgttatcaactgagcaactaggaataatataccgaaggctattctctacatagagtaagaatttctagactaaaataaagtcagaatgtcagaaataaaacaggtgttaaaaatcatccaacttgagctactgattttataaatgaacactccaggtcctgcatgataaagtgactccccaaggtcacctagctaggagtgacagggcctggggccagtgaaaagagagcttgtgttatgacttcaccagaaatgaatatgagactactgggtccatctctgggatcctaacagagattaggtcagggctgggggtttgggagaggagaagagagaaatagagatagctgggaggtaggctttgttacatgtcttggtttctttcctgaacagtcggacctttcctcacatctcatggctactgaatttgaggactgcctagtgccaaagtctgtaccttgataccttagatcacacacaattcaaacttttccaccttctggggtctctcactggcaacactattaaaattttgggcaagacgattcttgtttgcaggactgactctttggaatacctggcctttgctcactaaatatctgtggcatctccaggcatgattattagaaaacaagcgaggatattttcaaatgccacctaggagggtggtactgcctcattttcctgtcccttcaattgaggatcaccaaagaccagttggcagggttgcatttgtgttgagcaaactgcatcttggtcagcacaagaaagcaatcagaatgatggatgagaatggtcttaatgaccaccttcaccaaaatgacctgtgttgtctgttaaaaataaaattctcaggccccactctcagggagtaggatgcaagaatatacatttttaatagtctcgccaggtgattctcatgcacactaaaagtttagaacctctgccttagcagtagcactcaaccctggctcatatgagaattaatgtttaaaaatgccattgttcaagccctactgtcagagatcctcagtttcaactacagtgaagccctagccttgcatgttttaaaacctgcctaggtaattctaatattcatctaaagctaagaaacactaccattatgaaatcttgctagttaagaggaaaccacaaattaatcccctcactttcgggttaaatgcaagaaacttaatgttttcaaccttggctgcacccttagtgagatttctaaaatcgcagtgccacaccccatgccattgatatcagaatcttctgaactaggacccaggcttcagtgttttttaaagctcccagttgactctaatgtgcagccaagcttgagaaccatggattcagaatattttcctaaattctcccataaacctctgctcttggcttttagctttcctcctatcccctagttcaaaagtttgaggttgtgggggtcagggcaagaataataaagggagaaaggacaagattcaatccaatccagttcttttctccacttaatccctggctaccactgactcggcactctgggagtaaagagcagtggagaaagctctagacctattggtgtatatttccaagaggaagatccttggaccagcatcaagttggctttttatcttgattcttccctgaggtttctaaatattgttccagcataggaatttcagcttttattcttttccaacttttcatttatatggcatgcatgggtcacagaagcaatggaaagttggaaaccattgccttctaattagcagatgtctcagtggctaacattatttgccagtagcagtgccagcgcagcgctgggaaagttaattactgtcgacagtcctcgagcctgttttcataactggtaatgactgttaatatgtcaccactgaagttagagattcagaaaagtcttttgtcctaggactattaaatgtcatggaagaataacccccaaatttgcctttgggtagataaagttcaatgggactggctgggcgcggtggctcacgtctgtaatctcagcactttgggaggccaaggtgggtgggtcacgaggtcaggagttcaagaccagcatggtgaaaccccagctctactaaaaatacaaaaaaaattagcggggcacgggggcgcatgtctgtaatcccacctacttgggaggctgaggcaggagaatcgcttgaacccaggaggcagaggttgcagtgagccaagatcgtgccgttgcactccagcctgggcaacagaacaagactccaactcaacaacaacaataaaaaagttcactgtgacctttttaaaagaaatgttaaatctgaccccagttgctaaaggcagaagaataacacgagatttgagaccaagccagttcctgtttgactattttgaccccatttatagtcatgtcaaatgtcccccatttctgctggctccagccccatcttgttgctgcttccttgagatgtgaggaacaatcattctttcttctgttctaggccaggtcccagatgctgacaataaaactgtctaagtctggagtgttatggctcctagtgttaggttctttcaacacacaccacacacacatgttttatgtaaggtgcatcatttgcaatgggctggtggaccctgatatcgagttgggggtcaccagtacatgttccccttccctaatggtcagtagtcctgccctgccacatggccttagttaggaccagatttgaccatcagatagttaaataaatcagaactgcaaatccatcaagatcctttctccttatgtgagcttatgtctgcaaatagatatgtggtgaggatggggggaagaacacagcctgacaacatacaacaatagcatccatgcctcaaatcaaaaatgccctccagtgggtggatacttgcctgaaaactgcaagccccaaaagaaccactcaaatagttctacccagatttccagacatttcccaagtgaaacagcctcttagaacttaaaatgggaacgtcagagacattaatatctcattcctaccacctaccgcttaatcagtgtgttgctaagccccttacatatgaaatctttctcagtcttcacacaacccacagagggggacaagatatcaccatccgtacttaacagaggaagaaatgcgctgaagattacacaattaggacgtgtaaggatatgattcagggtgtgtctggattcagaactgcacactgcacctgctgtgctttattgcattagctgctgctgctgctctgacctgggctgacgttgcagtgagtctggagaaaccctttgccatgtttctgtgttttcatcacagtttctgtcactactttcttgaccttatcactcttacagtcctggtcctattctgtctgtgatgggagagacctttgccaaccagcctctctgctcattaattagatctcaaacatggtgtctttgtgttctagtctttctatggtgcccttgtattatgaacataaaagttaagcttccagatctctcacaggtaccccattttctcctccctgtgcttctctgaacttgtttccctaaccacaaacagaacaagttctctagaggttgagtcagaagaatttttgtggtaaagaagacattgaaagggggttggtctactaaatgtcttgtgttagggttctccagagaaacagagaaatatatatatatttctatatatatgtatatatattttttatatgtgtgtgtatatatatatgtgtgtgtgtgtatatatatatatatggagattgttatgtgaattaactcatgcaattacagaagccaagaagtcccacaatatgccactgcaagctggagacccaggataggtgtcattccgttagagtcctaaggcctgagaactgtcatgggaagactttggattcagccatgactcaagtgtaccagtggacttttcagttacatgagaaaatgcattgtctttctctttaagcagttgggttcattttctgtcacttggaggtgaaggttcctaaagactacagcattcttcccatggatcattggatggcctcatgcaaaagtgttgcccggacactgtgtgggacagatgaacccaaaagcatttcttccctaatatgcaccccaacacccagaatctcatctatgcatgagaaacagctttgtaaatagtaaactaggtgtcaacataaagtcacattcctataactcagtgtgaattgaccttcttgatatgagagctgagtgaagacagagaatgtatgaggctttgggtacaggttcctgaggcgtgctcaaatgtacgttaagagaaaagactggaatagggaatgagagaaggaattgatggatgttaaaatgaacatattaattttgcctgtgggcatgtttccattaattggcttttggatctgaaccaagaatagcagaattgaaaacctaataaaaaccaaacccatgaagagaagaaaaattttcataatagcccaagtgagagtaatgacgtgagctaatccaatttgaagtataaacaaagaaatttcttcacgcaaagagactgacttattttgtttcagaactaaataccacgcagtagaggttaggtcagggaatctggcctaaatatatgggggggtcagggagatggaggttagtcattccattggaggacagaagaaaaaggaacaagaagttcttttatagtgactgaccataaagttttgaaaaaagaggtattcaaatagcactttaatccacactgcatgttatgagaggctatggggagatgtacaatttaaaagctcactaaaaaatggcaaattaaatttcattttctacttacggttgatagacgtgacttttcaaggtcaggcatattaattggctttcagatattaagcactgtagaaagaggggacatatttaaactttcctttaaaatagtggtttccatcatttttcatgttattatacacaaagaaagtgacaattttacggcactacggtaaatagactaggtcatttgaggcagagattgctggcctgggccaccccaggtccacctaggctccccaaagactgaggaatacctattttgtatacaagtgagctgcatccactagttaagaagccaaatcaaagactgtctatgaggcaaaacatatactgcagccatttgggggaaagaacaaagcactgaactagagggcaaagaccaacattttggttctagctctgccaagtgtaggacattggactaggcacttaactgcagtaagcctcagtctgcttgtgtacaaaacagagtaaaagatttcttgcatttcctactttacaaggtcaacatgaggatcaagaataccatgttcataaacatcatgtacaaccatagagtcctatagaaatgtgtggcctgatgatgataatgagtatgacatttttcttcctagtcctacctccatttagaccacccttcctttcaagagtcccctgcaatggacaggagttgacaccaaggagaacaatacagctgctaaatctcaagtggctaggagcacagagtgtgggaagctattctgcagctgtgtttttgagttgggccaaagagctagtggggttttggcttcccaagtacctttgttgaaactccctggggaattttgctttatgaaatttccagcaattggagatcccactgggttggtgaatagaagcctaaagggctccctgttggatgaaaaaatgtgtttgaagtctgctgggaagagctgtaggagggagctgagggttcttccatgactcctactgtgcattgacagaagctgtccctaccactgttgattgccaattatttttgtctccagagccaaagaaaatatatttgaatttgacccatctttcactaggatctacagatggtgaaatattaatgaacaggtgggttgcacaatattccaagattgcgttagaattgatttttgtaggctaaattattaacaccagagttgctgacatatattctcatatgattagcaaacccagaagccttaatatcaacacagaatacattcagaaccatcaaacacaacatctactttgctgggaacagaatactaggtaaaggaattgagatctcacacaacactcctctgaaaatagggacagctaattttgtaatggattgccagcaaaagctgtgacaatgcctactctggaagtctctaaatttcttttcaacctgagaagggtgttccatgatatttactggagtaagaagtgatggaggaggtagaatagttctggaagtcaggtctctaaatagaacaaatcttgggatcctccaagtttcagtctatgcatggaattatgtttaaagaggcaatatctagtagctaaataatagctaaaattgttccaatcatgacttgcacctctcaaagatcattattcaagtaatgcttctatcctttcctccagctcagtgtttcctgaacttcccctgcactgatgctcttgcttacctaagcctcttcttcagcctcttctccatccctggacaattcaatgcactgcatggaccttgcttagattctgatttgagcaaaccaacttttcttcttctccttctccttcctcctgcctccttccttcttctttcagatagcatctctctctgttgcccaggctgaatggagtggtgcaatgacaactcactgcagcctcaacctcctgggctcaagtgattctcccacgtcaacctcccccagtagcttgtactacaggcactcaacaccgtgcctggctaatttttgtattttttgtagagacggagtttcaccatgttgcctgggctggtctcaaacttctgagctcaaaagtgatctgcctgcctcggcctcccaaagtgctgggattacaggcatgagccaccacacctggcctcaaaccatcgtcaatgcaacactttgaagacaatgagggaaatctgaatttggatagtgtattagatgataccaataacatattattagttttgataggtgtgattaatggtattgtgtttatgtaagaaaacaccactatttttagcaatcaacacttagatacagaaagctaaaatgacacaattctgggattcggttatcatacatcagccaaaataaaggaggaaggaaggaaaaatgtacagaagtaaaagtaggaaaatactgataattctggaatttaagtgattgatgtttgaagtccagtactatattctctatttttgtgtatggttgaaatttttcctatttcctgggaaaattttccttgaaaaactttttaaagaattttaaaacttcttttcaaaagagaaaaagaaggactggggtggtggatcatgcctgtaatcccaacactttgggaggccaaggcaggcagatcacttgaggccaggagttcgagaccagcctggccaacatggtgaaaccccatctctattaaaaatgcaaaaattatccaggcaagtttccacacacctgaagtcccagagaatctcttgaacccaggagccggaggttgcaatgagctgagatggcgccactgcactccagcctgggtgacagagcgagaacttgtctcaaaaaaaaaaaaaaaaaaagggagaaagagaaaagcaaatgcaaatatcttcaaacgtcataagaaaaggcaaaagtgaatccgataaatatattttaaaacaataataaaagaggcattttgctgacagataaattcatgaaacaagactgacttttttgaatgccattcatagaactgccaggtcagctgtgtagtgtgaggtatatttcaatgcaaaatactgaaattataaaaacaggattatgcacacaaatgtttcaagcctttataatttttttaagtccaaatggcataggtccatttataaaatattttctgaatttatattatgatttaaactagcaatatcctattaattaacttatttaaaattcataaggagacaagttatttaaaaaaaaaaaacactcttgaactgagtaaaaaatagcacgaagtgaggttcagctctggggagaagggaagttgtgctaaaacttttcaaaatggaatttaacctcagacttttaaagcatcactttctttaaggattcacggctttcctcccacactggtctggggccagtgtctggagtaaagtattgctactcctaaatgagattttagaaagtagcatagtttctgaaaggagcagccactggaaaccaaaaactttctcagggtactcaaacggtttgaagagaactgatatttgaaaacggaaatccttccatttgtgacaacatggacaaacctggagaacattatgctaagtgagataaaccagtcacagcaagacaaatactgcctgatcttttgtatatgtggaatctaaaatagttactctcctagaagcagagagtagaatggtggttgtcagggctggggtatacaggaaatgaggagatgttggtcaaagggtacaaagcttcagccatgcaagaggagttagttctggagacctaatatacagcatagtaacgacagttaacaataccgtattgtagacttgaaatttgctacaagggtagatcttaagtgttctcaccacaaaagaaaagaggcagctatgtgaggtgatgggtaagtcaactagtttgattgtggtgatcattttccaatgtatacatatatcaaaacatcaagtcatataccttaaatacatgcaatttctatttgtcagttatgccccaataaagctgaaattttttttttaaatgagaactgatgtttgcatccagttgctgctaaaggcacaaattttctttaaaaactattgaatgattttccagctcttacagacatactgggaagaaaaaagttaaaaactatttgagaaatttggattgaactacctcatcctgtatgaggtaaggccaatgtgcaatcttgcattgctaatcactcaagcagagtgctcagaagctgggaaacaggctgcggttaagaacattgcttaaggaagaataattagatcctttccgtgtctcatagccacaatttttttccagctttggctgttgtttgagcaagaccttgtgtatcaaacattgatctagccaagtggcttagtggagaatttgctcaaattggttttttagtatcttgttggcaggaggggaaatgactgcttgaacgtttcagccttaatgctgacatgtggtgacttgaagccaggtgaatgaaggttcctccagctagagaggtaagatgaacatgccggaccaggaagaaagcaggtcatcatgttagacaggtgcaattatgtgcagagactataaaagaagagaaaaagacatttagtcatcagagagcagccattcaagtaagaccttgaaggaaagggagggtgaatcaaacagaaaatataatgtaagcaaacgcacagaggctatactgtggagaggatgtggggaagagggaagtggtccatttgactggaacagagggtaaatttaaggcagtaggaggtcataagacttatggaaaatttggaatgccaaaatgggactgttatgtgttaggttgatactgggtgggggcactgaggatttttaaaacgtgatcagggctgccttgttgaaggtaaacctagcggtggtaagtcaaatgaaatggagtcatgagagaacaggtggtactaatcactaccagtactgagtgctttgcagatgctacttcatatacataatctgatttaattctgatagcaagaaccgttattagcccactttacagatgataaaattgaggcttagggtgattaaacaacttgctcaaattcacacagctaaagcagaagaggcagtgttttaatctagacacaggtacctgcccttaatcactatgcttgacagcttcttaagctagaatgggtggtaggtgaccggggtctgaattaggaatttggaggtagtaatggaaaagagggatcaaattcttagaggtaggataggcaagacttcaccaacaggagcctacggaggtctgtgatttggtggctgcgtgaaaaagaagaatgatactgttactaacctaaataaagaaaccagaagaaagacttggcatcgattaaaagattattaatatggttttagttatattgactttgaaatgccatgagtagatccagtgaaaatgtccatccagccatcggaaatgtagtttggttgctaaagaggggagatggagctagaaagagaagctgaggcatcacgtgcaagcaatagaggggcaaatacgcaagggagggtggcagaagaaaatcatcccaggtgtttcttttcttcttactcagctcggaatagagatgacttctgagtttttatctactcccattcaggaatgaaatggagaaatgtaggtcaaaattttacaaaatggtcatgtagaataattctctgacttcccatctctgggaggaagagaggcagctttagtagaagtgtgaagattctaagcaaaatttaagtaaaattattaatttttttagagatggagtcttgctatgttccccgggctgaattcaaactctgggctcatgagatcctctcacctcagccaagtatctggaactgcaggtgtgcctcaccactcctggctgtctaactaaaattatgaagggcaacccattatctctttactttctcttgccccagaataagacaagaatgccgaggcctggtcagtatcccagggtaccaccgccagtgctggccagagcaggctctgagaggctaacacaggccacagagcctagggccttgttttggagggtgaggtgaggcttaaagctggtaggataggcgccctctgagattcgccatctgagaagtcagtcagttctttattaaaccattctaaacaacagaaagtgcagtgggtgggcaagattccactgctgaattcttcagcaggccctgcaaatgaatgacatggtgtcaatgggagggaaagtgaagcaataaacacagatggtgtttgtgcaatctcatctgggtcaaggaaatcacctcatcactcttctttgatgggcagattcctatctcttagtttaccattttccttactaattccctcagctccatccaatgtgcattcttgtgtcaaattgcatgttcatgagtatattacatgttcctgttgtgagtatgcaggggttaccatgggatgacccctgtgctatgaacttggaacctcaagaaattagattgccttttaagaatgaatcagagaagaaatacaggaaaccactttaaataacaaatgtgttcctaggatagcaagatttgactggaccctgactgacgagattactatacctaaagaaagaacgcattcgtgagaaggagagttctgctcagttatgaacaaagcaactgcattcaataaatatttgttgagtacctactgtgttccagcagagagctcgcattctagctggggagacagaaaacaaataagtgcatttataattggatgtctgcttgtgatatgtgtgtatcccaggcagagggtccacagaacaaacaacagcatctagtgtggctcggagatgtgctcactcaagttctatgccagatttgagaagcctgcttgactctaacatcccaaatctgcatttccagcacttgggtgacattttgacctacctaatagctctcgggttgatttctcctgtgtgactttcatgaagacatacatagaggaaaaaaagcacatatcaaaagtactcaggtcaatgaattttccaaagtgagcacacctatgtagccagcaccccaaatccctccttatagccccttttaccacccttaccactgaaatgtaaccactatcctgagaccagcaccataggtttgttttgcctttttctgaactttatatagatggaaatatacagttcatactcaatacatgctgcatagattctttgattcaatattacatctgtgggatatattcatgttgttgtttgtattggtgttttgttcttttttcattgtcagatttcatggtatcactacatcacagtgtattttatttaaatggacatcagggttatttccactatgccactattcttttaacaaactatttttctgcaggaatctgttagaagtggcttctgatgtttgcaactaagaatcctgcctgatccacatttgttttaattctaaatttgtattgggttacctaggttttgtattgattaagaaatcaagtgaaaatttcggggtttttgtagaaattcttctttttaaactacgcttttgaagacatagacatatttttcatgagctatttgccaacgaagatctgcttactctgtttcaacagtgaagcctaatgataaaaaataacattccatgtagataaaagctgtgacttcccagcttaaatacagcactttctggaactacagctataacttgtgttctcttaggttgctaaacaagttggttaggagcttttctcctcagggttcaaccacatgactgcttctgggcagttcgagtggttttcatcctcattgcacaatagcagaggttttgaggttgtgtttttctccacattgcccatttccctggcggccactctcaggagctgtgaagagctcaatttaaagacagtcatatcagttattcatcaattactgggatcttttcattttttaagcatatcatatcaacaccccttttgtaggactatagcctgtctgagcggggctgtaggagagaagggtatacctctctgtcattacatcattttcttctttgtccgggccatatcaattgccaatgcctcattcaaggcctgacttttgagcaatgagatggaccagccagcagtcattcctctcagtgactcaaggagactgacatttgtaataacaaggagttactgagcacttggtatgtatgccaagattcttagtatggacaccagggatctgcagagcaagcatgtccatttcattaaaaccaatctctccactcgtgctctggataccatccccttgtccttcccaaagactttcctcctgcaataaacccttctctccctaacatgatcaatttctctctccctcctggatcatttccatgagaaggcagatgtgttctggtgcctactttccaaaaaaaaacattctctcacatcattgctccctccagacacaatcctatttctcaactctttcacagcatgccttcctgcaaagaattgtctgtagtcactgctccacttcctcacctccttttcttagctcagccaactctggttaacttccttctctccatgcccctgaatctgttcatttcaaggtcatgaataacctcttttgccaaacgcagtggccaccactgtgtcttcatcttattcaactttcgaaaatatttgacatagttgatcacttcctcattcttaaagctgtctcctctcccagtttccatgacaccactttctccccttttcctctgacctcactggctgcattgtctcaggcctttttgctcgtttctctttctctgatctctcctggaatgactccaggctctgtcccagatcttcttgtactgtccatctataagctctttgtaagtgactcattcagtctcatgtctctaaataccatctacataccgatggctctcaaaattaaaatttctgatcttgatttatctgacctatcccctaaggtcaagttcttatatcctactgacttctctatatcactacatgggtgtctaagaagtttctcaaatgtagtatagacaaaggtcttggtttcccaatgtccatctttgcctctctctgttctccctagtaaacagcagcaattttcacccattgaaggcaaacatttagaagtcatccttaagttctctctccctcactttcccaaacgaatcatcggcaagtcccgttggcaacagtttcatgtcaagagttaattttaagaatcttttattcaatttaaactgacaatttttaaaagtttggaaagtgggagagaaaacacccatgttttctcataatcttcataattatcattttaatagcacatgctgtatcattgagtagacatatcctaatttactttacagtccccctaatgttgtatctttggagtcttctcacattttatttctataaacaattttcaatgaatgtctgcatgcctatatagatgttttatttttgtttttaaagtagagaagctgatttttgctgttgtttttgttgctgtataaaagatcactgagtgattgccttagttatgcaacaatagagaaataagtgtctattattctggtgttcaggtaaagtagaattctatcaaaattgtcacaaaattgtctttgatgagagccatcatagtgcaaagttgatgactaaaaggagatggttaagttgtctaaagagcaaggccataggagagaagaaactaatattcaaagcttcctcccacagttcaaagttagagaaacctgagaggggtgtactggtatgaccacccgagatcccatcgctgagaaagataatggccctggagacaaagactgatgaagaaagacagtatccagctgtgatgcagatgaaacatgcggcatggttgcactcactatgcagccaaggctggaagccactctggatccagccactctggcacagcgttcttgctctaggaagaacaactgaacatggccacacaggcctcacagctggcatatggaggctgttaataagctgagcttgaggcttcaaaggactcttgtagcctgtgctggatctagcagtgaccagtatgccagtggccatggatgcccaggcccatgttcagtagtgaagcaggtgctagcagcagaagcaatagaaatggaaactgggagatctgctgtggatgaatctcattatcttctttctctgaccctctttggactaaataaactcccagtattcttgaccaacagaggtagggttggaacagaacctcaaaagtcatcattagacttcctactaatagggcattggaagttcaagcgactaactaggaaacaggttagtatttgtacccctacactgtgcaacagattacataccatttgctctatttggcatcctttccttaggctagattcccagaagaaagattactgattcgaagggcatgaacatttttatgactcttggcctaaattactaggccaaggttttttcaaagggatgcactaattttcactatttccccacaccctttcaggtgataaataattgacttgatttgtttacactgacgccaagaattcttgggaagaaggatcaaagtgaaaagtggtagcccatggtggggaggccacactcagtgcagttgtgaagtcagcagcatttttaagcccattcattgccagtagccctgagatgagcattcccaagctgcttcccaggtccctcctccactctctcagggacatccattctgtaccagccccctcagatactcatgcccttgccctcccttctccatgctcattaaaaccagcttaagagcagatatgacatcagtcacttaccttttcgtgtggctctaaatcaaagtgtcacctctcccaagcacatgcttgcatcttagctctgattgaggaatgaaaagctttgttctctgttaaaagaactttgagcttagatgccccagactgagaaatccaccaaaagctggacctttgacttgagcggcaaaggacccccatagtcaggctgtgatttgaggagcatcaagaggccagagtttccaagttgggacccagaaggtggggttggcagggggagggtaggagcagctggagactctgctctaccaggggaatacggaggtggggaccaatcccagggtaaggaatgaaagtaggagccccagaagctgaaaacatacttcaccgatgtcagcattttacccagagccattccaaggtgaccataactcacttaaaagcctgaaagctgttttatgccaactaataaagtgcagtttaataaaaaagttgtcaatcatttttatataaaatgtatttggggcatgaatggttttgatcttttataaagtcaaaagcttttagtgctgctcatggttataatcactgcgtgagcctgggcaagcctcacaaccttgctggccttgactttcttatttatgagctatagacaattacacccagcctgctgcctggagggctggggagagtggtgaattgagtgttcaagttgaaagtaagaggtggtcttcagcggttgactccaagcattacttatgatcaaggtctaatttctaagagtccaaaattaaataacaggtagaattgaatgccttgagcttgtctagtgatatggaagtgtagctaatagcctacagcctaaccgtgtaagatacaactggaatataatacaaaccccatggagagtaaaggacaaagagaaattaaagtaagaggcaggaaataataaaacgatatttaatttggacatgtgcccccaacgcatctgtagaaaaatcaacaaagcataaataccaatgggaaaacctagccataattactctaaaagatatagagacaggaaattggataggagtttgcagtgttgttttgggctgcagggatgcccctgtgtgcctgcaaagggaaatgagagtttatctctgaataatcagatggaattgtacatcaaataagggtaaaattggtcatagtcatctcatgattgcagtggtttctatgttctccaggtcagtccaccatcattgaggagacgtgggtgcggagaaaggggtcaggtatgtggtcagacatctctgtgggatctctgctgctaactagctatgccacattaagtatgttttaacttgtctgaccctccagtttagctcaacaaaatagaagaaaatctccctttcaaggctgttggaaggactacagatgaaaagtatataaagttcccagcagatggaaaatatcaaataaatgtcagctagtagcagcagcaggagcaaagatgaaggccgactcctgagttttcagactccacagatcccagaatccttctctgctctgagttctgagtcccacagttctgatgcatccacctgtgcacctcaccggcaatcagtgggagcctgggaatggttaactaagaggggcttgagaaggcaatgagagaggagcacaaggaggtaaccagccactccactgaagctgtgtttaggtggtggatatgatctgccagcggcccctcagccaaaaccaccaatacaaatccatgtagacagtttcttaaacaaacttagtaaaatcaaatctagaatatctccccctttcaaacaatgcattttcccagtgccaaagtacagcactttcttagcatcttccttctacaaatgatggcgcgatgcagtttaaacacataccttgccaattctttttaaaatgtaggcttatatgataattttaatcacatgctttcccaattattacatgtgtatgtttatatggtaatgttaaccacatgctttgctacatgcttgctgtgagtgatgttttattttatttttagagacagggtctcaatctgtcacccaggctggagtgcaatggtgatcatagctcactgcagcctcgaattcctgggctcaagtgaccctcccacctcagcctcccaagtagctggggctccaggtgcacaaccacatgttgctgatttttaaattttttgtagggatgggggtctcactgtgttccccaggttggtcttgaactcctggcctcaaacggtcctcccaacttgacctcccaaagcactgggattacaggcccgagaaccacacacagcctgctgtgagtgattttaagagaagctgttagagattggggccctagcatctcattgaatcactggttgacaccaccacagcctcccagctctcaagcaattcctaggaaaacaggaattcatcgggaaaatattcttgatcctgataccaaaattaacaaagggggctgcttcttgtgttgtattctcaacagcagaaatgacagttgtgcccatcaaaacccccagagaccctgaccagcagggaagagcagtagcaaggagataggagagaagggtggtataaagagtttaccttctttatttttctctgtccacagttcctttacgcggaaagctatttacagcagccacagtctctgtttggtttggcatgacactgactttctatggataagtcaggatctcatgtcctcatctaaaaatggtaccatattgaatgacgctttaccttcatttctctcacttcactggttttggatgagcataggggcacctttgggtcagagtacttttcagagagggacagtcaataaaaagccttcgtgtataactagtccattttcatgctgccgataaagacatacctgaaactgggtaatttataaagaaaaagaggtttaatggactcacagttccacatggcaggggaagcctcacaatcatggtggaaggtgaatggcacgtcttacatggcggctgagaagacagaataagagccaagtgaaaggggttttgccttataaaaccatcagatctcatgagacttattcactaccatgagaacagtatgggaaaactgtccccatgattcacctatctcccaccaggtccctcccacaacacgtggaaattaagggagctacaattcaagatgagatttgggtggggacacagccaaaccgtatcagtgtgcccagagagagagtgggtaagaggaatagaccaaaacttgaactatgagaaagagaagtaagacggtagggaagactgtagttcagaatctgtaagttataactgacttctcacagcctggcaaaaaattggaagctggagtataggacataaattcatgagcagtagcaattttagccaagtcgagagaaaagcattgaacttcaaatgaaaataatgttcaaagaggtgaacatgaagttcattcaagatgtggagggaattatgagcagggagatgcatgccaagagaaactagatggtatttgaaaaaagtgagattcaaattaaggttcacacacagagagagagaaagagggataaaacaaaaatattttaatggtttccttttcctgtggtctgctttagaattcacccaaaagccaattgtttctgtggttattcaaattttgtttctcttctcactccctcctcttgtctatcctctgatccccagcatttggacagaataagagagaggaagtaaaactcaaatcattttactttactttttcttggccatttggctaagagatgtgtggggtgaagaggtgcttgtggccaaagtgtgatttgtaaaatgtgtgggtattttttgtttggttggttttgcttttagctgctatacttatgttaccccagtttaccacatccagtcctctttgggcacaaagggaaagactcaacaaacatttgttgagtggcttgactcagctttgctccttctcctgagtattcctccgtggagttttagcaacttcccataggaaatccaggctaaggtctgattcatccagtcctgaataatgtgttaatcatgaattggataaaaatcatgaattggatactactcaagaggataagctgttttcaaacatcttagcagtaaatatttgcaaaccaacaagaaacacactaaatacaaatggcgtttctcaattcattagagcaagcctgcaagaaccttgacctgggagtagtgaggccactttctcagccactagttcatgccattatatatacataccagttttaacaatacattatttttataattttcaatgtttgagattattcatgaacctgaactgcccttcaacctgtaaatctgaataagtgaggttttactatgatttacaaaaccataaaacaagacagaaagaggtctgttcatctaatagtggctgtttgtttctcctttcctttttggagaggagggaaaaaaagagcaaatgtctatctagcaagatgacgtagggctggataaaaagataaatgcctctgaggtgtgtagggatattacaaatgtgatttggaagaaagacaagatctgagggggtgggaagttcagtgtagaaagtctcttctatcaggacatggattctaattctctcctaccacactgggcataaccatcagggaatttaaagtcccttccatgccaggcatgccccatcacctaggaagaaactcaacccatcagcaggcatccaaaaaggcgtcagccaggtagggtcccaaagagccccacaccttgggttatctgggaaaatcccaagttatttagaagacagtgtacctcttgcctctacccttggtggtaaacattgcttcagagtcacacacacacaaaaagataagcttttttctcaattgaaaactggaaagttgaaagaggaagtaaagagaaaaagaaagacatatactataatccaggagtcccacatgttcagaaactcttcacctgtgaatctacattttactgagttcacatctgccttctgaagggtaaccactctttaccccccaaattcaactcattacttgttcaactttgaccaagaggtttttttttttttttttttttttttttgagatagtctcgctctgttgccaggctggagtgcagtggcgcgatctcagctcactataagctctacctcctgggttcacgccattctcctgcctcagtctcctgagtagctgggactacaggcgcccaccaccacgcctggctaatttttttgtatttttagtagagatggggtgtttcaccgtgttaggcaggatgatctcgatctcctgacttcatgatccacctgctttggcctcccaaagtgctgggattacaggcatgagccaccgtgcccagccgaccaagagatatttttaagaaaagtctcataaaagcataaaattttatatatggcaaaagcaatcaacatctatagaaaactgataaacacatatgactcagaggaagaaatttccctctatgtattatttactgttaaacttactatggcttataaggccttgatcatctaaacacttgtttcgatttatccattctcttcctctcctcttcagccttcttgagattgtgggtcatctccagggatacttctccacagttctactatcagtgtctaagggattcaggttagggcaacacacacaaaaagtcaaattcagttattcaagcaccaattagataatgaacatctgcctggggtactcacgacattctgggctaaatattcccccagagagaagaataagggagtactcagtgggtactaatgtctggtctgtgacatgacaatgaagtgaagattaagttccatctttacccccattcaccatttatctcccaatctctcttcccaagtcattctttttttttttttttaattatactttaagttttagggtcattcttatcttcttctcatctcttacctgttttttcctgaccctaattcctcaaagaagcttaattcacttctagatcccctccttcccccatgaatataaagaaaataactatatctagttcttttagatgttcaaattgacttgattgctagctgaaatcaaaattgaccagctgaagtggttttcaagaatgttaattcttattctgaccactggattagcacaatgggccattgtacacataagtacacccacaaggcagtcagtaaaatagacaatgcctaaagctgtagatacactatatacatggcatgaatcttttattcatttgtttagtctacagcaggaagccaactgcctcacttcaggccagagggagaatgctgagatattgtacgaatacatgcaattttccaagcttcaggaaatttgaactgaaacattgacaggaaagagcccatagtacacttgcatgttgagctggtgtttaaactctttttcccatgtaatgagctcatatccaaaatgttgactcaacgtgcatgaggacttggcaagtcctgtggggaggagcgccctgtcacgggaaacaggagaaaaacaaggccggctcagcacattctctcagagcacacaggccttcatgggccagagtttctgttattaaaaataagaaaagaaaaaaaacagagaatgtctcctcttaatccagcaataactccaagaagataataagtcaacagtcacttttttcatggctacctactacagagtgtcctagtaaaatatatacttgatacattaatatacgctttaaaaagaatagcagttagacattaaccaatatctgttttggttatgttaaagtcacaaatgtttaaaatgcccatcgtttcacagtcaaccacatataagatatatcttgctttattaagtgtatttaacacctaaaagtgccacacactttccagggcacactcatctgagggagtttgtagaagatgcagtgctcatggggccctaggttgttagctctgaggctgccatgcttcattcaccaacatgtattcccttacaacttgggcccagcaacaacagatttactatataagcctccagtacttcctgaaaaagtcctttccaaataccctcaaaaacaaacaaacaaacaaaaacagtcctctttctgtgtttcaatcaaggctataaaagtaacccatgttaaaaagccaggatggctgcaatgaatggagcacacagaaggcctcctgagcagtatagactttatttttccatcgtggggctcctgtaatttttaaaagtctgtttgaagatattaatttggcaggaatgaggaagatggattcaagggattaggaactgtagggagatgtagcaagtggatgaaggcctggacatgaataatgttcacaagaatgggaaggagggaaagattaaaagggatatttagaaagaagaactgacaagccttggtaacggagcagatataggagataatgaggagagaggagttggagttggagttggtgaggagagatggagttggagttggatacagtgacaacttcgaagtttctatccagaggctgggagtgtgatgggccattgacagaaatggcaaacggagagctggtttgcaatggatcaagatgagggttgaactcagagattcttaaatctaaaacatctcagaaggcaccaagcccaattttatacttcctttctgtatattagagactgaggcccacagaggagaggataaagacccgttgaaggtcttagttagttggcatggagcagacactagtacccagtctttggtctcttgtttctatgcctatgatcattattcaatggtcctgtgcctaagctagaaatcttttgattgcgagtgatggagaacccaacccaatttgacttgaataagtaaaggaatttattggctcttacaagtgtaaagtccagaggtttcagttgaggcatggtccaacagctcaacattttcactgagcacctagtttccttttgtctaatctctgcccaatattgttcatagttccaagatgttcaccaagaggtccctgagctgtgtgctttctcatttacatccagcaggaaagaaagaaggtttttgttctagaattccaagcaaaagtcctgggattcactctaattggatttgcttggtcatatgtccacccatggccaaccacatggctggggagccaaatgtgctggtctgggtcacatgttccacccctggagccccaggtagaatcagattccatagagccaaatggattcccaaactccaatgagggctgctaggaagaaaataacagaagctacagcatcaaccaacaaatgtctattacacattgtttggctaaatctccttctgttttttccatagcaagtttatgacttttatttttattttattttattttgaggtggagtctcgctctgtcacccaggctggagtgtagtggcacgatcttggctcactgcaagctccgcctcctgggttcacgccattctcctgcctcagcctcctgagtagctgggactactggtgcccgccaccacacccggccaattttttgtatttttagtagagatggggtttcaccatgttagccaggatggtctcgatctcctgatctcgtgatccgcctgcctcggcctcccaaagtgctgggattacaggcgtgagacaccgcacccggcctatgacttttattgttagatacaatgatgaagtggtttgtccacaagttttaaaaatatacagaaatcagaattgccatactcaccatggaaaaaagggagcacagctttaacaagaacattttaaagagaaagaaaagtaattagggtgaataaattcaaattttagacaaagtcagtcatggtgacatgtgcctgtagtcccagccagctacttgggaggccaaggtgggaggatccctggagcctaagagtttgagtccagcctgggcaacatgggaagaccttgtctcttaaaaaaaagaaaaaaagaaaagaaaaaattggtaaatgcagccaagtctttgtcactaaaatatattctaggcaacattcttcaaagccaagcaaagtctgtggctgctgtgtgctggggctatttcctctcaattcaatcatgggttggggtgatggttaataaccctgaaatttaaggtcttttgtcagtctggcatcaatgatgagtggtgtgacaaggcttggtgtatcactgataattgcttagaaatgactccacactacccagttttttggtgtatttttcagcagtattgcataagaaagtctttagcagccactggtacatgcttctgagaagcatttgaccacagaatatcttagattcaaaacacattgctttgtgggaagaaaggcaccacccagcacacacacccatcctaattttgaatggacttaatttctgaattctagacactgcctcacaatgatataaaaacaacaagagcctcattaaaaccccagaggctgagcccacaaacaggaattcatagagtctctaagagaaagatatctgggcaacatttctaaattttgagctgtctggctggttgagacagatgatctgatggcaagaatgatttgcaaaaaattcaacactgaccaatcagagcagacagtctaaataaacatcgattcttacaaggctaccttccttaccagttaaatatcagtcctgcctcagagaaacataagatctaaagaggaaaatctacacaagattgtgtgtgggccagaaaggccgccgtgaatggtgagaaggtgagtcaatccatccatcctaagtcaaagaatccaaccagttccatggaggaggcacagaggaaaagaggaaggaacaaagtggaagaagaagagaatgaagaggtgggaagagatgggcaaggatgggagagcagaagccaatcaagagaagaaggaaaagcaaacagaagagagtagaaaggaatgggggccagaaacaagcaggaatcatgaagagtggggaaaggagagactttggaaattcaaacaagtagaggagtgaaaaaaatagtgatgaaaggtaagaaaggtaaggtaggagatgtgtgaaattgcaataagaaaaatggcagtgtttatgcgtgatcattgagtcttacttgcattacacttgcattacacttacactgtgtaatgcagggctcagaaaactttttctctaaccagtcacatggtaaatagtttaagttttgtgggtggtgcagtctttgctcagctactcagctctggtggtgtagcatgaagacagccatagacaataagtaaacaagtgggtgtggctgtgttccaggaagactacgaataccagtgatgggtcagacttggcccatgggtcatagtttgctgaatcctggtataatataaatcttctgcaga

SEQ ID NO: 1231 - DNA, 49935 bp, Homo sapiens
ctccaactcctgggctcaagcaatcctccagcattggcctcccaaagtgctaggattacaggcatgagccaccacgctgggccagactaatttttctttatgtgtaaagaaaccatctttatttgtagattaagtcctgctggttttgaattctaagtgctacatatttgtacactctgcaccacactgatgtcacttctgcctctaactagtctttaagctcatcctcttgctccactccagtcaacatggaagccagcatgatccttctaaaacacaagctagtctctccctaagcctccttatcccctgtgagaaggtgtcaaagttctttactatgatttgcaaggtcctctgtgaacaggaccctgctcactctgcctcacctctccccatcctcacttcatcctttatcctctggccttgtgatgctaggaataatgacccccaaaggtaaccaagtcttaattcctggaacctatgaagcattaccctacattgcaaaaggcaccttgcaggtataattaaggatcttgagatagggaaattatcctgggttatttcagtgggccctaaatataatcacaagtatctttatcagagggagattagactacagaagaaaagaaggtcatctgaccagggagacagagactggagtgatgaggccacagcctaaggaatttggtcagctaccagaacctaaaagacacaaggaatgaattctattccctggagcctccagaaggaaccagccctgtcaataccttacatttattttttatttatttatttattttgagatggagtctcactctgtcacctgcactggagtgtagtggcacgatctcagctcactgcaaactctgcctcccaggttcaagcgattctcctgcctcagcctcccgagtagctgggattacaggtgcctgccaccacgcccagctaattttttgtatttttagcagagatggggttttgccatgttggccaggctggtctcgaactcctgacctcaactgatccaccaacctcggcctcccaaagtgttgggattacaggtgtgagccactgggccccgccaccaataccttaaatttagctgtgtaagattcacttcagatttctggcctccagaactgtatgaaaatgtatttctgtagttttaaaccactatgtttgtggaaactgttttcaggagcaatagaaaactaagataagccttgtcagatgacaatggttccagaatacatcctgctggtctttcgtctgaggctgttgggttgttctcccctttcttggtgatgcccctgtacaccctttgcctaacatatttctacccctttgttttaatcaatttaggcttctcccacaaattaccacagacggactggtttcagcaacaaaaatttctttctcatggttctggaggctgggaagcctgagaacaggcgccagcattgttgggttctggtgagggccctcttcctggttcaaagatggccagtttctcattgtgtactcacatggtggagagtggagaaaagaagcaaattctctcctgtctcttcttatatggacactaatgctattcatgagggctctaccctcacggcccaattacctaccaaaggctccatctccaaataccaccacattggggattagggtttcaacatatgaatttgggaggaacaaatgttcagtccacagcaccccttccttaaggttcacttcagtatcaccacctgctttcctagttgccccaggctgggtgaggacctccactcaggtttagcatcagacctgagcttttccttaccactgaattcaccacaaggtactgtcatggtgtgtgtttgactctccaaacaggcccccagggtgagccccagggtgggggcagaaatcaagaactgttcttcctagagtcctctctgtgtaatgtctagcacaaggacgagcacataagagtcttcgataaatatttattgtctgggtgtagtggcttacacctgtaatcccagcaatttgggaggctgaggtgggaggatcgcttgagcccaggaggttgaggctacagtaagctctgatcgtgccactgcgctctggcctgggtgacaaagaccctaaaaaaataataaataaataaataaataaataaatattgattgattgaatgaatgaatgaatggttaaagcttcttaacctcctggacgcaggtggctctcatgtccattgcagttcctctgtctcttcttatagcttatcatctgatccttgtacctgcgactgagccctaagaaatctccaagtcaaacattagccaggatcagatttgatagctgggctgtccactcaggatactgcaaaataaatactacacggaacaagcagaatactaaacaaaggacaaaatatttgaattttttttttttggtgaaaattagagctttgaatgcagaatgtggtaatgcctgattcttttttaacatgccattccttgatcttctcaagctagcccctgtagtactggcagctcaacgacctccctggtgattcattatgctctacaactaaactctaattattctcaaaatattatatggtttagttgccaataatgctgattattgaaattcttagagctagccatgtgcaattaaccaactgatacacttgaaatgggattataggcctccattcactacctaataaagtattaaaccaaagctataaatgtaagattattttacagattgtttctctacgggaatttttacctgatgacagcaaaatgattttcctctttgtcagacaagacaggctatcgtcttctccaaggtctatagattcagggagaaatgagagtgactttactgatgaaagatttaaaaccagaaacagaaaagaaaaatgcaccagagcaaagcaataaggaattataaactaactttaattacatcaacaggaagaatttcaaactatgttgtaattcttattttaaagtttaaatctaattaatatattctgactaacataatcatccaaagataaaagtatttgtgatggcaaatggacagaacaatcatttaggtagcatctaggaatattgctacaattactttacataaatagaaatccacgtctttattagtaatgtgccacacatcttagagtaaaaatttacataagataggcttataaatatacataaatctcaaaattaatcacaaacattaggtacacaattgttataaaacaaatataacctatcaatgtctatgtaaaggcatagtttttacaaaatagtattttgtagacagtctcaaaaaagtatattaatactcctggagccagattgttccagcatatcagcatgtctgtggaaataaggcatccggagaagctgcattcactcttccccatggccagggccttctatgtgatgaaacaggtaggattctagtgacctgggtgaatgctacacccactgcagcaccccattaccttagagaatcaattactctccagaagaatccaaccaaatggctatcagcctaatagcaaatatccaggggaaaactgaacacattaatcaagcagcagtgtgttttatgttaaaaatcccaaatagcttgatgaatccattacattttgagttgccagacatacttaaaatcacactagcctagccactattttcatgaagaggaacttatatgcaagtcttttattaaatataaaaacaaagaaatctaccttgaaactaaataactggatacttgaataactgaataaggaacctaattaaatacaaaacctgtataggttgcatcaacatgccagttactcagctaacactagtcttggtttcttaactaacagtatagaaaagtcacattcaacagtggtactttatatgttcttaacaattcatataatgttgaatggaggaggaaaggcttagtaaaacatccaggaatcctttctacaaactacattgctataaactcaagcatagttttgcctgtaatatgcataatgttctacctcttgggttttaaagtaggcaagagatcagaaacagaaacaaccttgacaaagaccttcaaatgctcatggtgtgtatattcaggcctttgtgtataaacacacaccatcatgtatgtacaaatatacacatgctcctcaagttacaagagggttatgtctcagtaaacccatcaattgtaagttgaaaatatcataagtcaaaacaattatgggacataaccccattgtaagttgtaggaatgtatcaaatgtatatcactttcatatcatcgtaagtttgaaaactcttaagttgaaccatccaaattcggggatcgtctgtgtatataaacacatggagaaccacctaactgttcactaaacataaccaattccgtttagagaacaaggacatacaattatacacggcagcaaagtatacacatcccagcctttggcctagtgcagtggttctcaaacatttttccattatggtacataaggtagatgccacatcacatgtgtaaaacactcccatggtgcagcagattttgatacaacttttattttattttattttattttatttatttattttttagacggagtcttgctctgttacccaggctggagtgcagaggggcaatctcggctcattgaaagctccacctcccgggttcacgccattctcttgcctcagcctcctgagtagctgggactacaggctcccgccaccacgcccagctaattttttttgtatttttagtagagatggggtttcaccgtgtcagccaggatggtctcgatctcctgatctcgtgatccgcccacctcggcctcccgaagtgctgggattacaggcttgagccaccgcgcccggccgatacaactttttaaaacatctctaggttaatgaattactctgaaacactgaaatccttaccatgaagagcagttcagcgcaatggttgtccatgatcaccacagttacttaagacaaaactgctgcttagccggctctgtactttactgccaccacttttgcatcaattccagaaaatatattagaatgcaagagcatgagatgccctgtgccatttatttataaaaataaatcaacaataatttattttaaaagcaaattattcactaactttgatattcttacaactaaccagtaataatatgttactggcagtatcctttacaactaatcatgatatattggtgtgtccctatctaagaacaagggtgggaaagccacagtccataagcaaaccccgcctgcttcctgtttttgtgcagcctgcaagctaagaatggtctttggatttttttaatggctttctgaaaaaaatcaaaaggaaaacatttgtgacatttgaaaagtacatgaaattcaaagttcagtgtcaattaagttttattggaacatagccatgctcattcatttatgtattgtttatagcagagccaaacagagactgaaaagccaaaaaactactatctgacccttaacagagaaagtttgctgacccctggagtagagataagaatgacacacaacctcagtggtcacgtctcttatgcacaaaatcctgaatatagacagtaaacttaattccagaaatagtagtaaataccatctaggatggaaatccattcctgagttgtccaaactttctgatttctttaatgacaaaagccaacttaattaaatacagcttctgcattctatctgaaatcatgtttatatattcaccttttgactcagcggagcaataaaaaaagcactgggctccaagttagaagacctaggttttaggcaatttcttttaaattgttacattgttaaaaatgtatttaagtcttgtttgatctgtgtattaaacctattaaaagaactaaaatgactggtaaaataaagaatcaaaatgcttttaagcagaaaagaaagttgatatagagtaaaacatgctcctttcctctaaatataactataaaaagtcctccaattaattgtaaattactaaatgggggaaaaaaggcacctagctaattggagtatggatagtgggttccatttaataaaagttttaatggatgtgcacgaaggtgcatgaatgtgtaggaaatcatatcacctccttaggcttcagctgcacctctgtaaaataagagcattggattaaatggtctctaaagtcctggccagcactggtaatttatgtcaagtgaccagcctcagttttttcatctgtaaaattggataaataatagaatctacttcctatggttgcggtgaggattaaatgagttaattcatgtaaagtgcttagaacagcactaaatatatttcactagcattattattaatctattcaggtactttacgaaaaacactggttgggcatctcctctgtgacaagtagtatattagaaaatgggaatacagacataaaatagaagttgattctcttatatttaagtagggatgaatgaaactgaagtttttggaattatcacttcagcatgtctatcgactgctagttctctgagataatggtcaaaggccattctgtatcactggtgtgaattcttatttctgaaaaatgattactgttagtactgttactaaggatgtttctatttatgtttcaaaagacaaagttcagtgtttgctaacataattatttatggtttgagcataggaggaagaatataaaaatgttggccagtctcccaatatacatgaaatgcaagccttctgaaccaaacaaacttgccatagaagtatagtttcacatatagattcattccacaaatgtttgctgagtacctgatatggataaatatctgctacaatgatgagtaatggtctctgcattagggagataacaaggaggacaagccagcaattctagaaaagtataacgagcatgttgatgaggaagcccaatgtgctatgggagcatttgatgggggcctggacctatgtagtccagagatttggaggaaaaaatatttaagttgtgacctgataggtgaataggagttcatcaagcacaagaggtggagaatatgaacaaaatgagaggtgagatagagcaggtctgaagaactgagagcctctcagtcttgctaagacatagcaagtgaggaggagtggcaaaagatgatattgcaggtcacagaaatggcttgcattttaccttaatggcactgagaagtcattgaaagttctaagcataaataagcaaaatcggtaatcaaatgagaaatcactagtgaaataattagcttgattagaaatgtaagcggaaggaagctgcattcacttcttccttccctgcctgctactaagctgaagtctctcttttgttttaacctgtttgtagctcaaatattatacacataagagagagaaatataaaaatatttgcttcttatttacaacatggctgcctgcatatcagtatcttcactactaaacagccactagagctgagaagatgagacacaggccagacttagccatgcccagagtggagtcaaggacttgaaccaggggacttgagtttgaatcctacccagttccattatgcacttgatgtcatttaatttctccccatctgcaatgaacagaatttctcctccatccctccttggaagcttttggtaactgtgtttgttgatgttttccttattttggttcaactccaggagaatgtgaaagctctccccacaggcagactttcacctgtgacatgaatctggagggtggtattagaaatcacaatcaccagtgttgctcaatcataaagcccacgaagttggaaccagctttaaagcaacaagggcaagccagagaactctagaatgccagagtggaaatgtctcagcagcactaactatacctgcagacttctctcctcaaaatgggcagttagcacagacatttggaacaaagaacaaaggagtcctttggggcgcctaatgtcaaggcattactatgaattatgctgactacctgtctagtttataagtctgaacattttattttacttatttttttgagacagggtctccctctgtcacccaggctggagtgcaagtggcacaattttggctcactgcaagctctgcctccaaggttcaagtgattctcgtgcctcagcctcccaagtggctgggattacaggcatgtgccaccacacccggctaatttttgtatttttagtggagacaaggttttgccatgttggccagactggtctcgaactcctgacctcaggtgatccgcctgccttggcctcccaaagtgctgggattacaggtgtgagccaccgcgctcagccacaagtctgaacatttaaatggatattctaggtgaattcactttatgggtcattttcccattttcaattattttttaaaaagccacctcataaaaaaaattctactcaaaatctctacagtctcaaaaactgttggcttattattaaaatgccctaaatttttactaagatgttttgtctgatataacacatttttaggccaggcacggtggctcacacctgtaatcctagcactctgggaggccaaagcaggtggatcacctgaggtcaggagttcgagaccagcctgactaaaatggtgaaactccatctctactaaaaatacaaaaaaattagccaggcatagtggcacatgcctgtaatcccatctactcaggaggctgaggcaggagaatcacttgaacctgggaggcggaggttgcagtgaagctgagatcacaccattgtactccagcctgggcgacaagagggaaaattcatcgcaaaaaaaaaaaaaaatacatttttaatcacacttaaggtatgctggctctgacaagagaattcactgtaaccacagatgaataccttagttttataaaattcagtggtagaaaagttcaaattctaactgctaagaattccctttttttttttttttaatatcattaacacaactttacatcttcaggaatgctcacagtttggtctccaacctttgcaaatagcagtaaaaatgttttcccatagctgctctctaactgagaagaaatttcaaataaatattatttatttagttagttatttttgagacagagtctggctctgtcacctaggctggagtgcactggcacaatctcggctcactgcaacctccgcctcctgggttccagcaattctcctgcctcagcctcccgaatagctgggattataggtgtgcaccaccacgcctggctcatttttgtactttttaatagagacgggggtttcaccacattggccaggctggtctcgaactcctgacctcaggtgacctgcccgtcttggcctcctaaagtgctgggatcacaggcgtgagccaccatgctcggccaaaatttcaaataaatatgaactattttcatatcattgtattttcctccaatctccccattggctgtgtaaatatccaaaagcacttctgctttacggaaatttgaaatttcttctgcccaaaaggctgactgtgaacttatgacattcagtaaagttctccctagtaatattcaaaataactctctgtgctatagcactcatagtaaagactgttttgagacatgatttctatacttagttccttctctgcctttctatttgtcatttctagccaaagttatatggtatgtggatcataaaaaggcagtctttttgggtctcaaatcccattcaggaagatggcaatcacaattttcatcaatccaactcagagatgttgtgaagttaaataagaaaacatatgtgaaagtgcttagaaaaggtgtaagtatgttccaaaagtatagggtcattattaaacaatcttctttgactacaaaagaagcttgttctttcttccaaaaagctgaaattatatgaggttttttttcttaaataattgaagctaaaattatactggatattctttaaaaaatatatttatactaaagacttcccaatccatgtaatctgttggccctgcagctgtggttagggggttcccatcaataggtagaaggtcagagcaacaatcagaagcaaacaaaatggagatgagaaggtttgataggcagctgatggcataaaaatgtcttcatacttgtaaatactgacaacacgctctgaagccggcggtgagtctatatcatgtcgagtgatagagcctttaagaaaaaaagagaagagcaggggcaattgaaaaaagaacagatttataatggtataggcaaacaatggaaaaatcaaaagtctatttagtgttgaatacgtaagcagtggttacaaagatctggattcaggtatttgagttatcagaattctctatcattgtacatataataaagaacatagaaattagttaaatttatccaaaaagactagttcttattaatctgcactcccccatcagaacaatgctgttgatctgtttcctgccatctcaattttaaaactactagttacataattttgtgtgattattgtatgattgcctcctaaaacggctctatgagttttgtcttattaatacccaaatgggcaaactatatttttatttcaaacagcagagactactaactttttccctcaaatctatcttgtatatatatggatcatcaacaactcctgacaacactactaacgtctcccttacagatggaagccctcctctactgtctgtgggacacttagtagcctgcccaggccatgccagagggagtgtggtatactggatgtgtgtctgtgtgtgtctgtgtgtctggcagattagggtagaatggtatagaaagtgggatgattaaagtaccaaactagtctttggatgggaaactttcttttaattttgttacaagtggaaagaagtacagactgtgtgtaaaatatatttaataatcttcagttgattaaaagtgtctgacctcctgaataatccatttgaaacttgggttagggagactaaggcatatacattcagtgcaaaggtctccttaggaatagggctcagagtgagggtttttaaggtcctatctgctagggaagccctgccaaacttgacatgtcaggtccctgcttagtgtccgtgctggccccagttagcaaaaatcaaacttctcaggtttgtatgcctgtagtttcagacacttgggaggctgaggtgggaggatcacttaaacctgggaggtggaggctgcagtgagctgtgattgtttcactgcactccagactgggtaacagagcagacttttctctcaatagatcccagtcacctctcctacctaacctcagctcactggtcacctgcaagggctgctcaacttaactatgcgcctacagttcatgccttctttgagtgaaatccaacctcatacccctttcaagccttagttcaaagttttcccccttacagggaccttaggagaataggtaggatataatcaattaaaagggcattcaggaggccgggtgtggtggctcatgcctgtaatcccagcactttgggaggctgaggtgggcggatcacaagatcaggagtttgagaccagcctggcaaacatggtgacacagcgtctctactaaaaatacaaaagttatctgggtgtggtggtgggcatctgtaatcccagctactcgggaggctgaggcaggagaactgcttgaacctgggaggctgaggttgcagtgagccaagatcgcgccattgcactccagcctgggcgacagagtgagactccgtttaaaaaaaaataaaaataaaaacataaaaaaaatagaagggcattcaggaaacaagaaaagcagaagccagtatatggggtaggaatgtgcctgttttgcttagagttagtgagaagaacagaagttttgagagagcttatcaggtaaagcaggaccagatttggagaaggctttgaactttaggctagtctgccatatatgtaaaaagatgaccttctgaaaatacagctttttccaattggtaaagcaatttcaaatacttgttttcacttaatccttacaatatttccatggaataggaagtattattatccccactttagatataaggaaatgaaattcagaaattaaataataggctaaatattatacagctaccaaggggcagaaccaatactcaaactcaaatttttagacttcaaatcccactattttagattactccatttctccaggctgagatataatttatttcccagggtaccgaaagtaattgaagttataactgcagagccactgttggtaatctgggaaattagcaaatggaaaaggtgtcaccaatctggagacagtcaagtgtcttcccaattggcaacaggcaaaataaaaggtagattatgtcatctctgggctgattggtggaaacgaattgaaggaaaaaaacaaccagatcagattaggcagcaaatagttgatgagcacacagtaaagaaagatgcaattaccaggagccagaatgaattctcagtgcaaggactgcaaaccacactcacttccattcttgagcaggcccttaggctaatcaaccagaaggaatgctcaagactcagtgtaacttgattttagcagtctctaaaaggtctcatgatatccttgggtctttgctgggcaaatgctgcagagacttgccacccaaaatgaggtcatcaatgaaccagcatgaccagggagcttattagaaatgcagaatcttgccaggcatggtagctcacacctgtaatcccagcacttagggaggccaaagctggtggatcggttgagcccaggagttcaagaccagcctgggcaatatggtgaaaccctgtctctactaaaaatacaaaaaagttagccaggcatagtggcgcatgactgtagtcccagctacttgggagcctgaggtgggagggtcacttaaacctgggaggtggaggctgcagtgagctctgattgtttcattgcactccagcctgggtgacagagcaagaccctgggagaggagggaaggggaggggagaccagtagaggggaggagagaggggaagacctacagaaaactgcactttaacaatatagccaggtaattcctatacacataaatatttaaggagtaatgggttaaactatgggataatttggtagatttgtgactaacagaatagtcacaaagtgggccctaatgaaatgcttggtgtcaatctctggagaagtctccagaagcccttcctgttcagtactttttattatttctttcttcttcttttttttttttgaatggagacagggtctcactatagtgcccaggctggtcttgaactcctgggctcaaaccatcctcccaaagtgctgggattacaggcatgagccaccacgtctggcccccgttcagtctttttatatttacagcataggagttaagagtattcatgggctttggggtcagacagacttaggattgaattttaattcttctactaattagttgtatagccttgaccaagtttcttaatctctctaaaatcaggacaataatacctatacctctcaaggacatggtgaggagtaaataagaatgctgtgagaattgaacagagccctacatacagcagatacatgatctgtttcattaagcacatcactcatgacatactatcttgtactgctgtagctttgcatgtgtgtaactgttcatttgtttgtccgtataataagtccattataataagtccattataaccttctgaaggtaggagtcgcatctccttttcctttaaatgatccagagtgcttatcgctctcttgtgcacacagtgtgacttcaattaacaatgaacacaagcacagtggtgtctggcgtttaatccagatgctgaaatgtaagcttaccctgaatggctggaccccaagcaaacagataataccaactcaaatgcagatcaacaattgtttcatctctgggaacattcacagggcgtttaaatctgcaggtgacgcgattgttctcaaaaactccttcttcatctctggcagggtttctctgaatctcctttgcccactggcctacattatagaagtgctgtatgcggaccctgccattgtcatcatggacgcaggccatgacatcatcaccaccctaacatgagaaatgattgagaaaaaaaaaagtcaaaggttcatcttttgcacactggtcactagaaatatacattccatcatctctgcaatttgaaatcccaccaaaaaaattcttttaagtgccattaaaaagtctcaaccaggagaccaaagttaccatcacaataagtgacattcagtgcctcctgactgatgtttggagaagacattaccacctatgtggtaatcctgcccaaaacacaaaccaacctaatcaagaaaaaacaatcagacaaactcaaactgaaggtcattctacaaaaaaaattaaaaaaatacctagcctataatcttcaaggagtcagtgtcataaaagaccaaaaaaagaaaaaaaaaaaaaaggctaagaaactatttcaaaatatacatgacaacaaaatgcagttctaggtgttcctacatagaaatttgggctataaacccaaaatttccctaaggacagtattgggacaagtagcaacatatgaaaacaaacaatatatttaataataccatcatatcaatgttaaacttcctgaatttaataaactatataataaaagagaacattcttgattttaggagataacctacttaagtatttagggttaaaggattatgatatttgctatttaaatgccaaaattccagaaaataacaatcaaaaaaataataatcagtagtagtagcagtagcagtagcagtagcagcaagcagtacagagaataaagcatgtgtggctaatgtcattatttatgaaaaagttctggaactagggagtagtgatggttgcagaacactgaatgtggttgataccactgcattgacactttaaaatcataaattttggtgctactgcactccagcccggatgacagagtgagaccctttctcaaaaaaataaaataaaatggtcaattctggccaggtgtggtgactagtgcctgtcatcccaacaatgtgggaagtcaagacaggaggatcatttgagcccagaagttcaagaccagtctaggcaatacagtgagacactatctctacaaaaaattaaaaaattagctgggcatggggctcatgcctgtagtcctagctactcaggaggctgaggtaggaggatcgctggggaggttgaggctgcagtgagtcttgtttgtgccactgcactgcagcttgggcaatagggtgagaccctgtctcaaaaaataaaaataaaaaaaaaaatacacaacaacaaaaaataaaatggttaattttgttatgtgcgttttaccacaataaaaaagttattattttgttaatctaagtagctgtagtcccagctacttgggagcctgaggtgggagggtcacttaaacctttactatccttcctgcttgcctacagtttacatttttttcaaaacaagtttaaaaaagttaaaagagtttggtcgggtgtgatggctcacgcctataatcccagcactgtggaaagctgaggcagaccacttgaggtcaggagttcaagaccagcctggccaacatggtgaaacctcgtctctacttaaaatacaaaaattagctaggtgtggtggcaggtgcctgtaatcccagctacttgggaggctgaggcaggagagtcgcttgaacctgagaggtggaggctgcagtgagccgaaatagtgccactgaactccaagcctgggcaatacagtaagactccatcacaaaaaaataaaaagttacaaaaaaaagtgttaatcagttgtaatgcatgtaccatcctgtgcaggatgttgataatgggggaggctccccagggggtatatgggaaatctgtaccttcggctccatttcactgtgaacctaaaactgctgtaaaacgtaaagtctaattaaaacacacacacacgcacacaataatgcaccttttttttttttttttccccgacagagtctcactgttgctcaggctggagtgcagtggcgcgatctcggctcactgcaacctccgcctctcgggttcaagcaattctcctgcctcagcctcccgagtggctgggactacaggcacccgccaccatgcccagctaatttttgtatttttagtagagacagggcttcactatgttggccaggctggtctcaaactcctgacctcaggggatccgcctgcctcggcctcccaaagttctgggattgtgagccactgcgcccggctaataatgtaccatttttaaaaagttaaacgcttttaaaaaggggttccattttgtttttcctatacattaggttctcaaaaaaaattaatctgtgctttttcttggaataatacaagaaaaaaagagacctctactttcacagataatatgacagtagatactttataggcctttagataccaaaatatcaaacaaaatttgaatgctcctcactctgcctcactcccctaatcttaacagccctaccacgagtgcaaatgcatttaggacaggaagtggtcactttcaatgcaagccagcttctgggtgtggcatgccctgctgtttctcctgctgcctctagggcaggagataagtagactaatatctatccatgcagtcttaccagtggtacccattgtcttactacttggactggaactcattgaaggctattctcctggtgacctctccaagaataaagccaccagaccagccactgcttagactgcttatcagtcttttcctacgacacacctacaacccatatatccaatccacttgcaaatcctgtcagtcagtgctactttttttctttttttgagacagtctcgctctgttgctcagggtggagtgcaatggcgccatctcagctcactgcaacctctgcctcctaagcaattctcatgcctctgccttctgagtagctgggattacaggcacctgccaccatacccggctaagttttgtgtttttagtagagacagggtttcaccatgttggccaggctggtctcgaactcccgacctcaagcaatccacctgcttcagcctcccaaagtgctgggattataggtgtgagccaccatgcccagccagttagtgctattttctttttctttttcttttttttgagacggagtttcattctcgttgcccaggctggagtacaatggcacgatctcagctcgctgcaacctccgcctcctgggttcaagcgattctcccgcctcagcctctcgagtagctgggattacaggcgcccgccaccacacccagctaattttttgtatttttagtagagacggggtttcactatgttggccaggctgttctcgaactcctgacctcaggcgatccacctgccttggcctcagttagtgctactttcaaaacattcaaaatctgagccctcagcactgtcactgctggaactttggtctgagccgccctcctctctcccctgtagccccacacaagcctcagaataggccaggtgaagagaagggcggggtgctctaggcagaaacagccacaagggcaaaagcacagaggactgagaaagtctcatagtttgggaacaagcctggcccagtgaagtggcaaaagaatggggctccagaggaaagagagaaaaacgcagcaaggcacagggaagagcaggggccagtgatgacagctgcctgtgcacctgaggccccgcctgtgcctggccacagtcctgtctgaggtccagaggttttcttgcccctgggtacagaggaagataaaactgttgaaacaaattcgtaacttccctgatgtaatccaacatgccttttataatgaagcctccacaaatattcaaaaagaggccaggcacggaagtgcctgtaatcccggcaatttgggaggctggggtgggcagattgcttgaggccaggagttcgagaccagcctggccaacgtgtgaaaccccatctctactaaaattacaaaaattagctgggtgttttttgtattacaggtgggattacacctgtaatctcagctatgttgggagcccgaggcagaaaaatcaaacttgaacccaggaggcaaaggttgcagtgagccgacatcatgccattgcactccagcctgggcaacagagcgagactctgtctaaaaaataaaaaaaacccaaaaggacagggttcggatgagcttctggattgctgaacagatggaggtgcctgaagggtagcacacccaacagggtgttgaagctcctcactcccttccccatgccttcccctaagtgtctcttccatctaactgttcatctgtatccttcaaaatagccttcataataaatgagtaaagtaggtgggatacggtggctcatgcctgtaatcccaggactctgagaggtcgaggtgggtggatcatctgaggtcaggagtttgagaacagcctggccaacacggtgaaacctcgtctctactaaaaatacaaaaaattagcagggcgtggtggcaggtgcccgtaatcccagctacttgggatgctgaggcaggagaatcgcttgaacctgggaggtgcaggctgcaatgagccaaggtcacaccattgcactccagcctgggcaacaagagcgaaactctatctcaacaaacaaacaaacaaacaaataaattaaataaataaataaataaatgagtaaagtgtttctctgagttctgtgagccactccaggagattaactgaacagaagagggtggtggcaccccagatttatagctggctggtcagaaatacaggtcacaacctggggcttgtgacgggtgtctgaaatgggggcagtcttgtggttttgaacccttaacctgtgggatctaatgctatctccaggtaggtagtgtcagaaacaaagtgaattagaggacacctagctgtccactggagaaatgcttggggtgtgggggaacacccccacacatctggtcacagaagtattctttctgtagtgagaatatgagtagagacggaaaaaagttgtttttccctcttataagtggttctttcacttctgcctctgccatgaaaaaaatatgccttggatgactagtgaaaacacagagaaaacctgaatccaactcatggacaggcgtcaagtccagatgaaccccacctaaaatgagctgcaccccagtcaatccatgaacatgtgagcaagcaataaatgctcattgttataagccatataaggcttataacatgggggcctcttcttgcagccttactgtggaaacagctgatgaaaagaggtgccacaagacagcttggattctgatagccaaccctttcatttaagctagcctgaattttttttaacttgcaatcagagagccataactaatttgatcattatactgctttgatcaattaacttgcttctaaaatcaaaatagcacagccaactaaagagaaaaaatcagcttctatcatgttttgcatcttaccattttcttgtctgaagagaatccaactgctacccaaccatctgtgtctgcactcagctcaaattctacatcagcccctatcatccggtagctgaggaaatagtcacaggtctctgcattacagcctggtttgccatatctagaagagatatcgaaagagactttactgcttctacttacacaaaagacattaagagagcatctaccatgtatcatgtgggatgctaagcaatattattaaacacattggatttttgctacctggaatcttaaaaacacagtttcactctcttaggaggaaccttagagatgatctgccccactttgtacacaagaactgcagtcctgagatgggaaggggcttgcccgaggttgtatagtgaagtcagcggttgcaacaggacttgaatctgggtatctaaactcccagccagtgttctctacattatattagtattagagtcttttacatgttagttactactgaattatttctgaatcccttttaatggaaaaagattctccaagttaaccatttaaattgtttctgttaattaaatgtataccaactctttttaacttacaaattttcatataatcaaactaacacaaatttacaaattcaatataaattaaactaataaaccaggaacattgaaattcacagcactcatgcaacagataatggggctttactgaaagtaaatttctgcttatgtgcatgtggtatccgattagatcgtgcagggtctttggagttgagagcatgttcttactactctctatagcatgatggctcaactcttcacttttatctgtttgaactgctgcaaaatccttatttatgcgatacaccaaatgaatacccccatctggtactcatgaaccatgaatgaatgcaatatttatttacaatttttttttctttttttttttttgagacagtctcactctgttgcccaggctggagtgcaatggcgggatcttggctcactgcaacctccacctcttgggttcaagcagttctcctgcctcagcctcccaagtagttgggactacaggcatgggtcaccacacctggctaatttttgtatttttagtagagacgggatttcaccttgttggccaggctgatcttgaactcctgacctcaggtgatccacccacctcagcctcccaaagtgctgggattacagtcaagccactgtgcttggccttatttataaaatttgcctttgttctgttgggctacttgctgctaatataattacaaattcagacactaaaacatacaacaatataaggtgattatccagatagtgagattatgcagacattcatgtttttttgagagcaccactgaaatgaaaacacaaatttaaattttcttacagagcacttgtggatcctttcagaactggcaagccctggtttgaggaacactgtattacaccatttgcagaatggtagaaagttgaagcaatgggtgggacaatatacgcgcagatggaaggtatctaaaggaacagggcacaggggtgctaagtgttgaggaggggacagaaatgtactactatgctggcagaaatacccgagcagtcaggaagagatataataggatcaaggcaacagggcactggggtgaaaaagatgaaaaggagcaagggaagttaaaaaaaggagtaaatggacaagaaaacaagtcactttgaagccagtagagtactaaaattccctcccttctcaaaatatcccccaatcaccaggtttatacattgctgaccatcttcctcaataagaacatttttggctatttttattcattccttagaagtggccttgtaatccaaagaaagctcaaagcccctgtattcaatttttccttcttagaccttaagtactgaacaacagcaaaatcagaaccttcagtacagtgaccatcaaaactttgcccctgaccatcaaattattcaggggcaatttgttttaggaagtaaagggttcaaaggaggaggctttcccaaagaagctgagctgtctagatgggaggcccattgtccacatgactgttttctagcccagcccgtcatgtcgtgatactactaataatcatgtagagactcaccatgcctgagataacaagctagcaacaatgaatgcttaatgactagttagaatcatacagatatccataggtcaggactatttactaaaaaaggaattgggtactaaacatgtctatcattgcctgtcctgcccacagcccctgctgaataagcacagacacgttctgtgtcacatgagtcttctgcatatcagcaattggtgagtaggagacacctggagcaatggtggtacagctagaaaagaaccatggaagaatggtcccgggcccaggacatactaaagttaaaaggcctttaagactgaaaagcgggatggccgttacgaaacttcataaccctgctgaggtgatcaaggagctcaggccccctgattagaaggaactgcatgcaatttaaatactaccctgagaagtaaatcagtcttagccttaaagttatccaacctgcagttccaccaacctaaagcatcccttagtttttccacagtcgtccactttgattttggcaaatggatccacaggaggagcagtagggaaggggtaacctgggcagtgagaataaagaagggttagaaaatccagtaacaactgttccaatgagaatttttaaaaatgtgttgactgttttttctcacacatatcgagaaatgtttggggactcagaaaatggctttgatgaaggctaatcatccccttcatgggggagggtgtaggacacacacctttggacctaatcttgcatgtgaactgagagtaggtgtgtccttttctcactttacaggagaggaacctggggcactgagagaggcacaatttcatataaccacgggcttaccgctgtcccctgggagtttgagaatcacacgtttaatacaatatacatgttctaagagaaaaaagttaacagtgatacatttatatacttgatagtgggatttttccatttatatacttgataacaggatttttccattccattttcaacttccattttgcgttaacctgtaggtaacattttcttaggtcactaaattctttgtttttgttttttgttgtttttgagacagagtctccctctgttgcccaggttggagtgcagtggtgccatcctggctcactgcaacctgtctcctaggttcaagggattctcttgtctcagcctcccgagtagctgggattacaggcgccggccatcaaacccggctaatttttgtatttttagtagagacagggtttcaccatattgcctaggctggtctcgaattcctgacctcaagtgatccacagtcctcagcctcccaaagtgctagggttacaggtataagccaccgcacccaacttgtcgctaaattctttaaacacataatttctaacagttgtctatctttcttataagattacttaccaccataatgcatcaaaccatacaccataatgcatcaaaccataccatacccaacttgtcgctaaattctttaaacacataatttctaacagttgtctatctttcttataagattacttaccaccataatgcatcaaaccatacattgaagggtaaggctgcattatgcctccactttgtgagagaaatcttttctcctaggctgtttactccacgtacacaggaatcatgtgagacttatcttgtattctctgcccagcatagtgcttggcactggacactgaataaatgattgtcaaaggaataaataaaatcacccacagacattaggaaatgtaaatcagtacaaacttttaaaaatcattctattttatgagtttttttcttgttatttttaagttttttctttgggatttgtaatgctactttttttaaagtgaggctttgctaattttgtccattagatttattatactttaaaaaagccaccaggtcacacttttctggcacacttctgtgcactctgaatagtccatttttactatcctggaccttgatcacatcataaagtacaatcctaactttttaccaccaaagtagttggatcaaatgcattactttttctagttttatgcttattttatgctaagtcctatatctgcttcagtactagagaccagggatccccaatccctgggccactaaccagtaccagtccatggcctgttaggaactaagccgcacagcaggaggtgagtggcaggcaagcaagcgaagcttcacctgtatttatagccactccccatggcttgcataactgcctgagctccacctcctcttagatcagcagtggcattagattctcataggagtgcagtccctattgtgaactgcatatgtgaaggatgtaggttgtacgctccttatgagaatctaatgcctgatgatctgccactgtctcccatcacccccaaatgagaccttctagttgcaggaaaacaagctcagggctcccactgattctacattatggtgagttgtataattatttcattatatattacaatgtcataataatagaaataaagtgcacaataaatgtaatgtacttgaatcacccaaaaaccttccccttgacccagtccatggaaaaatcgtcttccactaaaccagtccttggtatcaaaaaggctggggttcactgctatagactgagtcctgacttgaacgagttttgtttttttctgaatagttattgagccactacaaactactgtatgttaagcagcttcatatatcttcttcctgttacttctcactacagtcctgaggccatttgtctcagaatatttatccaggaattcaatgattgttcacttacatgtttttgaaattctagagttcactgacaaagacaatctcttttaatgttgcatctgactcaggttccccatcttcttccattttcaaacatatcatcctcactacttcctggcatctagaataatacgttagcatacagcagatttccagctcaataaataccagttactattactactggattattatcactattttttttttgagacagagccttgctctgttgcccaggctggagtgaagtggcataatctcagctcactgtaacctctgcctcttgggttcaagcaattctcctgcctcagcctcctgagtagctgggattacaggcacccacgaccacgcccggctaatttttgtattttttgtagagacggggtttcaccatgttggtcaggctggtctcgaactgctgacctcgtgatccgcctgcctcagcctcccaaagtgctgggattacaggcatgagccactgcgcctggccctattaaattttgtaaactggcctgagaagtaataaccattgggtacgattgtctctttaagaacaacaagtttcagctgggcatggtggctcacacctgtaatcccagcactttgggaggccaaggtgggcagatcatgaggtcaggagatcgagaccatcctggctaacacagtgaaacccgtctctactaaaaaatacaaaaaattagctgggcgtggtggtgggcacctgtagtcccagctactcaggaggctgaggcaggagaatggcatgaacccgggaggtggagcgtgcagtgagccaagatcgcaccactgcactccagcctgggtgacagagagagactccatctcaaaaaaaaaaaaaaaaaaaaaaaaaaaaaaaaaaaaagaacaacaggtttctaaactccaaatgaaagcaaattttggaacaaagctagctcataaatgttctgaactagtttattcatgttggcaaatggcttctcaggacttttctagcactaattttctattatcatatatgcttctaaaacttgtaataggaacttgtgttctgtcaaatgcacttggacatgcctttaataacattttcctcttatattgcaaactgttgaaaaataaagaatttggcctttgtccctggtttctgggagacaaactctaaaaccttggaatttcccaagtaatgggagtgtttttgttcttcatgagccccttggattacacctgagtttatgctgagcaacgggatgactaagaatagaggctggtcactggaaaaaccatgtaattagaaggttggggctttgtgctagacctacctatagggagggttgtggggctggagattgagtttaaccatgtggccaaatgattaaatcaatcattccaacatagtgagaccccaataaaaactctggacactgcggcccagtgcagcttcctggttgaacacatcgatgtgctgggagggcaatgtgataatcccacgaggagaaggcatggaaactctgcctttgggagcctctcagacctcaccctatgtgtcttttcattgactgttcctgagttgtatcctttataataaaactgtcatagtaaaaatagcacttttttttccctgagttctgtgaaacattctagcaaataatagaagctgaagtgggaagcttcttctatcttgtgggaagaccccacatttatagccagttggtctgaggtgtggacaatcttattgtgaactgtgccctttcacttgtgggatctgcactaactctgggtcattagtgtaggaactgaattgcagtacaccagtcgggagttgatactggaatataagcagagcagaattagatttttttcctgaaattaaatgatctctatttgatataaaataagtttggaccatgtgccaatatttaagctcttgtctctcagctacaacccagccttctataggctgagtactctgcaaaccatttctcctttgccaggtgcttagactctgccaatagcaagcattagaggaaggcaggaggagggaaagaggactgttccttcctgtgtgattgctgttccaataagcaagttctcagcaactctacttcatcctggcagttggcctgagttcccagttcggtgctaggctcccagaaccaacctcatcccatgctgctctgaggcatcagcagcagctgagcacagcctcattctcaaaggatgggtcacagctctgcgaggtcctggtctgggacctttttataatctcaagcccttctctttgcaactccagccccaaggatggtaactttcctgaagttattttctgcatgctatcttggtactccctttttgcttctccagtcccgcaacttcttgcttagacaattccctgggctggtcttttgtttaaacagctagtatgatttccatctttcttactggaacttgattgatgcagactaaatggattaacctttcaatactgatacaatgtgtttgccaaaactgtagcttattagtacttatccgaaggctagaaaataaagacattcaataggatctatgttttacatgcattagacaattctaatgggaaattattttaattgtacaattctaagtaccctaggtacacagaattaaattggtatttcttgatttatggaacactcattatcagtctatacaaagccaatcttatatttttccaccaatccatcactaactccattttcttccccaccttagacacgaggtccagcatatttcatgcataaccttctcccaaggatggaagttttaacaaaaaatgaacactctgacacatacgtcttagaaaagcaatattttactatgataaactgaaaggacacattagcgataatggataacagacaatttggtggtggggtaaggttctcatctcagtccattctatgtagcatggaattctgcctgtccagggtaaagtcctgccaggttgcaaaaagtttttcatattcccaagattatcatcctgaaactcttgcatgattaccttacacgataattaccaaactgccttcagcagatcctggatctaaggttcaggttccaggcacaatttctcactctgccaacagcaccccttgccatgctgcccacagctccactgcattagcctgttcatggccaggcacaaagcctggaaatgcccaaacagagctgaccagtgagggcccactgaaacttaccattcacctctatgtttatttttacataggtgtgctcttaatatatcacttgtgtatgttttaatttgcataaatgacactgtgcagtacatctcattctgtttattatttccctttggaaatctatccacatatgtaagactgaatattattcagtcataaaaaatgaagtactgatacatgttacaacatggacgtaccttgattatataatctcatttacatgaaatgtctaggataaggctgggcacagtggctcatgcctgtaatcccagcactttaggaggctgaggcaggcagatcacttgaggtcaggagttcgagaccagcctggccaacatggtgaaaccctgtttctactaaaaatacaaaaataaaaaaagcacacctgtagtcctaactactcaagaggctgagacaggagaattgcttgaacctgggaggtggaggttgcagtgagctaaaattgcaccactgcactccagcctgggcgacagagcaagactccatctcaaaaaaaaaaaaaaaaagtccaggatacacaaatattgaatcagaaagattcgtggttgtctcgagctggggtggggaggagggagatgagggactgcagagtagtagctaaaggtataggatttctttgggggatgatgcaaatgttctaaaattgattgtggtgacagatgcacaaccctgtgaatatactaaaacccactgcattgcacattttaattgggtgaattgcatggtatgtgaattacatctcaataaaactgttgcagaaaaaaaatggatgcttgcatcccattccctcccttcacataacccagttctgactccagtgtcatgtacatgattcacagaatcaaaattgtatccagaactcaggattcccggtaataatctagcctccggatcaggggccggcacactagagagtctgggatagatgcagagggagttcattcaccgtatttgtcaaatttctcctttttaatttcatacacagtttatctgtattttcactctttcccttgattggtcatgccagaaatttgtgtatcttatgagagttttcaaaacaatccacattcagtttgggtcatcactcattttcacatgtgttttccatttcatttatttccacccagatctgttatttccttcctttttgtttccatttttaattgaatgcttagcttactttcttttttttgagatggagtctcactctgttgcccaggctggagtgcagtggcacgatctcgcctcactgcaacctccacctcccgggttcaagcgattctcctgcctcagcctcccgagtagctggaactacaggggtggaccaccacgcccggctaatttttttgtacttttagtagagacggggtttcaccatgttagccaggatggtctcaatcccctgacctcgtgatccgcccgcctcggcctcccaaagtgctgggattacaggcatgagccactgcacctggatgtttttttttttttttttgagacggggtcttgctgtctcacccaggctggagtgcactggcacgatgactgtaacctccacctccccggctcaggtgatcctcctacctcaccccgggactacaggcatgagccaccacacccagcaactttttttaaattttttgtagagacagggttttgccacgttgaccaggctgctctccaactcccaggctcaagctatctgcccctctcagccttccaaagtgcttaaattacagttgtaagccaccacgcccagcgtctaatctttcttattttctgataaatgtattcaaaactgtaaatttccctctaagctctcttttagattcacgccagatattttgacatgcagtgctttgatggtcattatatgcatatcttaattttctttatgatttttctccttaacatataggttaatattgtttttatttacagacataggtgattttttcccctaaacttttgttaatttcaaatcttacagcattgtaatcagaagacatctgtatgaggtagactgttttgtaatttgttgactttcttatattctggtatatggctgattttagtggatcttatgtgctcaaaaagagtatgattctgtatttgtgggttttacatatctatttaattgaacttatcattcatataattgaaactatctatatattttatttttattttttggagacagggcctcactgtgtcacccaggctagagtgcagtggcacaatcatggctcattgcagcctcaaattcctggactcaagccatcctcctgcctcagcaccctgagcagctgggaccacaggcaggtgccaccatgcctggctaatttttaaatttttttgtagggaatatgttgcccaggctggtctcaaactcctggtctcaaagctatcctcctgccttggtctccctatatcttttattttaaaaatgtgtttgatttttcaataccaagggtggtatgtccaattacaaatgttggtttatattttgctgtacaccatttccatcagttactgcttttatttggatactatactgttacaggtaaacattcctgattagtttcttctatcgatatacgacataatttgctccttatgttttatcttctatattttgtccgatgttactgtcatcttggttttcttatggttcatctttgcctaaaatatcattttccattccttcagaaatattttgtatagtacttatgcatatgtacgtgatcaaaactcttctgtaatgttcctttctcattgtgtccttgtctggttttgctaataaggttatgttatcctcataaacaagctggaaactattccttctttgagggtcctttgaaataatgtgtttaaggttagcatcagctgtcacttgagtgtctggtagaactgagcctggagctttcttggttggaagatttttttaactgattcaatttctttgatgggtaaaaaatttttcagtttttctaatttttcttgagtcagtttttggtaagttgcattttttttctaggaatttgtccatttaaattttcgagtgtattggcataaaactgttccttgtatttcttattagcttatctgctttcatttttagtaagctctaattcacataccgtaaaattcacctttttcaagtatacagatcagtgttttttaatatattcataaggttatgcaaccatcaccactatctaattcacaaacacttccatgattccaagaagaacccctgtacctgttagcagtcactcccaattccccctcctctcagcccctggcaaccatgaatccactttctacctctatggatttgcttattctggacattttatatcaatggaatcatacaacatgtggtcttttgtgtctgacctccttcacttagcataatattttcaaggttcattacatggtagcatgtattggaacttcactcctttttctggctaaataatattccattgtatggatcaaccacatgtgtatatccattcatcagtttgatagacatttgggttgtttccactttttggctattacaaatgctgctgctatggacaagtttttgtgtgaacatatgtttccaattcccttggagtagaaatgctgcatcatatggtaattctgtgtttaactttttgagaaactgccaaactattttccaaagtagctgcaccatttcacatccttaccaacaatgtatgagaggtccaatttcttcacctccttgccaggacttgttattttccttttaaaaaaatcaaccatcctagtgggtgtgaaatggtatctctttatgatttggatttgcatttccttaacagcccatgatgttgggcatcttttcatgagcttgttggcaatttgtatgtcttctttggaaaaatgtctttttaaagcttttttctgtttttaaattggattatctttttattaagttgtaataattacaatttaattagctttttaatctctgctatgtctaaggttccccctttgtcattcttatttctttttttcttgattaattttgccagatggttaattttatatgtcaatttggctggccaaagtgcccagatatgtggtttaaagaacctgaatgtttctttaagcgtgttttaggagtggattaacatttaagtgggtgggccgggcgtggtggctcacacctgtaatcccagcactctggccaaggtgggtggatcacgaggtcaggggttcgagaccagcctgaccaacatggtgaaaccctgtctttactaaaaatacaaaaatttgccaggcatggtgggacccacctgtaatcccagctacttgggaagctgaggcaggagaatcgcttgaacctgggaagtgtagtgagccaagatcgcgccattgcattccagcctgggtgacagagcgagactctgtctcaacaacaacaacaaccaaaaaaacatttaagcaggtggcctttgagcaaagtagattgccctccataatgcaagttggcctcatccaatcagtcaaaggcctgaagagaacaaaaagagtgacctccaccaaccagtgtagcagcagatggcctttggacctgacttgcaaacatcagctcatctctgggtctccagcctgccgacccaacctgcagactgtggaacctgccagcctgcataatcatgtgaaccagttccttaaaataaatctgtctacatagatacatatcctattgcttttgtttctctggagaaccctgactatacacttatctgtcttattaatattttcaaagaatcactttaggctttgtggatcccctttactgaatatttggtttctatttcattaattctgctatatctttattattttgttatttgtttccttctactatctttagatttattcccttctttctgtcacttcacagttttcggcctttcttcttttcttctatcagtttaaacccaacagccaactgcctccaggggtttctccctggatattccacaagcaaatcaattccagatgagttcctccgcctcccaaaagctatcgtcctatgtttcttatcttagtggataatcccactagccacctacagtctcacaatcctgaaacctcagtcctaagtttctccctttccccaacctggcacatttactcagccatcacttcctgctattccttttatttatttattttgagacagggtctcactctgtcacccagactggagcacagcctcgacctcctaggctcaagtgatcctcctgcctcagcctctcgtgtagctgggaccacagctgtgtgccaccatgactggctaacttttttatctttttgtagagatggggtatcactttcttgcccaagctgatctcaaactcctgggctcctctcaaagtgctgggattacaggcatgagccactgcacctgaccacttcttgttattcctacctcagaaaccagagcctgacttttggctgtagttctgtctcttatctggttctctggcttctctctcactccttctgccctgccgccatctttctgagaaagaaatcttttttttttttttttttttagacagagtctcgctctgtcgcccaagctggagtgcaatggcatgatcttggctcactgcaagctccgcctgccaggttcaagtggttctcctgcctcagcctcccgagtagctgggattacaggcacccgccatcatgcccggctaatttttgtatttttgtagagacaggtttcaccatgttggccaggttggtcttgaactcctgacctcaggtgatctgccgcctcggcttcccaacgtgctgggattacaggccgcctcacccggcctgaagcagaaatctaattctgtcatcccactgctcctgacactactccccagcattccatctcccctacacctacctgtcctccttagtcttgagacatatgtgttgaaccacccagacacaaccagcttttccctcttcccttcgctctgtccgttcccccatttttcatcacttaaattgttttggcttgttcctttctctccattttccattttgatgctatttttttccctctaaaataagaacctgaatgagactacattaatattggcttgggggttttttaaaaaagggtgtatcaattcttctccttccttttctttccttctgctgacatggactctataagctctttcagtaaattctgttttggagaacaattcgagccatttttttctctccctcctttcctctctattattttataatcccttcatttattgctgaaccatgaaaggtgcttattttcttggttgattttttaggttctcaattgggctttgtggtttccattcttgtctaattcaagaaactatctgttccttttttgcaatcccttttaccacactctactgggtggttaatggcttctggtttgctatttattgcttctaattaatggcttggctcacagcctttagctattaatttagtacttgattccttgaagtttaagttttaattgtctggccacaccattcagtttcatctgagaactactgcatcagtctctttcccgacggcctcaatttttgttccttctcttttcagggtcgtattatgaagtaaaagtatcgaggggttttataaggtgtaaagttccacacagaagcaaactcagccttcatggtggcactccactgcttaggaaactgtagtccctaactgtctaccatatcagttccaaactcttcctctcaagttcactcacaaaaatacccaactctaggccagacatggtggctcacgcatgtaattccagcactttggggggccaaggcaggcagatctcttgaggtcaggagttcaagatcagcccggtcaacagggtgaaaccctgtctctactaaaaatacaaaaattagccaggtgtggtggctcatgcctgtaatcccagctacttgggaggctgaggcatgagcatcatttgaacctaggaggtggaggttgcagtgagctgagatcgcactactgcactccagcctggatgacagagcgagattctgtctcaaaaacaaaaacgaaaaagcaattctacctgtccaatccatttcctagtgcaagtcaacagggaccctccattccagatgggcaggacaccttctaccactttatccattaagtccatcaacaaatccacacagttctctgctactttctagctgtgtgactttagctaaaatagtcaaactttctgtgggtcagtttctttatctctacagtagcaataatagtagtatttaactcacagtgttgctataaggattaacattcatatggacaaggtaccctaaagcggggcctgctgcgtagtaagcacatactaagagttgctctaattggtattatgatcaggctagattcatgaaggatacaaagataaattagatgtaaattgttacccttaaaggacttccagattagtagagtggtaagttatatatccacataccgtccaaggtagatgggggaaggatataggaagatgactaaacttctgccctttgccccatgttctgtccttctttctacctctctggctctttcccaagaaaaattgtgatcagaactcaatggtcagaaaatccttgattgagccacattttacgagtagtcagatgactatgccttaaagataagtgaccataaatgatgttctgtcttttccttcttaggcagggtatggctccaagggtcaggcggttaacatcatccatgtagctggctggattaagactgagggtctgcttcccaaacctggccatcttagcagcagggagaagcaagcttcatttgggacttaacccttagccaacatccaactcagttttgtttgtttttccccaaagaaccctcagaagtgagcatttgcccataatcaaatggtaatctgtttcacattctatcattgctctgaatatatagactctgggttaagaacctcaagggaaagaagtatgagtggtaggattcaagcactaagatcctatctgaactcctgaccatagacagcaaagagggtcacggcagactgtgtgctgtggaagaatatcttctgtgggagaaggagaaaatcagggaaggcttcctgaaagaggtgacatttgagctgagactgtaagcatgagtagtataggcttagacagtgggaccctcaaagaattctgaacactagcataacttaagtttttaaaaatgaccatgttagggggtgatcattttcttgagacagcaaattagccagcatcctgcctctggatttgagggttttgggcaatctggatactggggaaatagtctctgggtagggtaggtaatggtcagtaggctctctctcagtttcagtggatttccattcccacctccactattcaaattcctttttttctgatttttgaactcagtttcatgactatttgagacataagaagggggtaccctgcacagagggaacaagtagcctagtcactagaaatggacaacctcaagtgtattgatagaataagtcaaaggcattaccggcacttcttcacttgccacgtcctccaaggtcagtcaggttccctccttccttctccactgaatctgtcctaggagagttccacccataacctctcatctcctgaaaccatcgataattttgagccttcatgctatcaggccacaccttggtaggaaacaggctcttttcctttgccttctgggacacccctctctcctggttcttcttccctctctctggcaacccctcctcagcccccgcttttaaggcaatgtcactgtttatttctaagcgtcttgggaaagtctctattcaggacccacagggatgaagcctaggcccagggtaatctagcagaggcactgcctctgatagccccacgccacttacatctcaactagcacccaccggatggtggtagaatctgtatgcaaagaggaaatgaaactgtcagagagaagagggtaggagaagaatggagagtaaaagctcagggtgagggaaggggagatatggttgtaaaaggaagttgagccagggaggacatttcagataaagcagttgaatattcattcagggagcaggttgattttttttttttttttttgagaccgagtctcactctgttgtccaggatggagtgcaatgatgcaatctcagctcactgcaacctccccacctcctgggttcaagcaattctcctgcctcagcctcctgagtagctgggattacaggcgtgcaccaccacgcccggctaattttgtatttttagtagagacggggtttcaccatgttggccaggctagtctcgaactcctgacctcctgatccacccacctcagcctcccaaagtgctgggattacagtcgtgaagcaccacgcccggccccatcacagacttttgagtgcaatgccaacaggttagaggcagacttcaggagggttaaaccagttttatgtgcagaatggtgggggcgcgaagcagacacactagggatcggtacaaagccctgctgcctgctatgtgatcacctcacctaaatgccttccctcttctgtgtcactgaagtctttcctacttcatggcttgactctataaaagctgtccttgatggctgtggcccacctgatgtccacattcataaaactttctggactatacaatgaacatatcattctctctgcagagagactcaaaggacgtacagaatctgagcttatccttcatttgttagatgcatgagcccaatcagaatacaagttctcacataccacatttaagtcacctggcagcactaggctgtgtacagtgtaaagatacattagatgctttcagaaacagacgggcttcggaatatttattcttttccagagtgacagattccgccacatggctctccagctagaagactacatttcttagtctcccttgaagctaggtcattgtaactatgtttttgccaaaggaatgtgaacagcagtaatgtgggcagccagcctaaaaggtaactacttgccctgaacttctctttttctttccctcaatcttgaacaaggacatgcaacctggcttctactgtactgatgaggacaaagcctcagggggatggcagagcaacaagatggaaagaacccgggtccctgaatgaccttgcggaacagagtcatcccaccagccccagaccaaccagactcttatcagagagaaaaataaactagcttatttaaaccactatatgttaaaatctctaattcagcagttaagcctctacttaatacatttccccaaatccattctctccatcttctttaatacaataattctgatttttgaactgggcatattatgtctcagctaataggctctattttacatcctcctttgtacctatgtgcaaccatatgattaagttgtggccaaagaagtataaaaattgttatatgaaacttccgagtaatccctttataaagtagtcagtgaccttcttcctgcttcatttttcccactgtctagaatgtgaacataatggctgtagctcaagcagttattttgaaccatgaagttacatgctaagaattgtgaagaaacagaagggcaggatccagagacactggtgaccaaggagcctccagaccagttctggattacctatttctagttttctttctgtaagagagaaacttctatcttgttgaagctattaatgtttgcttgttgtatacagctgaacttaatcctaacaacagacacatccactaacagatatgagctcctgggactcaacacttcaaaccccagcttgatggttggatatccctcttagcagaagaaaaggaaagtcactacttcccaaagttgcttaaagaggccagtttccattccttctgaccaccatccgcttggcttttgtgctcgttgaagcagctctacagggaggcccttggctgacaaactcccagtctgcgggcccagcaggccacaacaatggtggctcgcactaggggaccataacatatgtggcgtcataaaagaggagggatgggagtggggaggctgatgtgacccagctctgacgggtcagtgagcaggaacagaatgctacgaggtgggcgctggtcactgcaaatttaagtcaatacagacagggaggaaataaggcaacctctctctttaggttggggtttttctgcttccccctagctgccctggccagatggcggcctcctcccctataacccaaccccaggcggcaaaggtggaagccagatctaagaactgggggagcttagactcagcacccacccctatccacagccttgcagaacttggatgacccctccctctcccagcctcactctccccatctgtaaagcgggcggcaggcattgacagctctttgggcctttcctccaggccggcggaggcctgggcactgcgctccccatcctggcctcgcctctgcaagagctgcctccacggacatcttttccgaccccctccccctccctcgccccctctcctcgttcccccgatcctcggtcccccacccccggtctcccctcccgcaacccctcgccctcccgcagcctcaccctcctccgacaggtagcgcaggtcgtagaactcccccgcgaaggtgccgtaggaggagtcgtggcgcggcaccgcctcgtcggcgcccgtgtccccccgcgcgcgtccccggggtccccggccccccgggcccgcaccgtcgtccgcggggctggctgcgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccgcggagcctcccgcacccccgcctccctgcctcggtctgcgcatcctcgctccagcaccgcagcctcccccttcttcttggaacccccctcctccccgcaccgatctctccttcctagcagcttcccttctaccgtccttctttccattctccccatctccccgacttccctccacgcaggcagatttggcccttctggccccttgctactccggagtgtggtccgcggaccggcagcatcagcatcacctggaagcttgttagcatcgctgaggccccactccagacccatgaagcgggatgttcatttcatcaaaattcccaggagatcccaatgcacgttcaatttatgaaacgctcctctagagagtttaccctggacacacctggtcagtgctgcctcctcaaccttgtgccggcactttttggtttacataaagcacttgctagacctattatttcttggatcatcacagaaggaacttgaaattgcaagacccccacaatagagctaggtaaactgaggtgtttagagacagagaaaactggattcacctgcttcctctccaggctcttgcggtgtgtaatcaacagaggctggtgccagtaggtaacctgttccccttcaaaactaggcttctggtttactctctttccctgcagcaagcacgcgcaggccttggaaggcccacaccgtatctgagggccatgctgaattgttgatttttctcaaatccattcctgctgcttgcagttcacttttggctatttactcagccatccattgattcacaccaagcatttgctttatggcaggtcccagggttctcttttgatgatggttgttggggtgatatattcgaattgctaagctgttttccatcagagaggcggacgcaattcctttcaggctggtgttgcagagccagcattttaacctgcttttcctattttattattttattttattgcataaacaaaataattatggaggcagaaaagcatagaggtcccaaatgcagacctagaagtcagactgcctgatctctcatgattagtcattgacatgatgcaatgaagattagggaagatcatagaggtaaggatcaatagggttcagtgctgtaagtggcatgcacacatgtacacaatattgtgaaatgttaatattcaaaaggaaactagtgatcttaaccctttatggcctgattggctgagagataagggtagtgctgttgaaacaggggagacatgatgggggacttagaagtcaggtattttctattaggtatcagctaacagtgggctgtccaactggaatttaaacatattaatcctgatggctgaattgaggtgtaattcatgaaaaccttgggcttcactaggtcccccaacatagcagttgtcacaaaaaatagatcagattatttgaaaaaggtaagatgaactatgattactttaaaaactcaagagacttcttcccaaaaagcatagcgtggcaatgcataacattctaaaaaagctgatccaacagattgaaaatctgttaaagtgtagtccttcaaaaaaaaaaaaaaaaacaaaaacaaaaacaaaaaccttaaacctttcttaaaaattaaaatttctttattttcttttcttctctttctgttcaccagggaaggtatggtcaacttagaatggaccaaagtttagccaaaaaaataaagcattagacttttgatttcagtgtagattctctggtttgggaatacaagcttttacctcttactttcctttttattcccttcattttggttactgaaattaacaataacggtgcccaaatagaaggcaaatgaaaaccaggccattcttctccgagtaaattaatctgatataaaaacacgtgggcagccgggcacggtggctcacgcctgtaactccagcactttgggaggccgaggcgggcggatcacaaggtcagaagatcgacaccatcctggccaacacggtgaaatcccgtctctactgaaaatacaaaaaattagccgggcatggtgtcgggcgcctgaagtcccagctactcgggaagctaaggcaggagaatggcgtgaacctgggaggcggagcttgcagtgagtcgagatcaggccactgcactctagcctgggcgacagagcaagactccatctcaaaaaacaaacaaaaaacaaacaaaaaaacaaaacaaaacaaaaaaaaccaccaccacgtgggctttctatattgtttttatgggggtatttgggtattttggggacggtttacaactacagcctaaaatgaagtttgcaggtaaactgtggatttcaattctctctctactcatgtagactcacagggggccacagataggcttcaggggtgatatgaggaccttatgaaagtgctggaataatgttgtgatgtatgggtttttctagggagaaaacccatagctttttttatgaattattttttccatgttcaactttttttttaatttactttaagttctgggatacatgtgcaaaatgtacaggtttgttacataggtatacatgtgccatggtggtttgctgtacccatcaacccgtcatctaggttttaagcctgcatgcgttaggtatttgtcctaatgctctccctccccttgcctcaccccccacaacatgcctcggtgtgtgatgttcccctccctgtgtccatgtgttctcactgttcaactcccacttatgagtgagaacatgcagtgtttgggaaaacctatagcttttatgggtcactcaagccttatgccttttcagggcccagcaacctattcggctccttccatttcatgagattctctcccatccactcaaattgcctttggggattttctttctcttcatgttttctgacacgatttaagtcctggaaagagtggaggcagacctattccaaccttaagcacatgctcccctcttagttacatcctaggtttgcagagaccctctgttccccaccaatgtgactctacagaacagctaagaaatattgtagtttcctctactgtgcaaattttctggggaggaactttgcctgaacattctgagaccactggctgtacaagagctggccactcaaacaaaaacttagagatgaaccagatttaaattcattttcattttaaaaagaaagacagtacctttattttctctccacctcaaagcaatttctctgacacaaccttttttgcgattaaaaactcccaaaatcattgctgcatcttggtatctgatgagtaaccgatttgcccaggcttctgactgtctagtatatataatttttcactttggattttgtaagaaataaaagctgtgattgtggcagttccttagaaagttaaacatggagtttccatttgacccagcaattccaagagaatttaaaacagatgttcacacaaaaacttgtacacaaatgttcataacaatattattattattattttctaagacggagtttcactcttgttgcccaggctggagtgcaacggtgtaatcttggctcaccgcaacctctgcctcccgggttcaagtgattctcctgcctcagcctccctagtagctgggattacaggcatgcaccaccatgcccaggtaattttgtatagtagagatggggtttctccatgttggtcaggctggcctcgaactcctgacctcaggtgatctgcccacctcgacctcccaaagtgctgggattacaggtgtgaaccaccgcgcccagcctagcagtattattcataatagccaaaaagcagaagcaacccaaatatctatcaactgacgcaactgatgactggataagccaaatatggtatatccatataataacacattattaagccataaaaaggagtgcagttctgatacatgctacaacatggatgaaccttgaaaacactatgttaagtgaaagaagccagtcacaaaagactacatattgtatgattttgttcatatgaaatttccagaataagcaaatccatagacggaaagtagattagtggtcgccaggtgatgccaggggtcagaatcagtagtgactgctaacagacatggggtttccttttggcatgatgtaaatgttctggaattagatagtggtattgtctgcacaacattgtgaatgcattagaaaccactgaattgtacgctttaaaatggttatagtgatgaattttatttgagtttttaaaactgtaatttttgagatggtgaaagataaatatgataccagaatattcctctgctatattcctggggaatataaaattctgggtgcatgcaagtgggatcttctgaatgccctaggatctcaaactcttcaaacatagaatttcctatgcagtttacaatccataaagctgtgggttgcaggtttcccagaccccttgcaataaccttccatgcctactgggaatctgcatcctacagtttggagccctagctctggaatgactatgtcagtaagctgattgtttcccccggacataaggtgtgtgttgtgtgcccatatagtgctgttgtttgggtttaaaatatataaaaaatgtgaaacaattgcgccaattcattttcatccctatgaatccatccagcacaatttcatcttctcagtcacaatgccaagcacccatcattcacttaaataggcaaataaccaggacaactgctgaaaccatggaatcctcttattttactggttagaggtgagctgccaaaggtactgggtttcaaatacagtaacagccaacttgtttgtggtcagacttccagtgacgtcaaccttcagaaacttcaacatctgtgaactctgggggaagcggggaagaagcaggaagcccagagcctcctggaaacactggccaaaaagcccatgcatcccttcttggaagccaagcagatctgacacataggaaatactggctttcctggcttccccaagaaaccttcagctttgccctggaggtttccatcagcgagcaggaggtgaagagcagaagcctcagaaagcaggttagaagaggaagagggtgctgggttggcaagaagtgacagccccatattgtacgggaacatattttgtatcatgtgcacaagataaagaacagctaaagctgttttaaaagtatagccgggggacataggggtaaaaggacccaaacgctacaattgccccggatagctccactgacagagcagagagcagtaaaaaaccatcagtgagaacagcataatatcctataaaaggccaagccaagccctacacatattgatagctcttaatgatatcactgcaccgtaccaaggtataaaaggggctgatgtttataatcatgaccatgactcatcaagaaaaggttaaatactctccagtatactctgtttactaaggcagggaagtgcgtaatacattttagaaagatttccctcaaaaaaaaatatattaaaattttaaagattcagcacttaaagggttaatcctcggttatctgaatattcacatacattcctcattttacaacaatactagtaaatgaggcattacctttttttgtagtcattagtatcaaattattggcaccattcagttttaaggagaggggcaggagagcaaactatacaatataacataaaaatacagttctgatacaaatatatgagatcagttcctcttaacaagtggtcataagaaatgaatgaacattttacacacaaggaaatacaactagtaaatcatcacatggaaaagtgctcagccttgctagcaattaatgaaataaaacaactcttcaagaacaactatacatacctattaaactagcaaaaataaataaaaatggcaaaacccaatactggcagagctattggtaaacagaaatgcttatacattgctggtggcatcataaattgtcgaggggattcaagcattcagagggggtggggaggctaaactagatgacctttaaggtccttccaacccaaagattggatctttctagaaagcaatctggcaatataaaacaagagctataaaatacttcatgctctttgaccttgtaatccctctttggagatattcctaagggaataatccaaaagaaggagcagttttttttttttacagacattcatagcagcactatttataagagtgaaaaattagatataactcaaatatctaataatggggtgaagtgaggttacccatgttacatggatataaagacatttaaattggtgagagtagaatctgtgttgacaagaggagacaagtgttaggccgagaagtaaaacaaaggagaatgtacacaacgatcatagctatgtaaaaatatgtgtgtattcattgagaaagctagggaactaatttagagggatattttgtggttagggggttgctttattcctgcaaagttgttcaagtgcattaataaaaatttaaaaacacatttcttgaaactatataaaaagagcaaaatttcttctggtcaagattctatcaatacgacatgaatcgatcaactttagaaataattttctgaatcttcttgatattgaatcatcttaaccttgtaaggatttttagacaatgtaagctatcatttcctactttgggttcaatgataaattctgtttattccaaataatatcatatccaaggagttcacaagttaaattatatttcagattaagctgaagtaccttcagtcatagtgatatgtaactttctttttttagttcttctactcacatctgaatacaaatgaatgttaaagactttataagatctgtgtatttatcagtgtaaatgaaaaaccagcaataaagaattattctttcattaaaaatgactctttaacaaacagtcaaagctcggtgcaagtttcaatcatacaaaatcaaatggttgaaattgatagtaaaagatcctacatcatattaacccctgtggttattaacagatacacacaggtacttctgaaaaggaatcccgttttcccatctttcttttcctagacttatcaaatcctgtctcaactacatagagtaatagaaaaactctaatgcttaggagacataaaataacttttcccataaaagtcaagccagaaattggcttcaactaaccatggagacctgggcgaacagagcacacacttgtatgctgtgctagagtgagcacacaaagcccgaagaaagaagacggacagaaggcaccatgccatcttccaggtgacaaggggagaatttcacagttcggtcatcaacagtcttttcatcatcttctctctctccagttcctgccggagtgtctctgcactaaaaaaaagtatgtgacaaaatagtgagacaatccctcaaaaattgcagaagcagacagcttaagtatcatctcccaggttctttcctgatctcagtgttggactttcttttttagactccttgaggactatctacatttgctagcatttcagtgatctgaaattggctacttactggtttctcagtcccaccatgctgagagttcctggctgactatatgtcattcatctctaaacctccagagccttgcgcagtatctggtgcatggcagccactcagtaaagtgttttttttttttttttttttttgagatggagtctcactctgtcacccaggctggagtacagtggcgtgatcttggctcactgcaacctccacctcccaggttcaagcgattcttctgtctcagcctccagcatagctgggattacaggcacgtgccaccatgccaagctaattttttgtattttagtagagacggggtttcaccgtgttgcccaggctggtctcgaactcctgagctcaggcaatccacttgcctcgacctcccaaagtgctaggattacaggcatgagccaccaagcccggccctcagtaaagacttttgaatgaagatgtccaggggttagatttatttaaatcatgctttaaattggtttcatgtgcattttctcccaggctttcatttgatgaatatctgagggaatgttgtaacaaataattaattatattttaatgaatcaaattgaatgaagtaaaattggctgttttgagaagttgcctctgactttttggacctcaggtccagttgcatatctatgtaacctgtctccactgtttaaacacacacacacacacacacacacacacacacacacacacacacagagtaaatacacatcttttcattgtttttagttagagatggggccttgctatgttgcccaggctggacttgaactcctgaactcctggcctcaactgatcctcccacctctgcctcctgagtagctgggatgacaggcacgagccaccatgcctggcaaaatacacatctttaaaggcactaaccaagtttaataatttcattcagggtagaaaacaaagtttctactgtagccaacaaggccctacgcagtctggccttaacccacaacttcacaggcctcctctattgtcattcactctgctctggccacgctggccccttaaacttccgtaaccatgtcaggcacatgcttcctcaggagccttagcactggctggttgctctgcgcagtactcctcccaggtatctgcagctttctctatagcccttttcagggctctgcttaaatgccacctcattgaggccatcccaggataccttattgccattcacaatttcattttcctccctatcccttgtcaatatcacacacacgcacacacacacacacacacacacacacacacacacacactcatttgttgtctatctcctctaacagcctacccttgtaaacatttttttttttttgaggcaaagtctcactctgttgcccaggctggagtgcagtggtgcaatctcagctcactgaaacctccacctactgggttcaagtgattctcctgcctcagcctcccaagtagctggaattacaggtgtgcaccaccacgcctggctaattttagtagagatggggtttcaccatgttagccaggctggtcttgaactcctgacttcaagggatcctcccttgtgctgggattacagatgagagccaccgcacctggcccctttatagacatttcaataaatacttacagaataaatgaaagaatgtaggaaaggcctgtacgtgtcacaaacacaatgaacctagagtctccctggtttccctgtcaccagaattacctgtcggaacctgctgacctgacctacctggctgccagagaaacaggtttccgggtggtgtaaatggtctgcactgtggagacggtctctgtcaaaggcctcagggtcgctgctgggatcagcggggaagtcgggccaggacagcactgtaatttactgtctctgaagtctgcctggagaagaaacaggaaagaggagatcaatctcaatttgggttccattttcacactgtcagttgctccctaagccttactctacagttcctgttccttttcactaccagctaaaatcgattgtcattttaagtgattttactttgtgccagacaccatgctaagtacttgacacatattaactcttgacaaccctttaaggtagcgattatatttcctcacatcttaggcaccatcagttgtaagatgcaccatttttgcatttgccaatcagaaagaaacatgtagccatttaaactttgtcatgcccactatcaaactttgtcatgcccagtagtaaacattctgatatcgggaaatgttaaaaggtgaaaacaaatgtatattttaaaactgattttatgggggaaagtgaggctcagagaggttaagtaatctgcccaaggtcacacagttagtaagtgttaagaacagtactgagaaccagggctagctgacaccataactggggtttttcattactgtagcagtggttcccaaagtatgggccccagactagcagcatcagcattatcttaaaacttggtaaaaatgc

SEQ ID NO: 1232 - DNA, 155684 bp, Homo sapiens
ccacctcaacctcccaaagcactgggattacaggcatgagccacttcgcctggccccagaagggatttttgttgttacatcccttggtggagaagtgagcgtattttgtgtgtaggaaaaagagtgaatcagatatctggcaaccagaaagatagtcatttgtgctactcaccatctacttctggtgcttcttccagacacattagcattgtactttcctgctcagttgaagttaggtaaagctgtgtcatttgctttggacatgaaatatatgtcacttccaggtggaagctgtaagactaagacagccagttaaaaggggtcactggagaacctccaaccagcctgggcactgggaagagtatacaatggggtggagcatacactggggtggagcctcgggaagttcacgctatttgcagtggggaagagcctggcctctcctgttccgaggtggtacatgggattcaatctgtgaggcgggaagcctgctagcaggactcttgctttgccaagcatccctgtttcctctttttttttttttttttttttccttttcacctaataaaccctgccgttctcacccttcaaagtgtctgtgagcctaatctttcaaggtagtgtaacaagaacccggcttttaacagaactaaggagaaagtcctacaacaagaccattttatatacaccatgcctccttcctcttctcattctagatagtggagtctctggcaatccagggccctgtgtgaggataatatggagctgatccctccctggcctgaaatagagatggagcatgagaggaaaataagcctttgctgttgtggacatattcctcccatcaagtctcttcaggaagcacaggagagacagaagaaatattctccaagtctctaaagcttttctattctgaatttaaatacttcctgagtatctcccacattcttgcccctgaattccacaggcaccctttatccatttactagatagctgttcaagtttttgtttttaaacaagctcaagttgattacactgagttgtaactgatgcattcataaatctatcaagcttctcatgccaaagaacaaaggaaagacaagcaggaaggcatgggacacattgggagaatcacagtggacccagcccaagtgggaatgtggcagagacaagctaactgttcaccatacccattgcctctttttcctgagcccatggctagactatattcctctgcctcttttgtcatgaggcaaagcagtgactgagttctagctaacggaacttaaacagatatgtaccaccttcctcacacacccctccatgctttgtccccttcaatagcttgatgcaaaagaccacagtgaccttagcagatgtgtgaagacagcagagccacaagactgaaagaaccgcgattactgaatcacatcatgaaaacccaccctctgacagaaacaactggtttgtgatggacatctgtttgccttatctcacataggggaggaggggaagaatttaatcttggattagccctttgtggttttgcatacccccttctctgatcctccttagaggtgaataaagtagtggaatggtccccattttacagctgtgttaggcaaagttcagagaagttaatggctagggagggggagcacaggccacagtctagccaaagccagcctcaaatatagatctcctgattcccagagcctattacttcttccactgtgctataccctgaatgctgaagattcctccttaaactgaacatgtcagcagctaatctttgagctattaaataaattacaaaaagatgatataaaaggcaatccttccttgagacaactgtaccatcccatttatctcttcatgcccaggacttgggcaagaacttggtaccgagaagggccttcataactgtatgttatgatttttaaaaaaagtcttaccaagaaacaaaaattcaagtttatatcacattgacaactaaagaccagcaaaacagatgtcgtgtactgcttccacatgtagaccaaccagaataagactccaattccatcaaatgtaatttatttaaataacaattcaattgcatgttaagtaaaccagttgtagcaatataaaaatacagaattttgagaaaatctggcaaattaaacctgtatctaaatgcagcatattctgtgatactacggaatgaaaaataaaatgtgttgactttcaagtcaggatgatttatttgcacttaaaaatataatttctaagatgacatctgttttcaaaaacatcctaatggtaaaaacaggctacaggaattgttgtcatcatgttgaaattttagattttatattagcattagcttaaaaatcatagacaataacattaacacaaaatcagcaagagaacactcattgggaacagtttttatgttaaaaatatcagaggttcacagttttcttcttttttcttgacttacattgataaaatgctttgatagctacaatcaatttcaccttctagtaccagatccaatgcctccttgatcagcagatggatgttactaacacattcattttatatagaactcacacatattcagtttctaaaaatgttttgctctgcaaaactgtgactgctgagagtgggaaagattggagactaaaatgtaatgagaagagaaaaagataaaatgctgacaatttttactaacagaacattaaattataaagtacatacaggtagcttttatgattcaacaagaaacttcacattagtttacaaagtgctatggactctaattttatttttgtttaatccaaacaaaagtgaaaaccacacattatcaaagaattctgaactccttctacatgtcaagttaacagaggttttgaggtgggcagaccacaagacaggtttattttgtatgttttaaggcaaagcaaaatctcccaaatgaaacatctacaaaatacatttgctttgagaataaatttcagtaataaaaaaatacttctcatttattaaatatacatatttgcctttacatttgatttagcaatgtgaatcaaaaaatgcaagtgttctgtgaacatctgcaaatcaatatttttaaacaccaatacagaaatgagtcagttttcattcaggtgtttggatgttaacagtcagcaaaagaaaaaaaaaaatagactacttatggaattttccctaacacaatatgagaatgcaacatatttttgagaattaagtaatttttctggaccatacatatcagtgaaacacatatgttctccttctgcaaatattaattaaagagaacccaacagtgcttaaaccattaaatttaaccaacagcctaagatttaaaatgtttaccataatctctgtttatgtaaattattttcttaaagaaaaaacaaaacactctatagaacataactgtctactttgaagaataaatcactttggggaaaaaatgtgaataaaagctgaactcggccaggcatgatggctcacgcctgtaatcccagcactttgggaggctgaagtgggcggatcacctgaggtcaggagttcgagaccagcctgaccaacatggagataccctgtctctactaaaaatacaaaaattagccgggtgtgatggcacatgcctgtaatcccagctacttgggagcctgaggcaggagaattgcttgaacccaggaggcagaggttgtggtaagccaagatcgtgccattaaactccagcctgggcaacaagagcaaactctgtctcagggaaaaaaagaaaaaaaaagggtgaactcatttattatccccaaaattgctacctggacgtttgtctacattaaaaataggaatgacttaaaatgtctacatgatttccaaagcaaagagtgtcataccttcaaattgattaagaccattgtattagtccattctcacactgctatgaagaaatatctgagactggataatttatttaaaaaagaggtataattgactcacaattctgcatggctgagaaggcctcaggaaacttagaataatggcggaaggcaaagggaaagaaaggcaccttcttcttcacagggcggcaggaaagagaagtgctgagcaaagggggaaaagccccttataaaaccatcaaatctcgtgagaactcaatcactatcatgagaatagcatggggaaaactgcccccatgattcagtcacctcccactgggtccctcccatgtggggattatgggaactacaattcaataagagatttgggtagagacacaaccaaaccatatcaaccacacagcacttcaaaataatacaattcctttaaaaatgaaataatattctttattatacttattttttattcaaagtttttggctacaagtctgctacactgagaccaatttatttctttcccaaatggtgcccaacagactaccaataattaaaactaatttactagaaaatactaagcagcaataaaactgaaggtgtcactgggatatgccagcaccccttaaatttgttgtttaaattagtgtttctaaaaactatggcattaatatacaaggtatattgtatgttaatattcaacaagtttcacataatgaagtttgttattaaagtgccttaattttccctattaaatatccaatctgtaggcattcttttcagttaaatacagtgagccagctgctttgatttttccatgtgatgtcctgttacagtattactgtgctaaacacatatcatgggtacattgtaagcagaagggaatggggtgtagacttcctctgaagctagatccacctatctcctctggataattcaggccaagaacctgctcagccatctcagtccactaaacagtccttgcatcatttctttctgcagttatgaagttacaaaatgactagaatggacttcaacagtcctctaagaggacagtctgtcaagatcagatagcagctgctcaacataaaagatatcttccctgatgataaattctgatgtgtccttttcattacatttcaagttcaacatttcaaaataactaaatctaacagcaaatgtgtaaaagacaaaactaccaacaataggcagcagaaacaagcaatctaacacttaaagacaaaaatatgtaaataactggactcggggaggaaggactaggataagaaatcctgcatttctttggaaagaactgtataaaacaatgtctatttattatttgtaagtagttttgtatatagctatctatagatacatgtatcttatgaagaaatatctgaagagatttaaaatgtcttaattatatatatgcatatcacttaggtatcatacacattcaaaaataaattattctctaaatgggtaacatgtgtccacaaacctttattttatatatatatatatatatatatatatatatatatatatatatatattttttttttttttttttttttttttgagacagggtctcactctgtcacctggggtggagtgcagtggcatgatcttagctcactgtagcctcaaactcctgggatcaagcaattatcccacctaagtctccctagtagctaggactacaagtgcactccaccatgcacggctcatttttttttttttttttttttttgtaaagacaggttctcactgtattgcccaggctggcctcaaacccctggtcccaagtgacgccccccaactttggcttcccaaagttttaggattacaggcgtgagccaccattgccagcctctaaaaacctttaaatagtaatactggcctagttgagaaagtcagtgttgaaacattaataacaaagcaatggaaaagattccactagatttctcagaataattttatcttagaaaatattgggccaggcatggtggctcacgcctgtaatcccagcactttgggaggccaaggcggccagatcacctgaagttgggagttcgagaccagactgaccaacatggagaaaccccatctctactaaaaatacaaaattagctgggcatggtggcacatgcctgtaatcccagctacttgggaggctgaggcaggagaattgcttgaacctgggaggcagaggttgcagtgagcctagatcgtgcaattgcactccagcctgggcaacaagagcgaaactctgtctcaaaaaatatatatattaatcatgaaatctatcttctcaaagatgtgaatcactcttctataactctaacaactgtactttgtaaaaaagaatgtctgtaaaatcaaattaaaatcatcatctcaaaaataaaatttcttaatctagtacataaggagtttggcggagggagggcagaataatgttcaaatatgccaatgacactgaccatctgcagataaacacgatcaaatgaaagtttaagggcactttaaatagaaaaagcaaacttcacagatatgtatgtgaagcacaaatcaggtgatcatagtagacagcaagtaaaagccagaactccgcaaagcaggctattgggaggcctttaagaagtgcagcacgtatgagtgaatgcttcctcagcattcagcaccattcccacatgtgctgtaagccattccgggtgctccgcagccatgtgtggcgaggggctactgtactggacagagcaagactgaggggaaacaacacggtttacaggctcatgagggcaaggtaattttctaagatccattccaggcccaaggaatcacaaaatcttagggtattaaaacatcactggagtcttcgtcaactcattttaactaaatgtatttgaatttaagatttctaaatatgcagagtataaatacaaaaaaaaaaaacagaaatggagggaaatgaatgaagcattagataattccagaagattttccagttagccacaaagatctttttaaaaattatttttaatgtccaagctggaggaaaaccctcctatttatgaagatcaacagactagactcactttaaaaaggagtggatcacgagttcaggagatcgagaccatcctggctaacacggtgaaaccccgtctctactcaaaatacaaaaaattagccaggcgtggtggcgggcgcctgtagtcccagctactcgggaggctgaggcaggagaatggcgtgaacctgggaggaggagcttgcagtgagcagagattacgccactgcactccagcctgggtgacagagcgagactctgtctcaataaaataatattaaattaaaataaaataaaaggagtggaaagtattaacaccggggattgttagtgtctatcacaactacctctaatagtagctttgaaagagaaaacattcacttttatttgaaatggtagggggggagcattttttctttacacactccctgctgatttgaagccctaataaaagaatcatagagtgacctcaaagttcaactagtctaagcttgcaggacaggcagaaatgacagtcacattagccctgcttaaactcacccctttgcagaagaactggttattgattttagactgttgggttttccgataatgaaaaatcttcctcggcactgattaatctggaattcagcttcctacagcctttatccacttgtctcatttctgccctctgaggataaagacaggatcaatggacttaattttcctatataacttggaaacttcttgtatcagggagcatagaaaacattaacatatatgtccagataagagctgatacagttcacctttcattccttgtcagggggaaatcatgccttccttgtcaccattcctacaaagcacaaagttacttaaatttatacagcaccaatcagaaccctgcctctccattaaggaaaaaaaaaaggcaattatgccaggaactacatgaattgcactgtcagacacaatggcaacccaaccccatcataaatgcccctcaaaaaactagataaaactgtcacttcagtattcattcttcacagaacaccctaatgactccaaaatgcaatattagctgatgcccaagaagttggtgccactacaatatcttgaacatagcaggaaacataaatatttgtagcattttgatattacagtactaaaagatccactggatatactgtccatagtatcaggtaactgcataaagaataggaaacaaaaataaaacaaaatataaataacaaaaaagatttttaaatggagatgaatttcttttatatttgtttagtaatgcagagttaaaataaaaatggccactctaagcttaaaactgtttcattttatccccaaaagagaatttgttactgacttgcagcactgacttgcagcttctcacagtaacaatgtaagaatatatgctcagtatacccacagtcacaatgtgagtgtgcgctttcaaaaataatgttaccaaagctcttctaagagcttttttccaaaaagctttttttggaaaacttttttccaaagctatacacaaataatttttaatgtattttccactactaattataatgacagttaattttattttctattttgtctgtacctaaagttgtattactaataacacattgatatctaccgccattgatatctatctttcattggatatacatcctcagtgttggtcaagaatcagtaccttgaagaaaacaagccacacactgcttgatacaggtccatgtggcagggaacggcaggagcaggttcatataacctgggtagcctactgtcaacatcaaacacatgaatacacagtaaggtatttgaatttctacacttctttcattttacaacacaaaccacagtatcagccaatacttttgtgttgatactgtaatccagacataaaaaaccataattattataataattcatacttttgtatagccttttacagtttacaaaaagctatcatatgttttatctaattgagccctcacaagtaccaaataccacaccgctatccatagtggggcaactgaacccctgaaaagctgagctacgtactccgtgtcatggaactattaacccacagagatgaactcgtgactcccaatatgtggctccttctgttaaactgcagaggcttctatgacaagttattcttcaaaatggaaatagaaataaggcccagattcatcaactcataaattgtcttttctcactctggatgccacaacacatacatgtggggagttgggggcaatgatgatgattgaaaaataaaacactccaagtgggaatggtttgcattcgacattttaaagtcatttgttgaaaataaatacctaatacatagactcacagttataaaactgaaaaagaccttgaaagtcatctgttctttaatcttgatttcacagaagaaaatgtggtgacacacagggcacagtggactccctaaaggtctcctcactaatcgctaatgggtagcagaaccaggaccatatggagtgtcaagctctcttctgctctatgccctgattctgtttcccaactaaaggactaagcaaggtccagattatctacaaggagacatcacagtgctagagagattagaaaactaggtcttaccaacatcttaagtgtaaaaattattgatattttacatatcatttaaagcagcaggaaatttacttcctagaagaaaaataatccatgtatgtattttaggctctcattgctaaggttaagaaaaattcctaaaatatgacacttccttccctttagatacacaggggttttgaattttgttattataatagacttaagtacattcaaaatcagtctctccaaaacgtcaccacctttaatcaaatgaagagtaaaaaaccactaactgaatactgcatcatcctttatagagaaaggtctcttcaacccatgaagtacattatatcgatccgtgttcatgttctcagactgtctttttcagaagtcttctgaaggtcactgttaagctattttaaatgcaatgatatttatttatcttctgaaatttaaatacaggcaacaaaatatctctgaagtttaactacccaacaaatccaaaattggctcaacttgtaagctatttgctaaacaatattaattttcacattaaaaaaataaataatctaattagactattgcatctgcaagtctttcaaaagacttcttcgccccctaattcaaataatatgaaattcttttgggggaggcaaaatataagaattttctagataatatagaatgccattccataggaaaaaaaattatgtagaccaacagtaaatctctcagatgatagaaaatattgaccaaaaaaactgtttttttgtctcttattcacaagatcatttttccactttaatataaggttgaatctatagcagatgccgatgctaattgaggaaaaattccatccttcaagttctgatcaatctgaggaaggttttctccagaggtgaagagctgcctgaattctgaagtgtagtctggactccagggagtaatctttgtagttgttcctgaagacaataacaataaaattgtacagtcaaaatttccttatataccaggtaccaccactctcccattcctctctctgatctacttacttactttcaaactctaatatacataaccgtagatcttagtaaaatgcagattctggttctgttggggggttttggggggaactgcaataatctgcatttctagaagcttcctggtggtcatctaaaggtcatactttgagtagcaaggttctgcttaattaccaaatcattcacaagcatagcaagaagttgtgagaagggctgtacaaattttgtgaactagtcctaaataattagacttccttttttaaattggaaaattttaaggtaggtgcatataaacatggttagcatgatcacatgatcgatcactcaagaaactcaaatgaaacaactgcaacaaaggcagcagaattacttaatgacgtcaaaattacttattccaattctcacatgtaaatatcaatggtttggccaataattacataagaattaggccaatgtctttaaagggggccatagaaatccaaagattatttaaaacctgcctaagagcatttatgttgacctccctttaccagaattgttaagaatcagaaaaatggaatacttttacatactgccttggcccatgggtgagctataactgctttctttacagtggcacttatttctatagcccttcattttgaacaggtataagggctactcactggtaatcttgatgtgggttagtaaaatgtattattcataaactaaaatcaatatgttactggagtttaccgacagatggaattgagtattttcctaaatgccaccaatgtgggcaactttgcaaagctcctaatgcataaagggaaagtgcagataatagtcttggaattactgggaagtatctttatgtttgaattgtcagtattgtcttgagttagtggaggcttttcattgctttttagcagtgagttactagtcttttatttttatcttataaagttgccttattatacattgtatattcaaataatgaatatttggaacagcagcatttataatccataattttccaatagctggatttgaagatatctatatctaacacatgaaatattggtcatactcccaacaaattaactttaaaagcaacttgctctcatatcacctatatataaatattttaaggaagcccttcttggctctaccatgcccgtaaagcttttgccccattacgatgttctattcacagcaaacatcctaaaagagttgcctaaagtagcggactccattttgtttgtcacctcatttgtcaaggtcaccaatgatactcatgctgccaaattcagcagccacttttctggtcttaacttgtttgacctcttagttgctgccctcataactgaccatgctcttctttttgaaacactatttggttggctttcctagatgtcttcctaactctcttaatcttcttaatcttatcatttaatgtctaagaagatggcatatcccagacattgtgctagacctctttctctagctatataacattcacaaaatgacttcatcacacgccattgctttaaatattactgtctctgtgctgttgactgcaatctctacattcagccctgaccttatcactgaacttcatgctaagtatgaacgccaacttgccatctacctaatatgagtacctaatagccatcttaaagaatcatggtctgaacagaagtatgtttcgttctctccccaaatacattcttctaagtattccccagcacagcagaaagcatcatcattgacccagtggctcaacctcctcaatgcagatgttcactaactgtgacttctgtcaggaatgctccctacctagttggttgatttctgatgactgatctcaagattggctttaattatgcaaatctcagctacaatatcatttccccaaggaaatatttcagaatcaatctatcctgaagtaacacccaggcaccatgtatcatattataaatctcagcaaacatataccactgatatttttcttgtctatttagtatctccctctggctaacagagcagaagtattgcctgcttagtttatagttgtctctctaaagcctttactagtagtgtctgacacataataggtgctcagtgaataactgctgaatttgaataaatggacaaatcactgtttatgacctagagctagtctggcattctttctctactgcagaaagtgttcaaggcaaacaggccacagggtttttgccttacctaagtgatccatgaccacaggtctaaaagctattgtctaccagaattgataaaaatactttgaaactgccgcaataaacagaaaaaacagagtctgggtaagatctgcaagcttcacaagatcaatggctcttcaaggaaataataggtatggctgaatacaatgaaggttggcaaactaggacccaagggccaaatctaaacatacccatctgtttacatattaccttctatgacttcttttgatataatggagtagttgcaatggagactttatgctataaagctaaaaatatttactatctagccatttacacaaaaagctggccaacccctgatatagaataaaataagttagaaatctttcaaatagatgcccataatcatatctgtaaacagtcacagggtgaggcagtaagagggttggaaacagcacaattacagcaaaagccatgagcataaatcaaccagaagttagcaaaagtagcattattactaatttgacattgttaattgttaagtatataatgttactgctgttgttagagcagtactgacatttctgactccataacaatcaaggaaaagctgccttcaacacttaccttgcagtttctaggaactttatggccttgtcaatttccccctggcttttatacaaagatgccaattcaaatagagtgaacggcactaggtagtggtcatacttcagtagcttttcactgaaagagcagaggaaaatcaagtaaatcttaacagaacaagaaatacacatttttctaaatatatattattcccattcttcagaaaacatgtgcagcactaagtctattatcatagaaaggcggccattgtatagttatggaactcattaaactatggcaataaataatgttcttttcctatattaatcttttattccttaatgtaaacccagcactgatggttgatcgctgtctcttaagtaaatcagcgcatacggatctttaaagattaaccctagaaatggcaagatcatctttctgaacacaaatgtgttcagaaaatgactccatttagaaataagaaagttgtattatttttaaactaaggttcaactccctttgtattttaaagtcttataatactttaaaaggccaataaagaaatggtcaacacttctgttttcagcactattaggagaactctctggttataaaacatgtaaaagcaatgaaaaaaaatacaactaacaccatttcaaatgcatagcttagctcaccagaacataagaaaaaaccctcaagtgccaaaaacagctagaattgaaaaagtgagactctacatatgtgggatgatgctgaatgagccctgtggtctacctccaactgagtcaagggctttgtatcctaatatccatgcaggagatgaggccttgggcccacagaaagcagggagctgaaactgagacctctatttaaagctgggatccttacaggactactccttaagacaaaggcaggttagaacaaacccactcactggcaaaggaggaagacaaagacagttgtctccttggccagcactttcaatgagaagaaaaaagaattccttaggaaatcaataaccaataggcctgcccacattgaatgtgcaattcaaatttacattgtctaaatgatccaagaagtaagcaatgaaattaacatgaaagaggccctgggcagaaaaaacctttagggtacctgacagaaataaaatgcaaaatcactgtagagcaactcttcttcagtatagcctcatgggaatctcaagaaaaaactccaatgaaggtgagttcacaatccacaattataaagcacatgagcaaacaattcactatgagattcacatacaaaaaaacagcacaataggtcatccttttgatcatccttttaatccttatagaaacactaataaaatagaattcaatagatatttctttaacatgtttactaattacagaatattactaaagacagtacatttgggaagtagatattttctctttattcttacaggggcacaagtcctcctatattcccatcaatactgtcaggaagaaggggatcaggtggccacggatggaaaggcacatgacacagagcacaggatgtccaccagcagtctatagctgtgattgttttggcttgcagaatattttcaaaaaatttgagccaatattttaaaatcaggtgattttacataatatccagattccaggcttctcgtgaaaaatggtagggattattgctattgggcccacactgtgcaaagcaataatcaaatagagctgaggagtgtggctacactcttcagagaaaacaccctgacctatagagcctaccaatcctattcctgccaccactcagccggccttattaagtaaggttacatatctggcccctgtaaatactgcatttgtgatacagagaaaagggccaggcatcagtaccctgattcaactctatggttagtaatggagcaggacatcatcatcaatgctactgagggggaataaaaccagaacaaaactcaattatatacagaagaactgccctttgccaaaagagagacagagtgctcatcacatgcctctctttactgccaaattattatcacggtgatggcaagtctgtttactcagctctgaatccttagaatccagcacagtctctggcatatagtgggtgctcaaatatccatggaataaatgaatggacaaataaatgtatgaattaaattagtatcagaagccaggcatagtagtgcacacttgtagtcccagctactcaagaggctaagctgggagtatctcttaagctcaggagttccaggctgcagtgagccatgattgtactacttgcactccagtctggacaacaaggaaagtctcccatctcttaaaaaaaaagaaaagaaaagaaaaactaaagaaatatgtaaaaaacaaaaaaattaatgagtagcagagattcagtatgatgctgccagagtttggctagacacctgttagttgagctataaatacagtttttgtaagtcatctttaaacatcaagtagaaatacataaagtcatgttccacccagaccataattttgttcacgaggaagaacaacaacaacacactactggattttctttctggtaacaccaagtaagagtttagcagtaagagataaaagcattttgcatcactttctcacagcaattccccagaaaccacaatttgcacttgggctggttttattgtttggtcttacctttccacaacatgattgtaacatagttcagcttgcaagggccgctgtaagttcttgaggcaacatcctttaagtaacttcactaagcactcatcatccacagagaagctgttaaaatcttaaaacaaaaaacatacaaagaaaacacacaaagaaaaatactttttaagatcttttttttttttttttttgagacggactctcgctctctcacccaggctggagtgcagtggcgcaatctcggctcactgcaagctccgtctcccgggttcacgccattctcctgcctcagcctcccgagtagctgggactacaggtgcccaccaccacgcccggctaattttttgtatttttagtagagatggggtttcaccgtgttagccaggatggtctcgatctcctgacctcatgatccacccacctcggcctcccagagtgctgggattacaggcgtgagccaccgtgcccggccttaagatcttaattaagagaaagaacaaagtttcagagggatcatttacaaataaggaaaactttttagcatttgttatgcctcactaaataaaatacaatgaaattattttaaatgaaaagaactgggcacagtggctcacatctgtaatcccaatgctttgggaggccaaggtgggaagctcacttgagcccaggagttcaggaccagcctgggcaatacaatgagaccccgtctctacaaaaaaaaatttttttaattactgggcatgatggcacatgcctgtagtcccagctactcagagatagaggcaggaagatcatttgagcccagcagttggaggctgcagtgagctatgatggcgccactgcactgcagcctgggtgaaagagcaagaccccatctgatatacacatacattcctacagtgctgaatttactatatcagaacatcattttattaaggagttcactctattcactttaaaatattcttcaggtggtcacgctctgagctttgtgaccttagatacaacaaccgaaaatctgagctctaaataaagagctttattaattctataaaaggtaaagccatgaggaacaagaaggctgcctcctcctgttgtttggcttctgtgttggcttcaatacaggagaggataacacttccatatggagaagcagatggccttatccccattaaaaattcaggaagtagaataccctctccagatcattatgtttacaacttatcaattctcccaggttgtgttctttttggggaaaactatgccataagatttaacaaaacggttctgaagtacatgaaaggcacctaaaatctccacaaacttctaactgcttgaggaaaatgtcaaggattttttcaccactttttcccttttgaaaatgctctctgccttctacagcccaagacaaatgtgtgttaaacagaaggaaccatattacgtgtgacatctatctgacaaaggtagccattccacatttacacttttgaaatttttttgcaagttacaggcaagtacaacgttattccaagacagaacgacaatttacacatttcaggctgtgacagtagagaggacggcagtaaagggaacatacgaggccctgggagtccctcctattgaaatcctcctgctttcagcacaaacctcagaaatcatcattaacacatgctggcagttaagatggtaaaccacttgactatggagattaacaatgctacttaaccaaccagaaaggggttacttcttaggtgctgaaaactgaatattcacctctaactttcaagctctgataggtcattcacccagaaaaccacgggtatcaataacacattaccttttctattatttatttagaatcatttttctaccaaaataaaattctatccattgcttttaatcacggatgttaaaacagacattcaagaagtaatatcttttaggacctagaaccaaaaccaaagggtccatattggatgctagcttgtagtatcatttttgtgcattctactgagtttcctgtagcattgtatcgacagtttgtattatgacaacattctggtgctctgtgaatgatgattttgttgaggaacagacgtaacatcatgggaagttaaaatactagtaaagccgcatgtaacttctatgacgaacttgagttaggcatacggcgactgggttcaaaaatactatattcctccaaaaaccttagatggcaaaatcattatttcctccgactacagaccattatctagcagatgattattttcccttgaagtataaatgctttgtcatgattttcaacctcatgaaagtgttcatagatgaacatttcgacacacaacacacatgtaatatgtttccatttaacattcaaagaaaattacatgataaagctactagagtacaattttacgacaaaagatccgctgaacttttatggtggataggctgagaaacagggaagtttgaagcccaaactacaaaaagtatctatgctgaaatttttagaagctagctgaaatggccccaagagaaaaatctgaaaatagatttagaaagtaaaaagtcataaagtcagtatcactttcccttttacataactctcataatgtttgctatataatttcattaagcaaattagtcaaagtggaacttctggttacatgttgaatttagttagatttcaaatgaaacactattggaattaataccaaatgctgactccagggatgtcaccaaattctgttctgtcttcaaagttctatcttttgtatcaatggccagcatttaataactatggccagagtattgcagagtagatcagttgtatcctctaccatcttttactttagacacacttgcaaagctaggagaagccaatacacatccagtttccaataatgggggtgggggatggggtggaagatgatgtaacctcaggtttacaacttctccccattttccaacttctctccattttccaacttctctccattttccaattatggactttttcttccctgctctgaaggataggagcttaattactaaaccgtcctaacagttcaaggtgggaaggagaacaggagataatcttgcataaaagaagtcctagaagaggtcatcataagtttcacatgaaatatctggcaaaggtgatcttcagaaaataaactaattatttcacccagagagaggacacacaaagccaaaactgtaggtaagtatggcatgtctgtctgtctgtctgtctcagtatcccccgccctgcttaaatatctctaaagcctatcatctcagcatgtcattaagagaaaaaggaatgggtggaggagagtgacttggttttccaaatttccactgcattttactagcatagtctgataaaatatatttcccctcgaattttgcccccaaccaatggggggctgggggtggtgaagagcttgctcaaatagacagtaggctgggctcctggagtgcccatctttttacagttaacaaaaatgagttaactgttaaaatgtttccccaccattcctgaatttctatgccctttaccatgtttagcatcacagaagttttcattttacttatgtggttagaatattacaaaagaccatttctcttggggtaatacctaagtgacttggcattgaaaagaaatacaacaaaggctatcacttatggcatggtttacccctcttaaaaatacagaatcaaaaaatgtcagggcaaggaaacaactttggatagcatctggtccaacactcctcccacttcacgagaaaacagaggtgttacccagagtctgatggcagagctgggactataagcccagactgcctgattctgatactccttttaccacatcagctgcttccggtaaactgaaatgtggcctctagcacaaccaaatgtaatgggtagaataaatcgtgataacatttcaccttgaaaactattccctgtgtctgcagaaacacactaatggttagacagcaataaggaggcatagaaagagtcacagcaaactcaacccagagggaagtgcacgtttccttgtgctgcgctaaaattccaatgctgggcttcctctcttcatcttttttgtcatagttttaagatacagttcacatgccatacaattcacccactgagagtaaccattcaatggtttttaggatattcacagagttgtacagccatcaccacagtcaactgtagaacactgtcatcacctccctccccagaaagctatcataactcctaacttccatactccatccctaggcaaccactcatctgctgtctgtctttatagatttccctattctgagtatcgtgtaaagggaatcatataatatgtggtcttttatggctggcctggcctttttcccttagtaagctgtttccaaggttcatgcagttgcagtgtgtatcattcctccctgcatttgactgcaatcacccagacccctgcagctcaagctctttgtccttgggatgtacacaaattaatgttggcagatgtgcacagggaaaagacaggagagcagtcatggagcagagacaaaggctcctcggtgcttactgtgtatacttactttgactttgtaaagctgcctcagctttttcaacagttactaacagattttcagaaaggtcttttcttttgctcactattgaaaaaccattccagacatacatcatttcctaatgaggaaaaatgaaaaccatttgcagttatatgaggttattcaatgtcctttatgatccccaaacaatgttcatgtgttttgcttcggtttctaggaacctcaggacaatatttacagatcattttcctttgcttttgccttttatactgtgaagcaattcagtatatatatttttaccaaaaatttaaactcattcatataacaaatatttattaaatatctacaagcatttaattcttttggaaggtaatagaatacagatacagaaataaatattttaaaccgatactatgaataataattctgtttaatgtaaacttttgttgttacttttaagtaaagaaaaatatttttaaatgtctgccagttgtttacataaaatgtttccaagaatatcactggatataaacactggaatatttcactgggcttaggatctttcatacaattagaaacatgtgacggtccagtaatgtaatccaatatgcagaaaacgtattcatttaaaagccatatggctgaatgacagctcctaaaatgtaaactaatgatttctcattacagattatatttaatgggctaccagatgagaatttttttggatcaaaagcaaatgtgcttttgcttgaaaatatttttctaatgttcctgatagtgcagttcgtattttgaagggtatgaagtaagcagggtaattagtatcttcttggaaataaattttaagatatgataaaaatatagcttgaaaagcctcttagcaggaggtagtggaaatgaggacgacacactcaagtagaatggcagcaaaggtatctttatcttatggcaccgaaaactaagatcatgacactctaccttcaattttacatgtaacaatttattgctgctaatagagcaagagttcaattcaataacagaatcttttttaaattgatgatgatcttttaaaaattccttttattgataaaatctttttatcagaagagggcaagctcatatctgagactttatgaaaaacaggcttttggtaaaattcctaggtacaaaaaaaaaaaaaaaaatcccagtactaacatttcaagccaatttcctgtacattctacttccatagacctggagaaagaagtgcagggagttaaccttccctatggttcttaacagtcaaagcaggatacacttacgtatacactggtatctaagtattaaggcaaagaaagatgatagtctagaaaattttctgtagagttctgtgagacagaaaaaccttcccagtgcaaatcacttaataaaaatgaatcaggcatggagctaaggctctaattggttaagcaacagaaggctctcatgtgagctgggagagggagatgtttggttatttgtgtgatttacacagtgttcttgtttttatttgtgctcagacacgattacagagtggtcatatttttgtcttgctccgtcacagtcacagaatgggcctgtctgatgctgaagttctctgagtttgtgttaggtaggaaacacctggacctaggtgctaggcgcaggctaactcctgtctgacccctgtcagggaggggctgcattgttctttctcatagaatgtataaaaggctcccataagtcactaagaaaacaatcaacaacccaatgaaaaattaggaaagaatatgaacaacaatttacaaaagaaaaaataaaaatgaagaaacacatgaaaagatgctccaccacatccacaaggaaatgcaaattaaaatggtaaaatactatcagtacttatttaaattggtagagctttttttgaggggaatttaacaatatctaccaaaatattaaatgtatatattcccttgaaccaggaattccatttttaaaaaacctttcacagagaattatatgcacatgtacaaaaagaggatattcattgcagtgtataattgtaaaaactggaaaaatctaaataactgtcaaagaggaatgatgaaataaactctgaatttaaaaaaaaaaaaaaaactcaggaaaccccagagtggaggactgcagacatcggttacactgaacagctttcctgtgctgactatctatataaaaactaaagcaccagaagagtcatagtaacttgatatattcagtattttttgaagaacacttcattaagaaaattcaagttgaaattgtgtttttcacagaagccttgcctaaatggcataaagtttaagaatgtgagctggagctagaatacaacagccagcagccagttatggctcttgagcactggaaatacagctagaccaaactaagatgtcctctaagtgtaaaagacacactaaatttctaagacttggttcaatatgaaagaatgtatatatctcatggataagcttctattaattacatgttgaaatgacaaaattttgcatatactgggttaaaatatattcttgaaattcatttctatttcctcttacttttttaatgtggctattagaaaaggtaaaattacataatgtggcttgcattagaattcaactcaacttcaatggaatcaacttctttctgtctaaatttcttcactaaaaaatggggctaagagttaactatactcaaaaagttataagaataaaatgatacgtttttagtagcctttatcgtaatgcctggatcatactaactagtcaaaaaccattagctacagtttttatttattaattatttatttagaaatgttcaacttacaacaaaacctacaatggtttttaaatgagctaaacttcataaccaaatttagatatgctccctgctgctgtgagtaggtaatttatttctagtacatgaaaagaaaataaaagcagataccagggcaggtaagatgagcttcacaggtgcaggtaaggaggcggagtaacgccgagccttcctcacagcaaacttctcagtagggatagatttcccggcaattctctgcttcaagctgtccacctgtctgtgaagaaccccagcccagccccagagaaaggtcatggcaacacatacattatttgtacctgtggttttcacagtgaacttcacagaccaccagcagcagcagcagcatcacctgggaacctatttgaaatgccaattttcaggccctactctagacctactgaatcagcaactccagggccggggccgagcaatctagattttgataagccctccaggtgattctgaggcacactcaagattgagaaccactgactgacacatatttctttccagtcaacttagctaatgtcttaaatctatcaaacacagtccaggaaatctaggtatacaactggcgatttctacgagtaagcaggaaagagtccaaagtatttacttacgttgtggatactcagggagagagaagagggtacactggtatatggcctattcctatttgcaagtattacacagatctataaaataatatggctcaaaagacagccaacaattaacgtataatttaagaaaatgtttcccaagcacaggttgtttgggaaataatcagcttaggatgtgtaccatgtttagaaacttccttttaaaattctacagaattccaattatgaaattcataagcaggtaaaaatgacagtaggatggggagactacatgttcctgggagcactttcttatgcataattttatggatgcatcaaacaagttgctgagaaagaattcaaggcaatactcaattacatcactgaaagaaaaaataacatgaaataatatgcctccaatatgagtcaagcttatgttaggttaattccgggcaaaatatggagctatggattttaaactacagtgtctcatcatttttgttcattaccgtcagtggaaaaggcagtggaaatgtgaggtgggggtcagaggaaggggtcagaagcatgtctcagacaggaacccttgtagtttaaaggtaacagcatctttatgaagagaccattcattgttagaactctcattatcccaacaacctagaagctatgacagagcaagacctcaaagctttctcctgaaaataaaaatgatcacatctttcacataaactgttttgatatggagaaaacttaatctgcagtggaagaaagagaaggagatttaaaagattttaatgtatcttaatactcccttccattaattgttgtttccgtaaaataaggaaatgaactttacagtaaaaagtgacatttatcatgccatggcttttactaatgttgatgttgatgctacagttaatatacatggtttttttttggagacagagtctcactctgtctgtcacccaggctgcagtgcaatggcattatttcagctcacttgcaacctccacctcccaggcttaagcaatcctcccacctaagcttcccaagtagctgggactacaagcacatgccaccaggcccagctaattttttgtattttcagtagagatgagattttgcccctttataccctcagagcctttgttataggaatagtgtctcacatacctgaataaagttaccacattctcattcgttgctactacatcctcctctggaagcatactcaaaattgctgctttcaagaacacataagttgccttgagaaaaagaaggagcttattacagaacatccctaggtaaatgacatttctacctttcaaatcaggaatgaccaacaagtcttccagatataaaattagaggcattaaagaaatcagaggaaatgaaatcttatattccctgttcaaaatgacaacaactcttttcaattacccataatttaaaccattttcctattatacaactacagcattcataggtgagaaagtggacagaatgaacaagaaaaaattatctcattgccctccaacttctcataagtggatcagaattaattttcattatcatgaaaagcctgggcatcagggcactggaaagtctacacaaaattatcaacatgattaagatttcataactttataagtacaactcattttcagagataaaacctcatgtttaaaataactctttgttgttgtttgagacagggtctcactctgtcaccaggctggagtgcagtggtgtgatcatagctcactgtagcctcgaactcttggactcaagctatcctcctgcctcagcctcccacgtagaagggactatagacatgtaccaccatgcctagctaatgtttttattttttgcagagataaaatcacaccatgttgccctggctagtatcaaactcctgacctcaagccatcttcctgccttagcctcccaaagggctgggattacaggcatgggccatcgcatttggccctgaaaagaacagtagatggcttttaaagcatgcaatgctgaggacagtacctataaatagtgggtacttaaggcacatttcctccttttgtggatctctaagttgagaaaacactgtggtatcatactactgagcaaacagtcctaaatgaaaatcatcctggccatgtattagcaaacagatgacattaatgaaagtattgcactttaccttggaccatttactctctttgcaaagcagatctgaatagtaatatgcctgcatccagttttgttggaaaacattaatccacattagctcccagtagcagagatggtgaaactgtttccattcttcttgaactgaaatgcatttttgaaatacttcttgtgcctgtaaatcaagtacacaaagttgatcgtccagatattagacaaggagataataacctaatggaaaaatacataaaacacttagtacaaaaaggacaaaattatcactcattaaacctctcaatatgatgatatgttcttttccttacaggcaatgatacagttaagttctgcctctttctttaattttgtgagagggccttgacactttgtaatgtgggagtggggaggttccattccaaggaagatatcaaatgcagaaatcatttaagaaaagactgacaataaagttagaacttccataggacaaaacactgtaggcagagttacaggcaacagacaggaagaagatgtcactatctacgtaactggcaaaaggttaactcttttatcattcatcaatttaataaaattctgtaagaaaaagaaaactcaacaggaaacaggcaaagatgtaaataggcaaatcagaaaaaaatatatagatgacagatatacatgtggataaatttgtaaactaggcaatataaacttaaaaattagattctcatttttagccatcacgtaatgtcctgagccagcaaagagcattggaaaaaaatatttttatatgtttactggagtttacactggaacaatcttaagtgaggaggacaatttggctggatttataaaaatgcaaccaccttttggcccaggaattctactaatcataatctgtcttctataaatgtacctgtgcacagaaatatacatacaatgatgttcacaacagtttgtagtggccaaatgtctatggaccactttaataggtatagtatatccatcccatgaaatgaaacccagccatcaaaaagaataggagacatttaggcatactgatctggaaagagatccaagacatattgtaaacagtgaaaaaaaaatcacagaaaaatacattttgatcccatttgtgtggaaaaaatggtttgtgaatgtatatacataaatggctccttacttttctacttctgacctcgacgcttcgtttttgagggaattcgttttttgaggggtcctttgatacggagcccacacgtagtagacctgcatgtcacacaggggctagattccaaagtcagtgtgtaatgcagaaattggtaacagtcacagtttcttgaaaatccctgagcttgttatttggtatatattaccctaaagtgcttaatgtactctatgtataaatgtagactatattcagtaatccactgcatagattttatataatagaatgtatatacaagttaaaagttttggctttttacttatatatttttttctttatttttgtctagtccatatagccaagtttacttttgttgaataagtaggtcacagcgactcatgtaggagtcgccatacagacaactcccccaaataattcccacctaataaattacctcttcaagattccctttcagcaactctattcgggcatgataaaacaacacgagtgagccctgcagagcaaggaagaaaacacactgttcaacagtcaacactggctgattaattatggttgaaacatacactttgaaatactgagcgtacatttggaaactgctggaggaagggtgccaggagacgctctgcttccgcaacattcacttctcctgtacctagaaatttaacaggaaaagactcagtcttcataagacatggggatatttataaccagctctccaaatttcattaacatacagtaaagacctactcatggaaaagatgaaaactattatttcatcatttttatatctggggaataaaataaagaccagtctcacctataactttagtttaagaaagctctaggacacactaattcttaagaatgcaggtggctgtctcagattcctaattggaatttctggttttaacagcaatattaacttatttagcccaaaatttcattttctgcaaagaaaaaaatctcatatatgataaaatagatcaccttaatatagaaattttagctgagaacagatgaaaattatttaatgaaagaaactaccctactccttctgctaaatgtcactatgacaaaggacactattttctacctttattcaaaaaaaaaagtaaacagatatgaactactagctcttgctgatctttctaaatttttacttactcagattaaaaataatcaactttatgttttgtcttgttttgttttttttaatttagagacaggatctcgctctgtggcccaggctggatccagtgcagtgacgtgatcatagctcaccgcagcctcaaactcctgggttcaactgatcctcccacctcagcctcccaagtagttgggattacaggtgtaacacaccatgtctggccaagacaatcaatgttcaatgaaacaatctaatccagatcttaccaagtattagggagatgtaagtatgaaaagctaagatggttaagcagcacagtgcagacctcatgctccttcctgaagcaccttcacgtaactgcaggaggcccaactcctatgggaattaaatgcatttttagaaagagaacaagactggaaaatcatattcagaaactttttaaacatttttatatattaggggggttacaagtacagatttcatatattacgctgtggtgaagtctgggcttttagtgtccctatcaccgcaagagtgaacatcatactcaacaggtagtttttcaaccctctcttcccccacccctcccatctttggtcaactattaagaaagcataggaaaccacgtgagagtaataagatctagcaagaagcaatattagcaacacataatttttcatccaagaatttggataacaagggtgaacatttttaactttcatcagaaaaactatgtctaagtcctgaaaaacatgatcaagaatcaaaggcttattttctgtcctacaaacaaattgccaataattatcaaggtagttatgcagacatgttgcattgccctcatgttcaataaatactgtcttatcttccctgtcaaaattaacataaaattaaatttgtaccctattcccagaaaatccaataaattctagtagtctgataatccttgctggtaaaagggacagcatctgtaagaaaaaaatatacagtgtacttatgtgttagtgtttctaactgcaaacaaatctaaactaacaacttacagttttaatgcttcaataacatgagaaattgggaacaagttttaaccaccagatatttctgttaccacatactgtaacaatcatttatgaattaatttcatttagctaagacaaggaacctttaaaaagttttttttaagcctggtctttccagggttctctatagaatactgggacctttgatgtggtgtgatgaagtgacaagaaggtaacccctcaaagcccacatccaggcaaggtttcttagtttcctttcccagaagcaaaaatcagtcatagtctgtgtgatgtgtagacaccacccagaagtggacagctgcagcactaccacttctctctgggatattcctgaaggacagtggtgagggaatatccttccagtgggcagaaccctgggcagtgcacctggttatgcactatgcttgaaaggagaaatggccagatgtgcaattatatgctgattcaggggatgtagacaatggtttggttggaagggcaggggcttagaaggatcatgattggaaaattggtgacaaagaggtctggggaagaagtacgtggtcagatctttctgaatgggcagaaaatgtaaagatatttgtgtcccatgtggatacacaccaaaggatgaccttagcagaagaggattttaacaaccaattggataagatggtccattctgtgggtaccagtcagcctctttcccatttatcaccccacaggctataagcaaagtggccatagtggcacattcactcatgtgtatacttctcttgatcactttattttctcactaattccagtgaaccatcaataaaatttaaaaatctcttaatcacatattggaatttgacagattactactcagacttccatctcctcaggaatcatcaaaaatcattcctcaagttatactggtccctcacacattttcaattccagagccgtcattgtcattgcaacaatatttctgctgtggaaatggaaatggattccactgttccttgttaccaaaaaccttactagtctattcagagtaccacacgcttcccttacattttacaatccaaagctactctgagcatgtgtggaactttataacacactgggtcacaatgccagaaaactgatcccactctagctgtttgtcaaccaacccaaggaaaggttcaggatgaggttcaaatgcagtggagaaggcacagaaaaccttaggttcttctacaaaagttctggtttctatacagtgatttccttaccaaattaaaggccccactgccaagcttgacacccccttcaaactcatagaagaattcctgctgaagtttgttcttctgaatttcatgcaggatagaaagacattctctgggttgaagaaaaaaagtgacagcataagttgaccatgactctgaaaataaatattaaatcaaattttacacttatgtgctataaaataaatgtcattaattaaaataccatcaaaattttaaaggatgatgctgtgctgagtttactcttaaggatactaggtaataatcatcaaagaaaaaggagatgctcatttttacagtgtctagcaggaccagtgtttctgggcttaaagagagggttcatccattggcaagcaccagccaggagccgcaggaccacaggctgccatcccacagcttccggcagcatatcacagcggactccctgcaagcgctcagctcctccaccactgcacacactgcagcaacctgaggaaatgaaatgctactggcaagaagatctgaatttcagtgtgactgccatcgtctcaaacagaccaaataaattagggcttgggaccaggacagactgaaacaagaaagcaaaggccatcacaatggccccatctgtcctctgctttcttcctgctccagccatgaaaatctttccaacttctcactttactttctatgtatttctctcttgcctgttcacatcatcttcaaaaggcaaatatttaaccaaagaaatacaaattaaaacaatgacaaaaatataaaaattgataatacctgggaattgcttattaaattggcaaatatatttttaataataaggaataatgagatatcatgaatcacttggtgtgatgcaattataaaatgtgcaactacacttgtgatccagtctagccaaatatttttaatctgaatctagcaagcctatagacctaacttccagtttacaaaaaatgtaagggtttagagagtcaattcagatgcctacaagcatcccctgctgtcatttcccctgggtcatttattttttattatggtgcattttgccaagataaaatgatgaatgtttatttggtcagctcaatcaatttcttctgatttctgattttatgccatagttaaaaggcctttgaaactgacatcatgtacctaatgatatcatttctaaggtatttttgccatagagtcataatctgaatttaatcatgaagaaacattagaaaagtccatattgaaagatgttttactaaataattggccagtttattcttttaaaatgtcaacatcattaaagacaaagactgaggaactattccgaatgaaaagagactaaggagacatgacagctaacctcgatatccaggatcccgggttggatcctgagccagaaaaagggcattgatgagacaactggagaaatgtgagtaaaggccatggagtaaatatgaatactgtatccatgtcagtttcctcattttaataattgtactgtgcttctgcaaaatattaatatttgtaaatctgagtgacgatttacaatcttccatacaagtgatggaaattttttgtaataattttcaaattatttcaaagtgaaaaaataaaaaacaaaaaagtttaaagcctttatatttaagaattataaaagtactttcttatgtttcctgctagaattctttttaaatcttttaatattaaacctatatggacttttttcgtcttaatgatttttctataaaatgaacaattttcccaaaaacatttactaaagtacctatctttcttcactgttttgaaagggcctatctatataaaggaatttagtatattttgaattcccaggtaagtatgtgcgtgtgtgtgtaagtccatgtgtgtgcacacacacacatgctgtctctttcaaaaaaccctgtggttcatttcactgatatgtaaaggcataccttgttttactgcaatttgtggatactgcattttttacaaattgaagatttgtggcaactctgtgttgagcaagtctatcgatgccatttttccaacaatatgtgctcactttgtgtttcagggtcacatttcagtaattctcataaaatttccaaactttttagttattactgtatctgttaatggtgacctgtgatgggagatcttaaatgttactattacagtaattgtttcagggtgccctgaaccacacccatataagagcgaaagttatcaataaatgttgtgtgtgttctgactgctctactgataggctgttcctccatctctctcctcctcaggcctccctattccctcagacaaaacaaaattgaaattaggccagttggtaactctacagtggcctctcagtgttcaagcgaaaggaagattcgcacctctcatttgaaatcaaaaactagaaataattaagcgtagtgaggaaggcatgtcaaaagccaagacaggctggaagctaggcctcttgtgccaaacagttagtcaacttgtaagtgcaaaagaaaagttcttgaagaaaattaaaagtgctacttcagtgaatgcacaaatgataagaaaacaaaacagccctgttgctgatatggagaaagctgtagtggtctggatagaacaaaccacccacaacactcccttaagccaaagcctaatccagaacaagaccctaactcttaaactctataaaggctgagagaggtgaggaagctgaagaaaaaaatgttggaagctaacagaggttgtttcatgaatttaaggaaagacaccatctctataacaaaaaagtgcagccgggcacggtggctcacacctgtaatcttagcactttgggtggccaaggtgggcggatcatgaggtcaggagtttgagaccagcctggccaagcatggtgaaaccttgcctctactaaaaatacaaaaattagccaggcacggtggcgcacacctgtagcctcagctactcgggaggctgaggcaggagaatcacttgaacctgggagacgcaggttgcagtgagctgagatcgtgccactgcactccagcctgggtgacaaagggagactccatctccaaaaaaaaaaaaaaaaaaaaaaagtgctaagtgaagctgcaagtgcttatgtagaagctgtagcaagttatccagaatatctagctaagatcactgacgaaggtggctgcactaaacaacaaattttcaatgtagacaaaatggccttctattggaagaagatgctatctagaactttcatatctagagaggagaagtcaacgcctggcttcaaaacttcaaaggtcaggctgactcttgttagggactaatggaactggtgactttaaatggaagccaatgttcacttaccattccaaatatcctaaggcccttaacaattgtcctaaatctactctgccagtgctctataattaaaacaacaaagcctggatgatagcacatctattcacagcatggtttactaaatattttcagcctactgttgagatccactgctcagggaaaaaaacatttatttcaaagtattattgctcactgaaaatgcacctagtcacctaagagttctgaaagagatgtatgcaaggattatattgttttcatgcctactaacacaacatccattctgcagcccatggatcaagaagtaattttgaccttcaagtcttattatttaagaagtacattttataaggctattgctgccatagtgattcctctaatggatccagggaaaggaaacagaaaaccttctggaaaggattcatcattctacctatcatagagaacattcgtgattcatggaaggaagtcaaaatgtccacattaacaggagtttggaagaagttgatttcaaccctcatggatcattctgaggggttcaagacttcagtggagaaagtaactacagaggtgttagaaacagaaagagaactagaattagaagtggagcctgaagatgagactgactgctgccatctcatgatgacactttaatggatgaggagttgcctcttatggatgagcaagaaagcagtttcttgagatgaaatctattcccggtaaagatgccacaaacattgttgaaatgacaacaaaggatttggaatattaaataaacttagctgataaagcagcagcaagatttgagagcatggatctaactctgaaagaagttctcctgtgggtaaagtgccatcaagtggtattgcatgctatagaaaaatcttttatgaaaggaaaagtcaataggtatggcaaacttcactgctgtccttttgtaaaaaattgccatagccaccccaaccttcagcaaccaccaccctgaatgtcagcagccatcaacatggatgcaagacctccaccaacaaaaagattatgacttgctgaaggctgagataattgttagcattttttagcaaaaaagtgtttatcaattaaggtatgtatattttttagacataatggtattggcagacttaacagaatacagtacagtatcaacgtaacttttatatgcagcaggaaaccaaaaagtttgtgtgactcactttattgcaatagtcactttattgtagtggcctggaacccaaaatatctctgaggtatacctgtatgtctttgcctctacagtcctattttaatcctttagtatttttaggttttgatgactaaaacagcaattagcattgaatttaacattcgtttataccttctaaaaatatttcacaaagaaatctatacaacagcatgtcaggtacccaagatctaccacccccttccaggattttgaatgaaacacagttttgtgaaaggattttcagtgaaagtacctcttaaaatactaaattttggttctgctaccagtaatggtagggtagcttatgtcagattaactttcccacaagtaactattacaaattgtggaaaaatcaaaatatacatttaaaacatatttttacacagtggaaaatgaagggaaaaaagtaggagtctcaggagagaagaaagtaagaatggggcagaaaaaaaaagtttgaaaaattatgaccacaaatttctcaaaaccacacttaggcacatcatagtcaaactactgagacccaaagatacaaactagtcaatcttcaaaaaagccagaagaaaagacacattatatataggggaacaataatacaaatgaaaaactgaacaacacaggctttaatacaataggacgccagttttaaagggctgaaagaaggaaaaaaaacccatcgactcagaatactatagttagcaaaaataagcttgaaaagaaaaagtaaaaagtaaatatattttaagataaatgaaaacagaatttgttgaaagctgacaccctctaagaaatgctaaaggaagttctttagtctgaaagtaaacaggaaatatatttaccattttgaataagaatatgaaaaatggtaagaatatgggtaaagagagaagactacaacatataactgattaaagagaaagtctgacaccgcattgtagggtttaaaatatatgtaaatctgctatacatcataaaaatagcacaaagggccaggcgcagtggctcatgcctgtaatcccagcgctttgggaggccaagacgggtggatcacgaggtcaggagttcgagaccagcccggtcaatatggtgaaaccccgtctttactaaaaatacaaaaattagctggccgtggtggtatgtgcctgtagtcctagctgctcgggaggctgagtcaggagagttgcttgaacccaggaggcagaggttgcagtgagctgagatcacaccactgcactccagcctgggcaacaaagcaaggtctcggtcgcaaaaatatatatatatatatatatatatatcataaagggcaaaatgtggtaaatgaaattacacttttgcaaacttcttataatttatgtccagtgctacaatattaactctaagttgactgtaataacttaaaaacaatattataaacactagagcaaccacaaaaaaattagactacagctaagagaacaacagttctaaaaatgttattaaagcaaaagaagacaggaaaaaagggggagagaacagatgaggcaaagagaaaaagcaaaatggtagtcacaagtgcaaacattcaactgcccagctatgtgaatctacaagaaatacaatttaaatatttaaaaatacaatttaaatatgaaaacaaaaataggtttaaagtaaaagaatatatcccatgcaaagactaattataaaaagcatgagtgcctatatgaatattagacataacagatttcaagacaaggaatatcaccaaagttaaatagagacatttcaagatgatgaaaaggttaattcattaggaagacagaagaattataaatacatattataaaagcctaacaacagagctcctaaatatatgaggcaaacactgacagaactaaaggaagaaagggatgactccagattcaaacttagagcctttaacactctcagtaaataacagacaactggataaaaatcaataaggatatgaacaacgctacagccacctcagctgaacatttccatctattgcagaaagttctactgggcagtgctgctctggagtctgaaccaaagatattactataattttaaatttataaactgttctaaggagagagaaaactaaaattatctaatcagaaattatgtcagtagctttattttcagctagctcttaaaattgtatttaaacttaaattctgttgtcctataacactgaatacacactcaacaaaaaattaagttcatttttaccaacaccaaataaaaaatcctagtcaggccaggcgcggtggctcacgcgtgtaatcccagcactttgggaggctgaggcgggcggatcacgaggtcaggagatcgagaccatcctgactaacacagtgaaaccccatctctactaaaaatacaaaaaattagccgggcgtggtggcgggcgcctgtagtcccagctactcgggaggatgaggcaggagaatggcgtgaacctgagaggcggagcttgcagtgagccgagattgcgccactgcactccaacctgggtgacagagtgagactccgtctcaaaaaaaaaaaaaaaaaaaaaaaaaaaaaaaaaatcctagtcaaacttaatttaggagaactgtgaagaacaaaggagtacacagcacaaaattatttacaaaccacatcttactttttaacttacttatatatttggtaacttgttctaattttgagtccacctttgatgaagttgatcatattttcatcctgaaaataattcagttaaaaaattagattatttagcaaaaaattttaaattgtccccacagttgtgtgtttgtgtgattagaaaaacaaaaacaaacaaacaaaaaaaagtattttgaggacataattttgaaattaacacatactcttgctttacatttaaaagtttttggggtaatttttcttccacattagaggacaacaaaaagaaaatacttgtaaaatccttcgattattttatattactaaggaggtaatcctcaccaattaggggccatatgcggtccaaattattttaataaacattgacatctactgagcaattttcttctgggtttaacagaatgtaaaatggatgactttaacaatctgctctaaggccaaaccttccagtacattacacccagtaaatgggacaatggtccttctttcacagagtactttagcagtcagagtctttttaatgttgcgaattttactcacacacatttctaggcccaaaataactggtctggtttctgaagtggctgtcactactacacaattttgttttaggaaaacaacaccacttcaattctgtttatctgattgtcatcgaccataaaattgaggctgttggcctagatgaatggcattttcagggtcagcattctaggattctaagacaataaattacatcaaataaccacttgaaggaagttactctaatagatggtactagtggagacagtcctacgttttgcatatccagagagaaagtttttctagtctattgatatcagaaagatgctctggctgggcgtggtggctcacgcctataatcccagcactttgggaggccgaggcgggtggatcaccaggttaggagatcaaggccatcctggccaacatggtgaaaccccgtctctactaaaaattcagaaagtagccgggcatggtggcgggtgcctgtagtcgcagctactcaggaggctgaggcaggagaatcacttgaacctgggaggtggaggttgcagtgagccaagatcgcgccactgcactccagcctggtgacagagcgagactccatctcaaaacaataaataaaaagaagaaaaaagaaagatgctctgatatgtatttctcgtgtacttaagcatccttctgtagcaaaagaaaaactgaatttcatttactaatttcattaattgcttaaatatttaatgttctaattattataagaatcaatagatatgaaattcaatgtttatcttcttaaattaaggaatcttatgattacataaaatccaataccaaccagaaaagaatttcttaaattagcttgaaatatacctcaaaaaaaaaaaaacaaacatatctcatttcaggattcatcaaacttaaacttaatgcctattttataccaggcacccaaatgcaaaaacagatgaaagtaatacaatatgttaagggagggcgtcaagcacggggagggagccatgcacggggacgggatcatgcatgggatgtcatgagaacacaaagtagtggcatggaaagggccagacatgcctcctggaagcattggtgctttaagcacaaaaataattagaaactggacaggtatagaaaggcaaagcagatgtgaattttgtaagcaaagtaaaactcaagtggaaagacagggtggcattaaggatcatgatgggtttggccatgtgtgcatatgtaattccacactgctgaagaatctattgcaaagagaatgaccaaggagttaagaaagctacctccagccatgctactcaagtatgcaaacccgtcagtggctttcaaggacacctgtaaggtgcggggggcgggtagggaacatagagaggaggtaccagttttgtttgaaaaagtacccccctcatttgtgacattctgatacagaatactgccatactcaatcaatcagagctactgaatgctgaagcagagaagtgaccaggtcagagactcatttttaagaggttactcaaccctcaactgcagaatagggaatgagctgaaggtaaaagaaattagagagggagagtcactaggttgctgtgcagtccagaaaagagtagataagcacttcttctagaacaatgataggaagagacggagctgcacaatctttaaaaggctaaagcagcatgaatataaaggtgactgggtgggagtcatgaggaagaggggacaaacatggatatctctttaatttcaaatccccaaatataaaataagccttcaaatcccagatttgattgccaaatccctgtttggaaaacagaaaaaaacttgggcctccatgactatcattatgatgcttactgaggcagtaagactgttgttatcaaccagtctttgtaatgtctgggttttaggaaacagggtcatgggctacagtgattccgttttactaaaccagaatccaacccaagaggtaaacctccaggaaaagaaagaagcaactgtcaaataattcaaaagattgtggctgggcgcagtggctcacgtctataatcccagcactttgggaggccgaggtgggtggaacacctgaggtcaggagttcgagaccagcctgaccaatatggtgaaaccctgtctctactgaaaatacaaaaattagccaggcatggtggcacacgtctgtaatcccagctactcggggggctgagacagaagaactgcttgaacccaggaggcagacgttgcagtgagccgagatcatgccactgtactccagcctgggtgacagaatgaggctccaaccaccctgccacccctcccccaccaaaaaaaaaaaaaaagattgtgagtgagggaagattttccatttcacagctgaatttctttctgatttcttacaatctctaccccacctcaccctcactgtagccatcactaccacccatgaagccattatgtgaaagtttatgttttacagaagcattggaagatacagaaataggcaaggtactgactgtatcagttcccagaggtgaaattaaaatggatcataagaaaaggattgtttagtgacttctaaaaactgctcttccaaaggaagaaataaaagaaaggagaatgagaatatagaaagaaggggaaaaataaaatttgaagtatacatgctatgcatgcataactgaacttgactgaggcaagtggtgtaacaggggacacttcctctgcccgggccactcccatgtgcggactctaccagtagaaagcgcaaaggagaatactctcccggtttccacacagatgcatcttaaaattagatgtgacggttgcaaagcagtttctttaaagtttcttttttgtttttgagacaaagtcttgctctgtcacccaaggtgaagtgcagtggtaggacctcggctcacggaaatctccacctcccaggttcaagtgattttcctgcctcagcctcccgggtagctgggattacaggcgcccgccaccatgcctggctaatttttttttttttttgtattttcagtagagacagggtttcaccatgttggccaggcttgtctcgaactctggacctcaggtgatccgcccacctcagcctcccaaactgctaggattacaggcgtgagccaccctgcctggcctaaagtttctttaaagacacagtctttaaagggcaatgattcccagtggagtgcaatttgaaatagattcttaagtgcagtagaggaggaacaaagctctctagcatcttttttcagccaaagtttatcagaataacaaatatttgccattacaactctaagtcaaaagaactgaagctttgacatagaatgcaccacatttttctatgcagcactggcagtcttcccagccaatacgaattccaagccaaatattcattacctgcacaaacgtgagtgcagctttctgtaggagacactcggcataacagatttcagcatgcatttcctctacaaaaaacaaataaaattatattaagtaaaatcacacatccaaagtgattgctctgtgatgttcaggaaagactggcagaaaaatgaacccaagagagaccccaaaacttagattgcccttgtgcttccacaaaagtggaatgataaccccagttctcactttgtcaggaagattttcctggaatgtgtgaagtgttcagggaagtcatccccattcaaatgtaactgcaaagagtcagtcacttcgtatcagagacgcaaactcaactcacaaggggaaatgaacatttaaaagcacttttttaaaaaaggaaaccacttattttttaacttaattagtaacataaaactttggctgtgcgtggtggtttacgcctgtaatcccagcactttgggaggccgaggtgggtggatcacctgaggtcaggagatcgagaccagcctgaccaacaggcagaaaccccatctctactaaaaatacaaaaattagccaggcgtggtggcacatgcctgtaatcccagctattcgggaggctgaggtaggagaatcacttgaacccgggaggtggaggttgcagtgagccgagattgcgccattgcactccagcccgggcaacaagagtgaaactccatctcaaaaagaaaaaaaaaaaacaactttcacacagttttaaaagttgaaaaaaactaaattaaatgtatgaatgctagcttctaaaatatgaaggtatggtaaccatgacactaaccagacacattagctacctgaaaagaaagcagcaattctctagagctcggtgaaaaagaaatgtcctgcacggccacgttaagactcctcacacatgaagacctgatatagaaagaggtagcactaccccagtttcaggctaatttgatcatgtagatgtctagcacaagaacaaggtactcacaaaaaggggttaggtggggctctgtgcatcccagggacctgcggagtaccccaaaacacacaccctagcttcccaaccaaccattatacttgcagaggatggagagacaaacctttacttttttccatacacaagtcagcagattcttgctctatccatgggatgcaaagtggcatgatatttaagtaaacgagcctggggtatttaggagcctgagctgctaaaaaggctctgccatgtacgagctatgggacctcgtcccctctctgctggtttcctcatttataaaggccactaacgccgcctctagttcacagctgaaggatcaaatgaagtgctgcacatagagctcatgatacagagtaagcactggatcagtgctaactacgtgcactgagattactgcccatgatccgtgtcactgctttttggtaaaagctcagaaagaagaaagcatttttatgtggactgtgactgaaaatagggtatttcttattattgggattagtgctaaatagacttagatgacaacaagtactttcttgcacttatacacatagatgccacccccaccctacacacacatacaacccactggttctcataaattggttcaagttcctgccatgctcatattccaatgtttaatttacaaagaagcacctctgcagctaaggtcttcaacagtacacagaaagatggggccaaagccattaacagaccaaacttgaggagttagagcctgcacatccacagtcagggtctcagtccttcagaacacctctcctcaaagtgtgcctagtgattttctagctgtgttcagcgggataccaactggtaacttatttttacccagtcacctgaatatcctcttcctaggtaattctgtaacagagtgagaaccaggaattatgagctatgaaagtctgctcaggaatacagattgctggcttggggtacatgcagaggggatgaagtccgtggtggtgatggcagcggtgggggagccggggcggaggggactgtgctggtaacaggagcaaggaaagccaagagcaccttcaggaaaagccagtcaagggaggagacatcaatgaggctggaagggctcagtcaaggctcaattataagtggccttgaatgttagagtctgcacttgattcaggaagcaacagtgagtcagtccctgcagagatctgagcagacgggtgggcagatcagggttaagtgaaagatgaacaaagttaagagcagcatggggatgtgacaacaaggcagacagaaaaggcatgagagtttgaactttgtattctgcaaataagtatctgtcatattaaatccctttcacatcccaggcactcattgcatttaaatatctgtttgtaaaggcaatttgaaacccatttggggcaatccgccagccacaagagaaaagaactagtatgttccacattaaaaccatgaaaagtttaatgaaatatactcactcctgtagacaaccagacactcaaggatgtaaatgaaaattaccaagaggaaaaacaaatcacacactaaagctacaatgttttgacatgctcccttgaacacaaagtctgtttgggttgcagttgacagccaaactcactaagaataaaatacagcttaatttataaaagtcttattctttcactgtggttgatttacattgcatagttctttagttctcaaaattagccattaggcacttatgagtaggtaactaccagaatatctcttaattataaattccttagtccacaggagtaaatatcttcatgatgcactgaaataatgttagctaagctaaataaacttagctaaataagctaagtttatttagatatgaaagtctaaataaacctgtatttcataataggctatagtcacaagtttattagtttattttttttatttatgtagagacaggttcttgctctgtcacccagggtggagtacaggggcatgatctgcactcactgcaacctctgtgatatggttaggctttgtgtcctcacccaaatctcatcttgaattgtaatccccataatccccttgtatcaagggtgggaactggtgggagatgtttggatcatgggggtggtttctcccatgctgttctcatgacagtgagtgagttctcacgagatctgatggttttataagtgtttgacaagttcctcctacacgcacttctccttcctgccaccttgtgaagaaggtaccttgcttcctctttgcctcctgccatgactttaagtttcctgaggtctccccagctatgcagaactatgagtcaattaaacctctttcctttataaattacccagtcctgggcagttctttagagtagtgtgaaaatggactaatacattccacctcctgggctcaagggatcctcccaccttagcctcccaagtagctgggattacaggcacaagccaccaggcccagcctactttttataattagtaaaaagtaattttctaccttattccagatttcctaaagtgccattgttcaaagacattataaaaatataacaacacagtatcatctattttcaagatgactaacacagaaataattcattatttccttcatccgtatatgacacatttcatgcccttctctacttgcctataggagaaagtgtgggttacagtgaaagagttgtggcttagggaaaggcagatgatcagttaaccctactctgctaggtggggaatcctggccatttgtttataactctgatcagttccaagtctacaaagaggaggttagattggttaatgttaagaaaagcaacaaggacagtatatagcacatacaggatgctttttaaaaatggaggattatcagctgggcacggtggctcacacctgtaatcccagtacttcgggaggctgaggcgggcggatcacaaggtcaggagattgagacatcctggctaacgtggtgaaaccccgtctctactaaaaatacaaaaaattagccaggcgtggtggcgggcacctgtaatcccagctactcgggaggctgaggcagaagaatggtgtgaacctgggaggcggagcttgcagtgagctgagatcatgccactgcactccagcctgggcaacagagtgagacttggtctcaaaaaaaaaaaaaaaaaaaaaggagcattatcatcttatttttcaaattattattattatttttgagacagagtattactctgtcacccaggcagaagtgcagtggcgcgatctcggctcactgcaacctccacctcctgggttcaagctcccgcctcagcctcctgagaagctgggactataggtgtgcgccaccatgcctggctaatttttatatttttagtagagacggggtttcaccatgttggccaggctcgtctgtaactcctgaccttgtgatccacccgcctcggcctcccaaagtgctgggattacaggtgtgagccaccacacccggccaaattattattattatttatactcatacaaaaaataccatgtcattcatgccaaaatgcagctaaaaaaaatctcaaatatcagccttcatactaaaaggaaaaagggaggcagaggtcaatgggccactagagggaaaccatagagagagtaacagaaaggagaatacaacaaaaaggttcaatttcttttgggcctatttgatttctcattaacccattttagtgaactttaggtctaacgggactaatttacataagcagctcaaagatggaaaatatgcagacacattctatccgaagtcaagaggataaatacattcttacaaatagttggaggtcagtttctggagaaaaagatgatgggtttcagctgcctagaatgaccaatgaaatgccattctgtttgaccatggttttggggtcaacatcatgcccctttgaaataagtcccaaagatgtgaaatgtctcataattcctctcctataatcaatactctagcttcacatcatgcaaatgttcccaagttctccaacgtccataacaagttgataatactcatctaacaaaataaacaaaacttcctaataaaacacactcaaaaatatgtctgacatacacttgaccattagaaactactctgacagcaatatccagaattgctcttgctctaatcagccaaagctacttctagtagctttgtattttgtgttctctagtatggtatattctagtattttgtgttacctcttcagagaacatgtttgacaatggcaatacaggcacagattctcctgggatggcaaaagctttattctacaatagtgacatttgaaggacttttttttttccttctacaggaatatttagatgctcctttcttgtaaactattgtggactagagtgtaacactgaaaagacagaactgatcatgaaccttctgccctagtcccagggggcacgtcaagcaattgacagcaacaggggtcatttcctcccatctatctgatcagggtgccgcagccagccattcctggattcttgaatattcctaaatgtccacaaaccaagcatcttccatactgtgaaacattatcatttttaaaagatatcaaaattactttcactttgaaaaaaatgtttaatagcttgtggaaaactgaaactctcaaagatgaatgctaagaatataaactgacctatatgtagaaaaaaactgggaatacctataaatattgtaagttttcaaactgtcagtcctggttcttccacttttaggaatctatcttatgaaataactttttaaaatgcatgaatccatatgtataaggattctaggacaccattattcatatcagtgaaaaaataaaaaccatagagaaaagccaagtaaagtacagtatatcaatcctatggaataccacacagctgttaaacactcacatgtaacgatctggggaagtgtcaatgtcaaattcacattgtaggacaacacctattatgtgattctatgcttgcaaaaaaaaaatgaacaatccatgagcaacaacaaaaaccttatgtgtaccttatttatgtatttgagtatgtacacagaaaaggcttcaaaatgaactattaacaatgatttcttccagagggtgagtatgatagggaagagaaaaagacattccatttactttatatacttcaggatggaattttatgagatgatcatttaactattaaaatcaaggaaaaaagtgatcttttaaatgacttttaccttcactcagttgctccagggatcctctagaaagaagacttgagaaagattctacaactgtgtattttttcctgtatctacattgaataaataaaaagggagatagaaaatagaaaaaaaaaatcaggctgagctcattttcatttgacgttcatttcagtcactatcacaccaaagagtcaaaaagctgaaactctaaaccctgaagtctataggacacagatcatccttttccaacactctacatgcagcactggctagccatttgtgggaactcagtctgtgctactgaacaccacgtggggaaacccacacacaccaatgaaaactaacctccaaagtaccttcccttatccctataactaaaatcagtatttgtggtaaaattctccacaggttaaaaatgaagttaaagtgcaatatttggaagctctcttcatttgaggagcttacaacacaattacatcaggatgtaatttcacccatgttaaccttctgatcatgaaccttctgccctagtcctatggggggcacatcaagcaattgacagcaacaggggtcatttcctcccatccatctgatcagggtgctgcagccagccattcctggattcttgaatattcctaaatgtccacaaaccaagcatcttccatactgtgaaacacctatcattttttaaaagatatcaaaataacttaccccttgaaaaaaattttgatagggtcttcctatacacacaaagtaaagcttaaaataaaactaaaaatctatctcattttcaccaaacaaaagtgttcaaaaacaggtccttcttaaacaaataaaacattccctcatgaatttgcatctcccacttaaaacaagaatgttccttgtgtggcttggtttggcatgcagtacctaatgtcatctacattgagagatgcttgctgctaatcccactgaaatccccccgaaatcccccccagatctctgtagctcagaccccaggctatcaaaaagaaaagtggaatatgtagatgccaaatgggaatccttcagcttcgaggctgaatttcttttctgtaactgtggccaatttcaaacacagagcttttggtcaggcaaatgacattatttttgtcacacaggcataaaagtttgcagtcacatcttaagtatttaatgactcgtcatacttttggcaggtttgtaaagcgtccttcatggcagaaatgccgttctggatgtcctgttgctcgaaggtcaggacagcctgcaacaccacaatggtactgtagcccaaggcatggtacatactctccttagccctgggaagaacacagggaattcagacattttaattcaatggaaatactgatcataagaaatcctagtaaatgcatgtcctgacttgcacagtaacctttattccttcaccataatcactgaaattatatgggtggtgaaaagtaacctcttaaaaactcaagtaccaaggactttccaatgtaaacccacacaggcagaacaaaatgttccaggttgaaggggacaatatgcatttccctatttcaacacaagagggcagcctgcaggcagattgcaagcaaactgttttctgttgaaaaaggggcagcacacggcctttggctctgaaataagtgctaaaataaaggccgctggaaatgtattttttgacagagagattctgatatattttttcaaaaataaaggcttatataaaataatccctctcctcgccagccaaaggccaagagcaaacaagattttggaataagttaggctggtcacaagagccatgaccaaagtagttgtcagaccttgtatctagtctaatcccattatctgaagttcctgattaaagttcttgatatttcaaatcatcaagttacagtgagaactgcttcaggattcttaaggatgttaactagaactagtcctaatagatggcagacatccagattctcgggctatgagaacatcatttattttctcaaaacttcttaagctgtattaattatttataaggtttaaaatggtaatgcatggttttgtttttaatttaaatattaatgcataacagcctgctgccatgcaaaacaaatgcaagccacattattctttgcctccatggaaatagtctaaacatcctttggtaatttgcagcttgtcctgaacattgagggcactatctgttcaaaagaaccacaaggaatcagagcagcccaaagttaatcattaattgtggtttcaaacctcacatttttaactgaaagctctttcaagaagcaaaaaaaaaaaaaaaaatgattcaagtgagggaaaagtatttttatttatttaattttttttgagacagagcttcgctcttgttgcccaggctgaagtacaatggcacaatctcggctcaccacaacctccgcctcccgggttcaagtgattctcctgcctcggcttcccgagtagctgggattacaggcatgcaccaccatgcctggctaattttttgtatttttagtagagacagggtttctccctgttggtcaggctggtctcgaactcccgacctcaggtgatccatctgcctcggcctcccaaagtgctgggattacaggcgtgagccatttaaacactgaaacatgtacaaaaatcggagactaacctgactgaacacaacactaaatcacctattttcattccatgttatgaccagctgtgtgtcagtggcagagaaagactcgtttgaataaaaatcaaaggagataatggatacaaaaatacagttaaatggaagcaataacttctagtatttaataatagagaaattataattaacaataatttatcattatttcaaaatagctagaagagaataattataaatgttcctgacactaagaacagataaatgtttgaggtgatggataacccagttaacctgatcgatcactgaacactgtatacaggtaaggaattatcacatgtactccaaaaataggtacaactatggctcatcaataaaagcatttaaaaacccaaagaagacaggcaagtaggctgagaaaagagaaggagagactgagagagggaaagacaagcagacaaaaggaggtagagacaggagacaaagaagtctgagggacagaggaggacagaaggaaaaaagcagaggacaggcaaggtggagattgtgaggcaaatattgaagacaacactggaaaatttccttagactacagggcttcattatcgatttcatcatttgttcttaacctgtgaaacaatagctgacccatcttgattacagctattctaaatcttaacacaattaccatagcagctcctcagcaggtcaatcaatctctaagattcacatgaccagagtccagtcaccctggtaaccactcaaagtaaggaacgagattgccgacttttatgcccaagtaatcttggaaattatcatatgaggtctaagcttcatctaagcaagtgtttgagggcacaatgtacgattattcttgtcaagacaaaggccgagtaaacaggcaagcacaggttttattgccacatctgaaaacttaacaggtactattaattgaaattaaattgcttgtttttcgaacaaatagagaaccccaataatagtcttcttatcttaaatttcttaatagcattgagatcagcatattctggtttttcccctccccatttcaaaggaaaattttctcaataatatttaaaaggaacaaacataaaaacatttcactgaagaaagcaaaattgaagccttataaaactacttataagatgacaatatctgaacaagagagattaaaatatgcaaaacaatcagaaattttctattaattatatttgaaaactcagatttctaaattgaattttaaaagtgaccaaagtaaagaggtctgaactaaattagcttatcaatattcagatgggaacagctaaattaatttacaagcatgacatcaaagaatcatcagaaacatctgaaagatattttatctaaaagagacaaagtaaattaccaggggcgaagcaattctaaggcgtctgtaaatttgttgcttagaaataagttcaatgccacagcacattcttcgaggccactcttgagatccaccttggttgatgatgaactaaagatcaagaaaaaagcacagagaatttctatagctttacgatcagcaagttgtccgaagggagtgtgtgtgtgtgtgtgtgtgtgtgtgtgtgtctgtgtgtgtgtgtctgtgtgtgtgtctgtgtgtggattctggagacaggacaggctggttatacataggaaaaaaatgtgcttcattggaaaaccatgcactgttgagactctagaggagacctctacaggtaattagattctgattctcagggaaattacaactctgtaaatcgtaggtaactaatagcagtgcaaaataactgttgtctataggcatgttaattttgtcctggccagtagaggttcaactaacttccctccccgaccgtggaataagttagttttcctgaatttgcatattaatttcaacagtactttacttcacagaaatttgttctgttttgatttctcctttgaacctgttataacatctgccaaatgtcctcatctataattaataatcagtgattaaataaaatccttaacatgttcatttttgtatctatatgagtcatgattttatccttttttgaaaattatatattaatcacttatgattgacagagattttgttctttaaagccatctctaaaatgttttgtgtaacgacttgcaaaagggaaatatttcaataagtaaatgagcagtaggatgatttggcaaacaaaactgctgataagaaataaaccagcacgcatgtttggctcatgcccggcactttaggagactgaggcaggaggaatgcttgaggccgggagctcaagaccagcctgggcaacagagtgagcactcgtctctataaaaaagtttttttaaatagccaggcatgtggtgtgtgcctgtaatcccagctacaggcattgcagtgggaggatgcttgagctcaggagtttgtggctgtagtgagccatgatcacgccactgtactccagcctgagcgatagagactttgtctcaaaaaaataaaatgaggctgggtgtggtggctgattacaggctcaaagtgcctgtaatctcagcactttgggaggccaaggcaggtgaatcacttgaggtcaggagtgagagaccaccctgaccaacatggtgaaaccccgtctctactaaaaatacaaaactagctgggtgtggtggcacatgcctgtaatcccagctactcgggaggctgaggcaggagaatcacttgaacccaggaggtggaggttgcaatgagccaagattgcaccactgtactccagcctgggcgacaagagtgaaactccatctcaaaaaaaataaataaatgagacaggcacggtggctcatgcctctaatcccagcactttgggaggccgaggcaggtggatcatttgaggtcaggagtttgagaccagcctggccaacatggtgaaaccccgtctctactaaaaatacaaaaattagctaggctgggtgtggtggtgcattctttataatcccagctactcaggaggctgaggcaggagaattgcttgaacctggaaggcagaggttgcagtgagccaagaccatgccactgcactccagcctgggcaacagaacgagacgctatctcaaaaactaaataaataaataaataaaatgaaataaaaataaataaacttggtaagtatttgaagttgagcttccatcccaccaacctcttcaatttcattctttaaaacatgaaagcaaagtgccccttcagtgactcttctagcacgaataggttatgaaggcaaggccagaacccctctctcctcgcaggtcttctcaaggctccttcttgttattcagatctaatctaacgcagagcagcctggctgaccccatcccatcctgtctcagggttttttctcccaccattattaccatccaaaagtatcttgtgcatgtagcatttgtagacatgcttgtctgtctttcctctctaggacataaatgcaaggaggttgttttagtcattcctgtgcaccagtgccttcgacaatacctagaacatattacgtgctcaaaaaatatgttgagtggtaaatgggtggatggacgggtacaactgctctgagtagaaacagagacttcttcatgcctagagtttgagacacctcctctaggatggagtagaaccgaggcaagctcttgatggagggctaagaattgctttgcccttaagtttccagtgaatgaagagatcatgtaagaatgctaggagttcataaacctctcacggcaagatttttcacaagaaagttgcctgacacctcctataacagtccatcacgaaattttgtcagtgttacattctgaacatctcttgaatttatcctgtctcatctctaccgtccagtccaggttggtcactgtgtgttgcctggggtctatagacccatttctttccccatcgcctacctctgtccccctcatcaaatatttgcctaaagccctttcaactaatatttatgctaaatatgtgccaggtactcttctaggttctggcgatacagcaatgaacaagacacacaggaacccaggctctcaaagagctttcattctactggagaagggaagacagatttgcacaagtagaccaagaactgaccagggtcatccctgattgggataagtggtctggaagagaacctagttttggtgggaggcaggggtgaggagaaggcccaacattactgaggatggtcaggaaaagctctccaaaaaggtgacatccaattgctgtataatggagccagcgatgggaatatctaggttgagggcagaggggggattctaaactgggaatgtgatgagcaaggcagagaatgagagaaaatgaggacagaaaacaggcaaaagccagaaaccatagtggcagagaggatgtattttattctttgaacaaaagaaaatacatcagctctgaaatcctcactctttttctcaacatccgttcccttcgaatattaggtgttcccattttaactcctgccaattctcgctaaggttacacctcatccttcattaccaggaaacagactgtgaacagatactagtcctcttgccaaacatccacctctgcatctcagctggccacactgtcacctgggaggatacactatacacacccccacttagatacacaaagtgggagctcagcacctccgagcacataaactcagctcttctgagtggtttacgatgatgctcacctggaattaacacccctctccagcacactagggctaccatgggttctgtaaggaatgaccaggagagcaactttcaccatggccaagacttctgtcaagtatctctcggacacacgtgttcctcttcatttccactgccatcacattaattgagactctcatcacttcagatctgaattctgaaatgctctccaagaatgccttcctactactgctttgactccatggttctcaaactccagcacacatcagacacactgggataccactctcaggttactcttctcttcctaaaacagatgctcatcattctgcctcctcagattaagaacctaaagtagctacccacacctaccacatgaactggaaattggctcaccatacctgtccaaccagaccggaatgatgagcaaggcaatttaaaaacagcccagtatagccaggtgcggtggctcacgcctgtaatcccagcactttgggaggccgaggtgggtggatcacgaggtcaggagctccagaccagcctggccaacatggtgaaaccccgtctctactcaaaatacaaaaattagctgggcatggtggctcacacctgtaatcccaaccactgcggaggttgcagtgagctgagatcgcgccactgcattccagtctggcaacagagcgagactctgtctcaaaaaaaaaaaaaaaaaaaaagcactccagcattttttgcaagaggctcatcagcatagcatccccctcaagtatagcatgatgtaaataatgaaaagattcctggactggaaattagaagtcagccaagccattctctagccttgtgaccttcacaatgtcccttaacttccctgagtccctaggctcatctttgaagtgctctcacttcacaatgtctgcagaagcaaaggcaatggttgttatgagtgtgttttgtgaactttcaagccctatgcaagttaacaaccatgtctaactctccaaaaactgtggtgctcagcccacatattcatattcctgccctgctagagacatgcccgagtgcccttcataatatatatcttcagtgaggtgacgactcctcatgtttctaatttaaaagatatgttaagttaaggcaggatgaattttttagtctattttaaatatatatatataatgaacacataacttataaaaatttggaactatactatatcattatcacttacattccaattcttactttagtaattactttataagcttggttacaaaaaaaacttcatagtaaatgagcatctgggctctggaatcagatccttttattcatttcctgactcccttttgcctcaagagaagtcaaatgtttcccacaatatattggttccactgaaactgtgatcctagagaactaggctgcagcctcccaaggccattttctattacttttctggaggttttgtctctttcctctagcaatcataatttttactcgcttatgttagacagggaaataactggtgacttttttctcctctttccaaattatctgaactctgctcacattacttttacaatgaaaaactgatttataaaaattttgaaacataaaagtagtattttaaataagaacaaaggaaaagtcttttctctaccacttcccagttctgtaaccttgaacaactcactttacctctgtaagtctcagcttccttatctgtaagatagggatcattaagtctgcagttactactataaaaagtagttgtaaagatggaggaagctcctggaattaaaagtataagcatttatatatattgaggcattactacaattctccagaagtgtcaacctgccccaactcccctgctaagaaccacatatgcacacatacatggtgacctggcagtttctctgcactttgctcataatctgatgaccttctactattaatatatctgattcataagatctattgattaaaaggtaaaaaagggattttattgtgttacaataaataaaagtctacaaaaccaatatataataatcatatcccctcacccttctcccctgaagcaggtgacaagaccctcatccaagaggtgccctccctgtaccctgaggaaaggaacatccttatctccgacacctcggacttccctgagtagggacttcactagatgaatgctcctggactttcctctccctcctcccctcttcattcctcctctgagaaaggaattaattatctgattggtgagttggaaagaaacacagggcataaatggcccagcccctttcttacagggaaagagggtgcagaaaagtctattctctcagcgatgcagtgagctagtagggcaggctctactgccccacaccgcccaaccatgaccctcacaagggaggcctgcactttagggctgaaattccattcagagctatgtcaaaaagaagcccatttttccacgcatctaagctataatacattctccaacatagtctttgtgaataacgaagctgagaatttgatctccatacgtctgactcttgcatcaatatttcaacttaggccaaaaaggaaccttttttccaaagtgagaactaaacacttagaatctgtatgcacagaatgatgggcagacaagtttactcttcagagacttttactaatttgtgtggaagtatccagggttcttttgcaagccaatccaaatccaagtcccctgcacctgtggactccagacctccctgccctcaagagctccatggcaagaagtctcaggtctattgattcagctgtgtggagtccagaatctcagaagcaactgtggctggacagccagactacagaaactcctgctaccatttctcattagttatccaagggagaggagggaccccataagctcatagtctacagtgggctgtgttagatggcgagacttccaagaaagtcattaacctctccaaatctttgtttcctcagctatgaaaagtatatgaggatatgacaatatccacccaacaggtattattaacattgccgttatgagcatcagaaaagataaaaatgcagatgtaaaaggtaaaaatgcaaatacataatgcaataaaaggaatgatataaatattacatctaagaaagaataatagggtgctcatccttcagactcaaatggggaagcagagttttttttttcttttcatttccaaataatttcaggcttccaaaaagttggaaaaataggacagagtttgtataaccagttcccctagataacatcttacataacacttttgaagggtgctggcaattattttgtagcatggccctttggtctgtctgatgtttcctcatgatcagattcaggctacacattttgggcaagagtctacagccacatcaccctgaacacacccgatcttgtctgattttggaagctaagcaaggtcgagcctggttagtacttggacaagagacattttgggcaagaaaaccacagcagtgatgccgagttctcagtgcatgatatcagggctacgagctgcatgcacatatctggtgatgaccgcatagctagggtggtgtctactgtgaggttactactgttcccttgggagtcactaagcatcttcaggggaggttctcaagactctgcagataccccgtttcacaacacacattgccccctaactttagtgtccactgagtgttcttgtctgtacccattaccactgtggtttgtcaaacagcaattttccgttcccatcatttcttctacattagtcagaatgagtagggaagagctctccctcccaccactgacatgtttacccaattatttatatactatgaacacattcatattaattgattctgtgggctatataactcattacagtcattatttattttctttctcaaattgtcccggatttggcaattggaagctcctttatgttgctcccatgttctttcgacaagccctgtcctttttttcagcaattctttactttctggcacaagatcttctaggttcatcttgtactttccctgccctggtgctggaatgagccaggagccttggtctcttttgttagagaatggcatcagaactgaggccttgggtgccaggggtctctgcgtctaggccctagaagagcagagttctgacccagagccacccctgtgtgccgcagtgcttcaagctatgtctactttagtagatctgttaattaacagaaagagttgggttttgttcatttttttaaaaaagcacttagtctacataaccaaaacatgatatataaattcctttaaattattataccttaatgccccttcttcctatcctgatttgttaataagcacaattataataagttgcttttcagtattgcattgttacatatggtaacacttttacattgcccaatatgtctctaataaaaatagcttattttgaaatggcttcttggcaaacactggtaactactctggttaagcaactaagccagatcattaggtgaaggctaaatgaattcggaagaagcaagaaagagtaacgtaagtacagtcagaaggtgggatgtattcccaaaaacctgcctcagctttcccgagctcagtcaagggtttcttttgtcgtagttgttaaactaagagggatcgttccaagagggaatggtacagatgtgataatggcatggaaaatacacctggcactcttctaacacaaaggaggtaaaagctagactttatgtaataacagctgggaaatctgtcctgcattctttttttaaattgtggtaaaatacacatagcataaaattatcatcttaaccattttaaagcacacagctcggtggtgttaagtatattcacacagtgtgaaccacacaggtgtggttcatcacttcaatctttagaactttctcagcttgcaaaactgaaactctgtactcattaaacaactccctctatcctacattctttactaaccaatccaagggagagtcaccctcttctctcaaaagcccttggccaacattttgccgtaaccttcatgattgagccatttggacaactcatcccactaaaccagtctctggaactcagtctccggagcagccagaactccctgtgtaattctgggatttcccaatgccaaccttgatttggtaactaaagctaccaaagttctgtacccacactgggctgacatatctaggcttggtaagtgaactacaaagaagtctatgaaaggttttctctccgttcctttaattctaaggccctagacccctgttctgttttgatgactttctcaagtaaataaaaaagacacactttctcttagagactgtaaattgagtaaccttgtgttcagcccatttcctatggaaaaatacatatttgatgagccaacaacaggtctcccacctctaatgaagagatgtggtaagaggagaaagtaaagtgatgacaaagctctggccagggtgcagagtctttcctcatttttccagggaccttaacacagttgtttcaacaactagtttgtaaacagatttgaagtgatgaacacaaaactgtcaaatgtcttaaagtttgtcactggtgccctttaggacaatggcaggaaattctaattccaagaatttgagagtgacaaggcattttagctgatcatgtacttctctggatatgaggatccttttgtgggaagattctctcttggctctttcaaggttggagggagaatcgcaagaaaccatggttgtcaaaacactctgtaagactaaacaagtgaaagggattacaagtaaggaggcaaatgagtttcttaaaggtgcaccagcccagaaattagaaggtggagcatcaagatgtaattccaccactgcctggctgttgcacttggctatgtcacttgacatccggggtgtctcacttgttaaatggtgacccaaactctctccttggctgcctcacaactttgtgttaagaagcaaatagctagttgtggaatgaggagtaccaggaggagtaacatatgaggtatggcgctatcattttctgttcagactaactccataagagccacacttcttgtccacatccaagcttcctccactttgccaagtgtcattttaggctgcttcacattatgtttattcttcaacacatgcattagaagacctatcaattaaaaggcagagtgagaatgtctgttgtttagtttttaaaaagaaaaagactatgaaaactgcaaatgtgagtacaggttgagcatccctaatctgaaaatccaaaattgaaatgctccaaaatctgaaactttttgagcacccacatgacactcaaaaaaaaaaaaaaatgctcactagagtattttggatctttggattagggatgcccaccctgtgctatcatgaaaacacttctcaattatttcttatatttcacctccatttcctcttttatataactttaacctcttcctctctttgactccttcccgactcagaaatatacacaaatctcattcatttctatttaaagtaaaactagcaagaaagataactccctcaatcttgctttctctcctaacacacccttctcccactccttctattcacaggcaagagcttcagaaaacaaatgatgctcactctccctacttccccacctcccactgacctttagccatgctgcctgactcctgcctcaacttccctaaaaccttatgagctaaaggtctccaatgacctaactatgaaatgcaaaggatacttttccacctgtatccatgaagacctctttgccacacctggctctgctgactgcattccagaactcacccttcccccaagtcccttgcctgtcctgtggccaccaacttgtagtcttcctctctcacacatctatgtagctcttgtttgaacggtcactgtctcagccatgcttcaatgttctgtgttcccaaaaggttccttcctccattctcttctcttttgttatggctctctgggaaatacaggtgtggttcatcacttcaacaactacgtgcatgctaaagacttccagtctacagatgcagcttgttgctgcctgtgcgtgtcatgcccttatttattaatgctttcagtaatttttatttattttattagagctttcaaactcagcattataaatgttgatacagtagttacttaggaaactatcgaatgagttagaggataactatgaaggaagagcacttctttttgaagaaaacacaaaattccatgagcaggaattttacacacacagtaaaaaaaaggatatggaaaacaaatgccttaagatccttagaagttattttcactttatctccattctgtaaccttttctatatattgcgagggtagaatcctaagacaaactaccaaacccatgagtataaagaacacacgcatagctgaaatttcaaatgcaaaatccaaaatgctaagtaaaggatctgctgtataattctaaaagtttaataaacctctaaggatggatgaaaagtactttctcatgtactagaacagctttaacagagctgccttaataactcataaaaaaaaccttcatgttcaaagagagaatctgttaattctaaaatgatctggaaaggaacaaaaattaaccaagtatgataccacagaaaaatatctaatggaaggggaaaatatcacgatatattaaattttaagaagtagattactgaacagtatatttaatatgattccaattaagaaaaaaatttaatatctctatatttgaggagaaaaagaatacacacaaaaataatcaggattatagtaatacatatttcattctctttgtgctttctatagctctgaattttctacaatgaacacttcttaaaatatatttttaaaccaagattatgcaaaaaatgtaagaaagaaataatcataatataatatttgacgaaaaaatctattatggttacaactgtatcaagaagcacatgcctaggaaaaagactggaaggaaatacaccaaaattctgtgttcaagtgatcatcattatggttgtttctcctttcctccattttccccaatgtttggcagtgtgatttattattttataataaaaataatagctaaaaatatttaaagataaaagcgacttgaaagggagttgtgccccaaagttgaattttgttttgctttcatgtaacagtgccacctattcactgagtccctgagcagccaccgtatctccttccctgatttataaaatgggcactctacttgcctaggcctctcctgacctcattggtttgtcaaacgcaatgcactatgcaaatatcagtattatattccttcaagggtgggactgtcctcccctcttcccccaggaatgcccacaacccttcctgacctgctgacagtagacgctccgcgctgtctgggcgcctgttgtgtatcacatgatgcaaagtgaaggctgcttgttgccatatctgagtgagaagatctgttaattaaaaaggcagagcaaggttttttatttctttgtcctgtgagaaaagtctacaccagtgcaattacacaacataagtcttccaattatttttatacatcttacctccatttcttatcaattttaaaaatcaagtaacaaaaatctactgttatgtgtcaaacattcctgaaatacagccctaataactttattttttcattctagtacacaaaaaataagttaactgaaattactccacaggtctccacccaaagataggattgtatcttgtatatatccgtccaggttttttcccaagtaaatctatacatattttaataaaactttattaaagatacttattataatgggttatggtatacagtataatggattacatataggaattattctgaatcttttcttctcaataaatccagagttgctttatcatagcatctgcaacatgctgctgactggaaataatgataatttgttacctgtccctcattttcaggcatgtaggttactcccaaagttttggcattacaaactactgttaataagcccctttactcacttgcctaattatttccaaaaaatacattcccgaaggcaatggtacttattttgtaaagtactttatttttaataaactgtctaatttcccactaaatacacaccacagaaagctgaagtaacataaagaaggtaaggaccaatttgccttgcagaatcttcggccagtttgttgacccacagatatctgacaggcacacaatgggggcaggtccactcagagaaggaaatttccagaaagagtttaagagtaagtcctgccctgtattacaatagaattgccaatctccttccatttccactcaccttaacagtacacatttcacagagaagagctagagtcattaaaaaaagaggtaaagtcattaaaaaaagaggagaagttttgcgtgtttttttgtggttgttttttgtttttgtttttgttttttaattctaagatgtacaatgggtgcagtggctcacgcctgtaatctcagcactttgggaggccgaggcaggtggatcacccgaggtcaggagttcgagaccagcctggccaacatggtgaaactccgtctctactaaaaatacaaaaattagccaggtatcgtggcgcatgcctgtaatcccagctacccgggaggctgagtcagggagaatcgcttgaacccaggaggcggaggttgcggtgagccaagatcgcaccattgcactccagcctgggcgacaagagcaaaactccatctcaaaaaaaaaaaaaaagtgcagtgtcctcaattaagtggagttttgttttttgtttttttcccccattggaagttcagacttcccaatgcactctaatattttacactagacattcatttttatcttggatatatcaagttccctaaatttttcacatcacataggggaaaactgaagttgttcttacaagggtggttaggtgtgggtggtgggagggaagaaaactccacaggtaagggaaaatgtcattagaagacaagttatttccatcacaaaaacttcttattctgagaatacaggtaccacttccataaataagactctgggcagtgaccatcagctccgtttacaagcagggaaagaggaagtgaccgactgaaaaggctatctacccatttggaccattcttgcccatctgttcatttacagactcattttcgagggctagaaacacacagtctctgaaatgtactgttaaaatatccccttttcacatttgcctttagctttaataaaagtctccccaatattgaaatttttacttagtcgtaactatcacccttttctttaacattcctgattttgagggcatacttagaaaaaccttccctctacaaagattatataacatagttttacctgtgttttactttttaatatgttatatttaatcgtttataatttaaataaatggtacaagatagtgctgtgtaattttttccctaatcttttgccatgtttcccaagattgtttttaaaaaaacacatcttttcccccaatgatttgacatgccatatataacacactagatataaacataaatttggtgtgccaggtaaatattatatgtttcaaagtgctaaaataattgggactgggcacgctggctcatgcctgtaatcccagcactttgggaggctgaggcaggcagatcacttgaggtcaggagtttgagaccagcctggccagcatggtgaaaccccgtctctactgaaaatacaaaaattagccaggcgtggtggtgggtgcctgtaatccgagctactcaggaggctgagacaggagaattgcttgaacccgggaggcggaggttgcagtgagccaagattgcaccactgcattccagcctgggtgacaagagtgacactccatctcaaaaaataaaaacagtaataatgaattgggaggccttcagcaaagatggttcctatacgagcaaatggaaactcaactcaccgtaaacagtaaaaacaaaacttaagcttagccaatcagaaaccgccaactcacctctaactaagaacttcccacttgttccagtcaagtattttatttgtcttgcttctttaaatacttcataagtttccccctcccactccttaagtagaacactgaactgcttgtgttctaatgatattcaattcaggaatcacttatgctcaaacaaactagttaaaatattactgtgcctaaattaatctgttaataaaagctaaaattattgtatctttacctggcacaacagacttgactttagcagaatataataattattaacaaaataatgttacattttattcatcttttctgaggtataaaagattagattcagattcttcaagttctttatgtttgtatacacatgtacacgaattcatggaaattctacagtatttctagatttatgttaatatcacaataagcatatcatgccacaaactaatttttttattaaacaggatttttttagatatagacataacccatttattgaaagtactgtctagtgttttaagaatgcattttctcatttcattaataagaaatgcttcaaatacataaagtagagaaaatactattgcaaacacacaaatataatctagaatccatttttgtgtacagtctgagctacatttaattctttcctgcatggataagcaagaaataactcatctacttgttataagagcttggaaacaaggcaaaaggaagactgcatgtcctctcaaggtcaccttggagcactgtctgacaggcccacccaaggaacatttaattccctagggagtatatatcttgtttggcttgctatttactattaaaacctatactctgtaaaattatgttaacttgtagattttttaatctggtagatatgcaaataatttctgtgtggtaagattatggttttattaccttgccggaggttaaccagtgttgtgcataacaaaccttatttcaacactttttctttcctcagttctccaaatgctgttaccaggtttaccatcttgctgatttcctcactgacatgcgttgattccataattatgatactttgacatactggattattctgcaatctcttacacacagcaattttccatacgtgctcaggtctgtttctgggcattcttttgttccatcacatatttgcctctctctgcactagtcacaccgtttttattatcatggctttccgagacctgtaagccaactggggcaagttctctactttattaaacactctttttgtggggttgttattattacacctacattcttgtttatgaatttcagagttagtcattataatattacaagcaagtcctgctggagttttgactgggaattcattacattattaggaaatctacagagaattgttgtctttataacattgcatcttcacatctttacacatttattcaggtcttctcttatttccttcaataaaggcttttaatatctgaacactgcactgatatgcatgtacccttgcaaaagagccatgctaaatctttatactggaggctacgaaaaataacacaccaaacttcaattacagctattagtacattggaatatatgcccttattttgccctattttaacggctctaacttttaagtttttaaacagctttattcagacctaattcacagaccataaaattcacccaattaatgtttacaatcaatggtttttagtatattcacagactatcaccacaatctaattttataatattttgtcaccaaaatgtatccatatattagcagtcactcctcattctccactccacctcctctagtcctaaacaaccactaatctactttttgtgtctatagatttgcctattctggacatttcatatcaatggaatcataaaaagtatggtctttatgcttggctttttcagttagcatgttttcaagattcattcatgtggtatcatgtaacagtactttattcctttttattacctaatattattccattgtatagctataccacattttgttagtcatttgttgataatatatgaataatttgcattttgtggccattacgaataatgctgttatgaacattcatgtacaagttcttggccaaggcatggtggctcactcctgtaatcccagcaggactttgggaggccgaggagggcagatcacttgaggtcaggagttcaagaccagcctggccaacatggcaaaactccatctctactaaaaatacaaaaattagccaggcatggtggtgcacacccgtaattccagctactcgggaggctgaggcaggagaattgcttgaacccgggaggcggaggttgcagtgagccaagattgtgccactgcactccagcctgggtgacagagtgagactccatctcagaaaaaaaaaaaaacaaacaagttattgtgtggacatgtattttcatttctcttaattatatatctagcattgctatggaatgctaaattatggtatgtggaattgctacattatgtggtaactttatgtttgacattttgaagaactactagactgttttccaaagtggctgtgtgatttttccgatttttttaatttttattttttgtagaaatggtgccttgccatcttgcccaggctggtcttgaactcctaggctcaagcaatcctcctaccccagcctcccagagtgcttggattaccagcatgagccaccatgcccggccagctatgtgattttatattcccaccaataatgtactagattcccaatttcttaacagcttggccaatacttgtttttgtccatgagatatggtggtatctcactgtagtttttggtgtgcatttgcttaatgactaataatgttgagaatcttttttaagtacttaatggccaattgtatgtcttctttggagtaatgtctattcagattattttcccatttttaattgagttacttatctttttattattcatttgaatactgctctaattttaatcactaggtacaactattttcgagggtaaagcttacagctatctttgtttatactttttctctcaatcaaatcatagatagcagagccaattcaaatttaacttccccaataaatccaacacaatatgttatgttcctgcgcaatgagataaaagctagtccatatttaaaactaaaataaaatttcaaaaatgaataaaaatatgtccttcaaggttttccatcaacgttaaaatctctccttaggggagaaaaggaatgagtgtagataggccaactgatgtgctctggaagccaccatgtttgtaatctagagtcgaaatggtatccatcaagccagtggagccctctcaaatcctgcagagaccttggcacatctcaccaggagctcccccgagtcacccccaccagggctggagcttgagctcgtcactgtgatactcatgggcaagctagggaatccagttctgcccagctatgtcccccctccccaacctgaacaagaacctcaaggcaccaggcactcctctgtccagctcatcacctgaaacaacagaggtctcatcacagtaaataaaaatcaagtatatacccatctgcttgtgcggcaaatggctcttacccataggcgccacctactgacctccaggtcaaactgcacagaccaatataaaacctgcagacagaatcgcgcagggccttagaagcgaacccaaaagaccctacccaacatactaacgctatagttacacccctagaagaggtggaaacgggaggtgggggggacgcccatctaaatgaaaataaattcaaaaagaaaaagcagtagcctctctagatgagaagaaaccaacataaaaattctggcaccatgaaaaatctaaatgttgtgacatcaccaaagggtcacactagctgtctagcaacagaccttaaccaaataaaaactcagaaacggcagataaataattcagagtatggactgcaagcaagctcaatgagatccaagaaaaggttgaaaactcaacacaatgaaaccaagaaagtaatccaagaaatgagggaagagactaatatcctttaaaaaacaaaaacagagcccgcctagctgaggcgcgcaggcagcagccgttgctgcgacgcctctggtgtactaaatctggaggggaggttgggccctcgaagagaaggagaagaccctcaaaccttggctaacggcgacgtagctggctttttggagaggccgcctaacgttctgccacttcattggaatcagcctccgcccttctcaactggctgctgcagggccagtggtgccgggagacgacggcggccgctcaggcacggttcgaacactctggggactctttccctgaactataaaaattctcaaacactgcatacacagagaggataggagacatggcatttgtggatagggaaagaggaaattttgcgataggacagctgtagatcctgttgcggacacccagccgggcagttggaggcggggtcagtccagaagccttcagataacaccagggtgtagccctggcgagaaatcttcagttgcttcaggaccttttctagccccacgcgacggctaggtcctccgtgagagaaaactggttcgagaagcatggccaacattcccaatgatccgcagatgtggtttccacctggccggtgccatgacaccggaacacacggcgacaaggagaagggagaagaaaacctcgccctctccctctccctctccctctctctccccacggtctccctctccctctctttccacggtctccctctgatgccgagccgaagctggactgtactgctgccatctgggctcactgcaacctccctgcctgattctcctgcctcagcctgcccagtgcctgcgattgcaggcgcacgccgccacgcctgactggttttcgtatttttttggtggagacggggtttcgctgtgttggccgggctggtctccagctcctaaccgccagtgatccgccagcctcggcctcccgaggtgccgggattgcagacggagtctcgttcgctcagtgctcaatggtgcccaggctggagtgcagtggcgtgatctcggctcgctacaacatccacctcccagccgcctgccttggcctcccaaagagccgagattgcagcctctgcccggccgccaccccgtctgggaagtgaggagcgtctctgcctggccgcccatcctctgggatgtgaggagcccctctgcctggctgcccagtctggaaagtgaggagcgtctctgcctggctgccatcccatctaggaagtgaggagcgcctcttccccgccgccatcccatctaggaagtgaggagcgtctctgccccgccgcccatcgtctgagatgtggggagcgcctctgccccgctgccccgtctgggatgtgaggagcgcctctgacccgccgccccgtctgggatgtgaggagcgcctctgcccggccgcgaccccatctgggaggtgaggagtgtctctgcccggccgccccgtctgagaagtgaggagtccctctgcccggcagccgccccatctgagaagtgaggagcccctccatccggcagccaccccgtctgggaagtgaggagcgtctctgcccggcagccaccccgtccgggagggaggtgggggtcagcccccgccaggccagccgccccatccgggagggaagtcggggggtcagccccccgcccagccagccgccccatctggcagggaggtgggggggtcagccccccgcccggccagctgccccatccaggagggaggtgggggggtcagccccccgcccggccagccgccccgtctgggaggtgaggggcgcctctgcccggccgcccctgctgggaagtgaggagcccctctgcctggccaccaccccgtctgggaggtgtacccaacagctcattgagaacgggccatgatgacaatggcggttttgcggaatagaaagaggggaaaggtggggaaaagattgagaaatcggatggttgccgtgtctgtgtagggagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttcttaaacagatgcttgaaggcagcatgctccttaagagtcattaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaataaataaataaataaaacaaaaacaaaacaaaacaaaacaaaaaacagaacttctggaaatgaaaaattcacttaagaaatttcaaaatacagttgaaagttttaacaatagactggaccaggcagaagaaagtatttcagagcttaaagacctccaattcatatcaccaactaataattttttaaaaaatagcttgaagacccatctttcaaattaacccaaacaaaaataaagaaaaaagaatttttaaaaatgaacaaagcatttcagacatacaggattgtgcaaagcaaccaaacctatggcttataggcattcctgagaaggaagaagaaaaagtaagcaacctggaaaatatatttgagggaataattcaggaaactccctaatctttctacagaggtgaacatacagatacaagacattcagagaacacctgcaagacactatgcaagacgaacttcaccaaggcatatagtcatcagactatccaaggtcaacactaaagaaaaaattttaaaggcaactagaaagaagggtcaaatcacctacaaaggaaaacccatcagactaacagcaaacttctcagcagaaaccctacaaaccagaagagattggggtctatttttagcatccttaaagaaaaaaaaatgccagccaagaatttcacatcctgccaaactaagcttcatcaatgaagaagaaataaaatattttctagacaagcaaatactaagggcatctgtcaccacaagacctatcctacaagaaatgctgaagggaattctaaacatggaaatgaaaggacaatactcaccatcataaaagaacacgtaagtgcaaagctcacagatcttataaaacaactacacaattgaaactccaaaacaactagctaacaacactatgacaggaataaaacctcacatatcaatactaacctaaatgtaaatgacctaaatgccccacttaaaagatacggagtagcaaactagttttttaaaaaaaatacaagacccaaccatctgctgcctacaagtgacccacctactggctaaagatacctttcgactcaaagtaaaagggagaaagaagacataaaatgagaatggaaaacaaaagtgagcaggagtgactattctcatatcaagtaaaacagacataaaccaactaacagtaaaaaaagacaaagaaggacattatgtataatgataaaggattcaatataacaagaagatttaactattctaaatatacatgcaaccaatactggggcacccagatttatcaaacaaatgctactagacctaagagaatagactgatatcaatacaattatagtgagggacttcaacacctccactgacatcactagacagatcatcgaggcagaaaatcaacaaagaaacttgggacttaactgggttacagaccaaatggacctaaaagacatttatagaacattctactgaacaaccacagaatatatattcttttcatttgtgcatggaacattctccagaatcaaccatatactcagccacaaagcaagtctcaataaaatcaaataaatgaaaatcatatcaagtattttctcataccagagtgggatgaaattagaaatcaatcccaagaagaactctcaaaactatacaagtacatggaacctaaacaacttgctcctgaacaactcttgggtaaacaatgaaattaaggcagaaataaaaaaattcttttaaatgaatgaaaacaaagacacaacatactaaaacctctggtacacagcaaaagcagtgctaagcggaaagtttatagcattaattaaacgcctacatcagaaagacagaaagacctcaaattaacaacctaacatcacaactcaaggaactagaaaaacaagaacaaaccaacccaaagctagcagaagaaaagaaataacaaagatcagaacaaaactaaatgagattgagacaaaaaaaaaaaggcaaggactcaataaactggctgggcacagtggctcatgcctgtaatcccagcactttgggaggcccaggcggatggatcacctgatgtcaggagtttgagaccagcctgcccaacatggcgaaacgtcatctccattaaaaatacaaaaattagcagggcatagtggtgcatgcctgtagccccagctacttgggaggctgaggcaggagaattacttgaacccgggaggcggaggttgcagtgagccaagatcatgccactgtattctagcctgagcaacaaagcaagactccatctcaaaaaagaaaagaataaatgaaccgaaaagtcggttcttcaaaaggataaaccaattggcagaccattagctagactaaccaagaaaataaaagagaagattcaaataagcataatcaaaaatgataaaggtgatattacaaccaataccacagaaatacaaatgatcataagagactcctatgaactcatttatgcacacaaactagaaaacctagaggaaatggataaattcctgaaaacatacaaactcccaagattgaaacagaaagaaaaagaaatcccaagcagaccaataataagtaagtaatgaaattaaactagtaataaaaaatcttctggaaaaaaaaaaaaaagcagctcaggaccagatgcattcacagccaaattttaccagacatataaagacaagctactaccaatcttagtgaaactattacaaaaaatttgaggaggtgcaataacaccttctgtgaatccaggatcaccctgatactaaaatcagacaaggacacaacaaaaagagaaaactaccaaccaatatccctgaggaacacagatgcaaaaatcctccacaaaatactagcaaactgaatccaacacacatcaaaaatataattcatcacaatcaagtgagctttattccaggtatgcaaggatggttcaacatatgcaaatcaataaactaaaaacaaaaaccgtatgattatctcaatagacacagaaaaaacaactgataaaatccaacatgccttcctgataaaaaccttcaacaaaccaggcatcaaagaaacatacctcaaaataataagagccatatatgacaaacccacagccaacatcatatggaattgggaaaagttgaaacatttcccctaaggactgaaacaaatgaggacacccactttcaccactcttattcaacataatactggaagtccgagccaaagaaatcaggcaagagaaagatataaaaggcatccaaattggaaaaaaggaagtcaaattatctttgttaattgatgacataatcatatacctagaaagccccaaagactcctcccaaaaagacagaaaaccccgaagactcctccaaaagactcctagatttgataaacaacttcagtaaagatacaaaatcaacgtacaaaaatcagtagcatttctatataccaattatgttcaagctgagaaccaaatcaagaactgaatcccatttatgttagccacaacaaaaatccttggaatacatttaaccaaggaggtaaaagatctctacaagaagaacaacaaaacactgatgaaagaaatcacagatcatacaaacaaatggaaaaaacatcccatgcacacggactggaagaatcagtatcattaaaatgaccatattggctgggtgtggtgcctcatgcctgtaatcccagcacttttggaggctgagacgggctgatcacttgagctcagaagtttaagaccagcctgggcaacacgacaaaaccctgtctctacaaaaaatatgaaaattatctgggcgtggtatcacatgcctgtagtcctagcaactaaggaggcttaagtggaaggatcacttgagtctgggaggcataggttgcagtgagccaagatcgcaccactgcactcagcccaggtgacagagtgagaccctgtctcaaaaataagaaagtatttgcagactatgcctctgacaaaagactaacatccagaatctacaaggaactcaaacaactcaacaagaaagaaacaacaccattaaaaactgggcaaaaggcctgaacagatatttcttaaataaaataatacaagaggccaacaaacacatgaaaaaaaaaatgctcaacatcactaatcatcagagaaacacaaattaaaaccacaatgagatatcatcttataccagtcagaatggctattattaaaaaatcaaaaaacaacagatgttggattgcttatggagaaaagggaacacttgtacactgttggtgggaacaaacgttgcttcaacctctatggaaaacagtatgaagatatctcaaggagctaaaaatagtgctaccatttgagacagcaatcccactgcctggtatctacccaaaggaaaagaaatcattatataaaaaagattcctgcactcatatgtttatcacagtactattcacaatagcaaagtcatagaaccaacctaggtgtccatcaatggttgactggataaagaaaatgtggaatagatacagaatggaatactatgtagccacaaaaaggaatgaaatcatctttgcggcaacttgaatggctagaagccattatcctagatgaaataagtcagaagcagaaaatcaaataccatgggttctcacttctgaaagctaaacaataggtacaaatgcaaataaagatggaaataacagacacttggtactccaaaagaggggagggaggatggaggtgaaggttgaaaaattaccttttagatacaatgttcaatatttgcgtgatgagtacactagaagctcaatccccaccattatgcaatatacccatgtaacagacatgcacatgtaccttcaaatctaaaactttaaaaataaaaaatggtatccactagaattatgaaatgcaggactctgacacaccactggaaatctattgcttaatagtattagctacatagacaacatttgtctttcttactaaaaaaaactgcttcccagaccaaattctgcccaaggatgattcctcaaagagctgttctcatggccgatgatcagaggaaggaggaggtgctgctgctgacaatgagaaagcaagaagagcccaaaaataaaaagatactccccaagtatcattttactgccaactccaatcccattttgccaggcctgtcaccagtgcattcagaatcaaaggaatatactttcaactttttctctccactctggccctgttcctcacgaaggaaaaacagctgaaaaaggccaaagggcaagcaccaacaaaggatataactgttctattaaacgagaaactggcgaatagataaactagataaacttctccctaaataatctatgcttagacttcttacaaagccttcctcaatcaaaactgtaacccttagtattatttgtagggcgtgggtaatctttagattctttgtacttttcaatgtttttttttcaattttttcaaaaatgataatgtaccattttaacaataatgaaaaaagttaagcatatattttgagtaatttaagtctatattcatgaagggaatattcaaatattaatttaaggaaacaccctctgatcatccctttttatcacacataactcaaaatagttatctaagaaatatgcaagaacagtataatttattatttttggccctctccacatgaagaagtcagaatacatcactactcaatgtgtttctcatgttattttagaccttttagaagtcttccaacctttcactactttaaaaaagtcagttcttgaatgtggtttttctaattttatcttttctatttcctgcattgataacatgcttcaataggtctactattatattcctgaactgctttcaaacttattactttatgcatatttaccatctcaatctggtccttcatgcatctacctttgctaaaaacgaacaatgattcatgccttattgaaggaatcagccctcataggaagctaagagatggcgctctcacgagttctctaataccagccgtgtttcccatctttggcagatgagaaaaatgtagcacatgaggcccatgtgaatgtgatatttgccaagtgtcccttagctctgtatggaaaatggggaatgacaagctcattcaaatagatggattcataactgtttgaacagcttctctcaagaggtacttccctttatcatgtgttttacatttgtatcagaaactgggattaaaatagagaatgcaaggttaaaaaaaaaaaaactctgcaaaacaatgaaactggaaaagatagcagtgaatgaaccataatttaaaaagataatgctctaagtggatgacttatatttagtaaactaaaatttaatttttatccataaacatttaggaatgccatattccaggcatggtatcagatgttaaagcacaaaaaataatagcatgcctgctctcaaagatgatacctgagtgagaataaattataaattcctgaatttataatttataaaatctaactgaataaaaacaggataaaagagatgtgacttaaaaacattgtaaaaagttgtgaattattttaaatgaatttgtgaacacaacagaatatgaatcctgatacaacttaagctgtattaagaaaactatagcatctagaatgaggaaaatagtaatctttcgtaagtttcttttaattaactcttttttttttttttttttgagacagagtctagttctgtcacccaggctggagtgcagtagtgggatctcagctcactgcaatctctgcctcctgggttcaagcaattctcctgtctcagcctcctgaatagctgggactacaggcacatgccaccaccacacctggctaatttttgtatttttagtagaaacggagtttcatcatattggtcacgctggtctcaaactcctgacctcagttgatccacctgcctcgacctcccaaagtgctgggattacaggcatgagccaccgcaagcagcctaattaactctgacttaaaaatataattatctcttaatcagagtacaaacttcataaaggcaggattgtatcgcagcacctagtacagtgtcttgcaggtaatgatcttcaataccactgtgctggttgattaaataaataaacaaaggagcaaatgaaggataacatcattctcctctagtcagaccagtcacacctggcctatctgatggtctagacatacacttttaagaatatcaacaacgggaaatgcaggctgggcacagtggctcatgcctgtaatcccagcattttgcaaggccaaggcaggcggatcacttgagtccaggagtttgagaccagcctgggcaacatagggagaccccatctctacaaaaaatacgaaaaatcagccaggcctggtggtgcatacctgtagtcccagctactcaggcggctgaagcgggaggatcgcttgaaacaggacggttgaggctgcagtgagctgtgatcatgtcactacactccaacctgggtgacagagcaagaccctatctcaaaaagaaagaaagaaagaaagaagaattggaagaaagcagagaaaagaaaggaatatgaaagctccattcactagaaagattttggttcatccttctagaccaccttctctggagcaaaatcctattctcaaatgactcagaaaatacctaataatgtatatacatagaataataaaacaaatatggcaaaatgttaaaactgaattaagggcattcagaagttctctgtgttattcttgcactttttctgtaagtttggaattatcataaaataaaaatgtttttttaaaagactgcttattggcatgatgattctgtaacaaagggcagagacagcgattaaatgtgagtggccgctggatctcaggaacctgtgggccaaccaatgccagtggagaatgccaagcccttgggccacaggcacaccaacagtccagaaatcctttggtggcagaggcagcaaggagagaggccaatgcaaagacaacaggatggggccctctaccaggcagcagtccccagacaggggccatctgtacaccacctcttcctgcacccaacgccatgtcagaaggaggagagagagggaaaaccttttaagaaggaagatataagcctgatacagagtttaagtttttacttaactgggcatttacccctcccacatctcccagaaaacctgagtcactccaaaacagactgctggaaatttgaacagatgatgtaatttttaattgaccacttaatgtgcttttctgtcctcaatggggatgaaagttccagagtaaaggagaacagttgaaaagaatacaagtacattttcatatacaatacaaagcatgattcagaccctactcattaaggggcagagcaagatggcagaatataaggctccactggtcatcgcccctgcaaggaaaccaatttaacaactgtctacagaaaaaaagcactttcgtaagaaccaaaaatcaggtgagcactcatagtacctggctttaacttcatgtcaaagacgctactcactaagaaaatggaaagcaggctgggtacagtgcctcacacctgtaatcccagtgttttgggaggctgaggcaggaggatcacttgagcccagaacttctagactagcctgggcaacatagcaatagcccatctctacaaaaaaataaaaaattggacgtatgtagtggcatacacctgcagtcttagctactcaggaggctgagaggacagcctaagcccaggagttcaaagctgcagtgggcagcactgtgaagtgcacaggctgtcgcccaggctggagtctctaaaaacattttcttttcatttaaaaaaaaattttagaaagaaaatggaaggtagtgcttactatctctttcagcaaaagaaactactccaacagctgctgttttccttgcccatagtcatagcaaattactgaccaagttggaaacttagaaccagagcctgtatcttttcaaattctttccttaggcaagcaaatcagactccttcacattatttaaaacaaacaacaatggaatgttggattggcaagagataggcacagctcctgtttcattttgctagttttctttgctgattttttaaattaaaaacaaacaaaaatcctttccctattggagggttctcttatttctgactgaaaacttcttacctaatctatgaattatcctctcttaccacatgactggagcgtgatttaggagaaggcatgctgggacacatagcagaccactgtgttcctgtcctaggtacgccagtcactggcgggcagtgtggctttgcgccacttcctcacctcagtgggtctcagtgtccctatctgcaaaagcaaagcagcaataacaacacctgccctatgtccctcccagagataccacgaggaaagaacgtgctccattttgtaaaatcgctttttaaactgaaacatcacataaatgcaagggaatgaagtggtgctgatgttattagaggagttatagaggagtatagtggtgctgatgttattagaggagttatgggagccaagaacttcccattagacagaccattatattcctgctattcagcagttctgcttaatgcttcctgcagtcatggggcagaggccactgaggcagcatttgccatttgcattgcatcgctccacgttggaatgcagatattttcagatgtagagcaaatacaggttttcagtgggacactgaatgggggggacattgtcttttcttttaaaatatcaccacctaaaacaaagagtaacaaagtttttctaaagacaattctgacaacaagttttccttttatttgcctcatgatccatggaggaagaaaaaaaataaaggcttccaaaaagtcattttctcaggctagatagtatgtttcttctctgggttctctggttggagtttacaactcatagtataattattggtctacttttcaattacagtgagtagcttatgagcttcttaagaacaggaactatctgtttcttaatccagagatgttcaatgactgcttgatgaatgaatgacattcttcctgatgcaattagccccttgcatcaaattcagtcttcctacttggcattttatgtcacatatgtagatcatgaaaagtacccatgaatatttcatcacagaaaccttcattcacaaacaagcagctttcagtagatataagggctctccctacaaatatctattagtaggaaaaacaaacaaaactgaagaaggagcatataaatattcgagtaattaaactctagagtttttctttagttcttcaatatgtggctgtttccatagttaatgtgctgtatttattcagcctgtggtatcaagcaggcatatgaaatggttttgctatacagggatgctattactttaaaaaataaaaacaaaaacacctaagctaatattaaggaggggtgatggcaaataaacgctatatattgggtcctggattgctggaatgaagggctcaaattctgtcacaactactaactaagaaaacaatgactacagccccaaaccacaagagaaattcaagtcttggtttcatactttcctgctttctaaattacagccacctataataactcaaaataaaatattctataacccattaatctaaaatgatcaccgaagaaatccatccataccacttggtcactaaagactttccacatctgtagactgacgaaacatcaaaagaaaagtaaaccatgcatgaaattcacatcaaactcatgttctgtttgctcttctgcaattaccacctaaatttctctggctaagtcagagaacttgggtagaatggcactgttaagtcatttcttacccaaataaatcaccaggccgggcgtggtggctcacacctgtaatcctagcactttgggaggcccaggcgggcagatcacctgaggtcaggagttcgagaccagcctgaccaacatggagaaaccctgtgtctaataaaaatacaaaattagctgggcgtggtggcacatgcctgtaatcccggctactagggagtctgaggcaggagaattgcttgaacctgggaggcagaggttgtggtgagccgagatcacgccattgcactccagcctgggcaaccagagtgacaggaaactccatctcaaaaaataaataaataaataaatcaccagagtcacataacattttggttaatgtcttgatgttagtctgcagaggggtatctcattaaggtgaggagactcaccttaacaaaaattcaaatctaactcttggggttttagttgaggagtttaaggtgtatgactcagctggaaatagagagaaggacagagaccaaaaatttggcaagtgtggtagattataaacggccacaaattctttgtcacccttcctgtcaagaagtgaggtctatggccccacttcttgaatcaaggtggtctctgtgactacttgaccaatacaacactgtgttagtttggggtccaaatcttaaagactagcagttgctacttcttgtcatttggaatactaaagctcagaaccacattgctatgctgtgaggaagctcaagcaacaacatggagaagaacaaagcccctgacaacagttctagctaaattcccagctgacaaccaatactaactggccagccaggtaagtgagccatcatagcaatggctcctccagctccagctgagccaccccaggtgattccaagtgggcagagatgagtcatttcctctgagacctgcataaacttcagattcataagcaaataaatgattgttattgttttaagtctactaagctctgtggtgatttgttacacagctattgatatgcagcataggaaacattaacagaagaataacattactgcatcatgagaaacaaatgacccatttgcactcttggctgaccagacaaaactagaaatagtgtccagttttggttgtaaccatctagaaactatgacaggtcaaattcaaagagatcagaatggagagaagcatgaaatatgtcacaggagagagaagtgacataactgaggatgtgtagcttggatatacgaagatccaccagggactggtagggagaatattttacatatttgaaagactactttgtaaaaacactagagtggttttatcttaagatcagtgggtaggaggctgtagagaggtaaagttcatcttcgataaggaagacttcattctaaggaagaacattctaacagtcattcagaaaggaaatggacaaatggcctttagaatcaagatgtgctataatatctctcctgaaaagttactccctaccctcaattttcaaatttgcaagaattccaactcattacaggagacaagtcctgtgtacaactctgaacatggcggccctatagggaattgctgatgttggtgaacagcattctggacctaaaattcaagaaacccttgatttttccattagcattcctcttctagggtgcatgttttccacgttccttaactggcctgccactgaagcataatctgcccataagtgcaatcctgtcctttctaaagtgaaccaaagacataaatgtatatgtgctgttaacaggtggaaagcaagtacaaaatgttaggaagacctctgggcatgaggcaaaaaaaaactatgcattttcctgtttcataatagcatgatatttaggagtgcactgtggctttaggagaaaaaagaagaagaaaaaggaaaaaaaaaaaacgagggggctcccccaaccaacctatgactaagggacataatccagcagcttcaaggagcacagagttgccaacttttagcatgatggagttacaatcaggattctgagtgaccctaggcaactgagttagtctttgtgcacctcgttttcctcatttggaaaatgggagcattaaggtcaatcaacatggttgctgttgaagattttttttaaaagccaaaaacagatttaccatagatactgggcctggcacataagacattttaaaaataatctaggttgtttcttctccagtaaaatgggaaattgatgacagaacattctaacatagccaatttcccttcctcttccactaagactatgagctcctccaaagcagaaccatttctcacttactgacctaaactcagcacttactatagcactgaccacatgcttgctgaaccagttaactcatttccaacatctctttccagcttaagcattctagggatctgtaccttcagatctggggcagaattagttgcaggtatttatatgtcctatatgtttggccacaaagtacttacacttctacaggtgaaaaattaccacaattttaatgaaattaggtaatcagttttttaatgccctcttcatctgctaaaaatatctgctccatgagggaagatacaatattttgttcagcatcatatccccagagcctggcaagagcttcgtaacagatgtaaacatttttgaatgaatgaatgaatgaatgaatgaatgaaatgaatgaacgaatataagatctttgcaagtttaagtaaggcagaatttcctaattttagcaatccttcctaattaaattcaaagttgctgcatttaggtatgacaaaatgtttaaaaataaaaacagcagatgtttgatctctgggtggtagagaaaatttctttttttaaatccttgatttattttaccctgcaggaagtcaaccaaaatactggcacccaaaaagctcctataatatgtcagcctaagtcaaacatattctgcatctacaacgatgactgttaccagttggtgtttaaaagtattttgactactgatctctgaacatatcaacttttaaaaatcatttcagctaatgtaattttaagataaaggaacaaaatcagtagccaaattatatgaatctgttcaataatatgacttttattcaacaaagacaaatcaggaacatatgggggttatggtgagaatcaaaaattaacttatctttagagaatgctcaaaactcactcactaattcagcaaggatacaattctaacgtccaggaaattccaaagggggaaaatgggacacgatgactaaggacagatgtttagactccagggtctgcgtcacacacacaaaaaaaatacccagcattgattctgatgcacaattttaaaaggtggccatacaaaggtcactttttggtagctcacatttactgtaatctgctacaaagagaccactaaagccagcacagcaaggtcagaggtgagagtctaggacaatcaacacatgctatttctgaggacaagccactttactaatctctaaggttctaattaccctaacaaaacaaaacaaaatgctataatgaaaccagcagaggacataagacaaacagtaaatacaaagtgaaccagcatcatcctgccattgttctgcagcaggagtctcagccgcccagacgcacaccttgcagcagcaataaaccagccatggcatcccgggaagaccagatcctcctccgcagcaagtcacactattttcttcaatttcagcactcaccttaggaagttttaaaaaggttggggggagggtcagaggggaagccaagcaggcttgacatgaagctcttaatgaagacaatgtcatctaacaaaaactgcaggttccagtgaaatttaactggagtttaaaaaatttacatagccttccttaaattaaaccctcatagatttaaagagaacatttgaatcataaacccaggaactgctaaataaatatgacatactcacagatttagagcagctgtaactttggaggaatgaatatagtcccactatgaagatgtctttccctctcttctaccagatttttttttaagccaactaaaagaagagacaaacctcaattttagagccaacaaaaatcctcaatttctattttattccttggtctccagtgagactctcaattctcaggcacaagcaaagtagttgccgaggcagctgacagcatcccagggctttccagggcagaatttaagacatgtcagttaaagtggcagctacactcactgctgtagcggatgcttctgcaggaagggatgccgggagattttttttcccccaatctctgctgcagcctaattctaatccatcactgtttaattatctagagaaacaggcaaggaacatacaaatggcctggatttataaaaaccacagaatattttcatgatttttcacctaatccagggattcatgtcctatctaaaaagggacaattaagaaaaaaaaaaaagaatgatcccttttgtcttaaggaaaaatgtaggctgttattgccgactgagacgcagattttatatcatggactttaaaaaaatactaaataagagaaaatcaacttttcccctaagtttttagattaatgcacaaaagttaaattagcaaagggaattaaacacatatatgacatgacagtcataccaagatagttggaaaactccacttttaaattgataattgatcaacaatatttgaagtggttttgatgaaactagaagatagtaggcataggaaatactagttcaaagaccctaagatagaacatagttctaaagttcagctatacttttttggtttaaatagataaaagctctcctggggaataaggtggtcgttgacttcacaaatttcttatcttgcctcaagggctcttgcacatgctagaattgaaacgtttttagtataggactcactaatttttctaattataaaagtaataccagggctaggcgcagtggctcatgcctgtaatcccagcacttagggaggctgaggggggcagatcacaaggtcaggagttccacaccagcctggccaatatgctgaaaccccatctctactaaaaatacaaaaattagctgggtgtggtggctcacgcctgtagtcccagctactcgggaggctgaggcagaagaatcgcttgaacccgggaggtggaggttgcagtgagccaagattgcgccactgcactctgccctggatgacagagcgagactccatctcaaaaaaacaaaaagtaataccaggtaaaatattgtggtatttccaaattataaaatagtaaattccttggaaagagctaaaaaacaaagaagaaaattaaagacagcctgtaatcccagcactctgggaggccaaggtgggtggatcacctgaggttgggaactcgagaccagcctgaccaacatggagaaaccccgtctcctctaaaaatataaaattagccaggcgtggtggcgcatgcctgtaatcccagctactagggaggctgaggcaggagaatcacttgaactgggtaggtgcaggttgcggtgagctgagtagcgccattgcactccagcctgggcaacaagagcaaaactccatctcaaaaaaaattaaagccagccataatctcataacccagagataaccactcttaatgttttgcaataatatacttctagttttcttcctctctatatatatacgcgcatacacacacacacacacacacacatacatatacatatatatatatatatatatatatatatatatatatgtagtatatatggaggggacaagacagctaaatgtatttttgatactactattttaaattacccttttcacacagaattgttatgattatttacccaaaaatgtaccctatagttaaccactcatatttctaaaagttcaaaagagcatatgcaatgacagtccatttgtatctgtatgcctactatgcaccaggcacaggggatatagcagggagcagagcccacaaggtccctgctcccctggagctctcagtccagttggggagccagatattcaccaaacgacagcaaatatcatgtgcgctgtactacaaaagaaaactatagattctttagaaacatgaaaagacctggtgttgtgaagttcaggctttttcaaggaaggaaaagagaactgcaagcccaaatgcaaaattattagtaaagtacatttcacaccttcatttttccatcaatataaatatctctcatctaatttttcttttttcctttcaaaattaattaagtccagcttccaactacatttttgtggataatatgtaacatgtaagagaataattgatgtaatgtgtacagatcttaagtatttaatcaattacaacatatcctttaagaaattacaaaaggtgggccgggcgcagtggctcacgcctgtaatcccagcactttgggaggccgagacgggcggatcatgaggtcaggagatcaagaccatcctggctaacacggtgaaaccccatctctactaaaaatacaaaaaattagccggccgtggtggcttatgcctgtaatcccagctacttgggaggctgaggcaggagaatggcttgaacctgggaggcacaggttgcagtgagccaagatggcgctatggcactccagcgtgggcaacaagagtgaaactccatctcaaaaaaaaaaaggatattaggtgaaacctaaggaaatctgaacaaagtatggactttagttagtgatgtgtatccaaaatggttcataaactgtaacaaatgtacgatactaatgtaagatactaatcgtagggggaactaggtataagggtctgtgggaactctactacattttctagttttctgtaaatctaaaattgttcttacaaaactgtctattaaaaaatcatctttccaagagtttcttagctttttctgatcactaataaaatacattccataaaaattctgacaatgcaaaacagttatataaaaggaacttttcgaaaattataaataccctgtaatctcaacacactgaaataatcccaaacataccatatgtatgtccttgcacaggcttcatgcatacatacacagataaacatatgtgtatcgttccaccccacatgctatttgataggtgtggtagtctgaataatggcacccaaggttatccaggccttaatacctatgaatggtaccttatatgacaaaagagactttatagatattagggatcctgaacagagtcattattgtgggttatttgagtgggccctaaaggcaatcacaaatttccttacaagagggaggtagagagacacaaaaaaacagaaggtggtgggaccatggaaggagagtgatttgaagatgctatgctgctggctttgaagatgcaggatgtggccaagagccaaagaatgcaaggaatgtagctctagatactggaaaaggcaaggaaatggattctcctctagagcctctcaagggagcacggccatgggacaccttggttttgacctagtgaaacccacttcagacatctgacctccagaactgtaagaaaataaacctgtattatgtgaaaacaccaagttttaatctgttatagcagccataggaaattaatgtagcagcctgacggacctgtatttcttcttttaattgtctgcttatgtccctttgccaatattatcatcaaagtattctctttctgggtctgtttgcagtgttaaccttctttcatatatgttcaagtattttctctttgaaatgggcttgtaagggttttgtcataacaatcaaaactatcactcttttttcctattggtgccatgtttgaaacagacttctctacccaaaaaaagatagaattatatgccttaatttgctcttaatatttaaacaataacatctccaactattgtcctttattactaagaaccatacaaagcaacacatccctgcacatgtgaacctctcccctttgcaccctggcccctggctcagtgtcaacattgagacttgactggagaaaaaatgtggactcgagacttcctggacactcccattccatacccacatcccctttgtcaagtctgtccccttaaaatagcttaatgcttgatgtaaaggatgtgttcaataaaggcttgttaaacctggggtgtctataaattcataaaaccagcattaaaaaaaaaaagaaccatgcaatgaaggcatcctctccttccttttccctgttttgatggagtaggtctcagaactgggaaatgaccagggataattttatttcttagatatttgttagattttttttaatgtgttctttttttaaatctttaaaaagtgtttttatagtttaaggtagccattgtgagactgtatgaaacagctatatgaaaatgtcttacatcatgaaagaaataatgcttttacaaaaacagcagtgctcttcaatatattatatgtatatactatgttacgtttgctttacgctttgcagttttacaaaatgctttcaaataaattattttgtaggttaaatacatattaccaaataatttttacttctatgggattgtctgaaaaggtatccttatacaagtttagtaactaagttctgctgaaaatacaggacccatctactgtaccgagacaaagagaatgtatcgtttaaaatacactttttaaataccaatcacaggcttaattttcttacagtgattacataaaattattttaatcaaagcaaactacacattatgggtataacttctttcaaattaagctgaaatttttaaatggcaaagaatcccttaagccaatgggagatctgacacacataactttatacacacacacacacacacacacacacacacacaaacacacacactttttttttttttttgctgcataaaagtcaagttacgcttgcagaaaactttcctaactactaaaataaataaaaatcaaaagcttatagctgtattgcctacaggggagaccaaatactatgcccacacctttgaaaaggttaattcatcagagctatatggagttttaacatttttcattctaactataacattctgctcatcaggtaattttaaaagaccgctgctggtatgaatattttcattctagacaataaaaataaaataaataacatagaaattactttatacaataataaaagttatatgtaaatccccaaatatctcttcagttttaggcaatttcagggttcttccaatttgttgatggctattaagtcttcagactatttattagatgtgcatcatgcatggtactgaactatacactattcaaaaatgtacctaaaccaaatatcactatgcctttgaggagttctattctctggtcgtagaataatgttccacaagcagagacaaaagggggaaagagggaagaaggaaaaagaaaggagaccagagaggctgatgattttcggaacacaagcaatgaagaagtttggcgcatttcaaaagacaaagctcccaagtatatgcttttgggtgttttattagtcatcttaggttcctatttttatcgtgaggtagatgaaaagggaatggatgaaggcgtcagaaaaaaaaaaaggatgtcaggtgaaacagggtaaaaagttaacaaaaggcaatgagctcactgtatcctttaagattctgacactcatttatgcaaacgtcaagtgaaaactgagtcagcccttcagagaaaaatggcaatggagacaccaacaattatggatagtgtttactatgcccaaacatttggactttatttaattatatatgcatttgagtttatgaacacaatcagccacagtctttttttttaactgtgtattccaaaagatcccttaactaaccatttgaataatcacagcaattatcactgtgccctatactcattaggaactcaatggtggctacatttttttctttaatttactgcaaatcctagcagtctactctgaggatccacctatattttcttaatagtacatgctatggtttaatgtttgtgtccctccaaaattcatatgttgaaacctaacccccaaagtgatggcgtggggcctttggaaggtgattaggtcatgagggttccacccttgtaaatgggattagtaccctaacaaaaaagcttgagggagtctctttgccctttttccttcttcttttttttttctttcccctctttccactattttctgcttccttctaccacgtgaggacacaaagaaggcaccatctatgaggaatgggccctcaccagacactcaatctgctgccactttactcttggaccttgcggcctacaaagcagtgaggaaataaatttccattgtttataaattacccagtctaatggattttgttacggcagcccaaatggactaagacagtatattaatttcacacattcattttttcaacacatatatactgagcacctactatgtgacaagcatggtgcataggtgccaagtacaccatgacaagcaaagtagatcagacccatcgttatagaacttggagctcaaaaaaacagatgatcaaaaaacaagtaacaattaactgcaaaatgagaaatggagtgatagaaacaaacaagatgccaagacagagaaatgggggaagactaactgttttggtggagtcactgagaaagtgggaggacacgccagctgagagtggaggatggccagcaaaaagccctcaaaagagtgagggcaaacacgctccaatccggagcagcacagggtttactctcacaaaaaactgtataaggcttgtggctggagggtcatgcatgagggcaagagttgccctcgatgaggcagaagcagtatgtgggagcccaaccacctcaaaccttatgaacaaaggtagattgggtcttcagctttagacaggaaaactcatggatggattttaagcaagcagtgacatcatcccatttaatttctaaaaggatcactcttgtcctgattcacacaaacatactgttaaaaaaataaatgagacagtcggagaaatttgagcactgaccagttactggacggatattattatgttttaggtgtgacaacagtcttgtgattttttaaaaagcgacctttgcaagctaaatacagataaaatgatgtcatataaagcatacagattaaactatagctctatatcaatgttaatttcctgatcttggtatctgaatggtaattatgaaagagactgtctttgttttgaagaaatatattttaatatatttagaggtagaaataaattatcatgtctaggatttgattccaaataatctggggataggatatggatgaaataagattggccttgagttgacaactatagaagctaagtgattagtatataaggtttggtttactatcctctttactttctgtagatgttcaaaattggtcatattaaaaattttttttttgagacagggtcttactctatcacccaggctggagtgcagtggcaccatcacagctcaacacagcctcgacttctgcggctcaaatgatcctctcatctcagcctcccaagtagctggaactacagatgtgtcaccacacctggctaattttttgtattttttatagagagggggttttgccatgttggtcaggctggtctcaaactcctgggctcaagcaatccacccgttttggcctcccaaagtgctgggattacaggcatgagccaccgtgcctgacgcaaattatcttatttttaaaaataattttaggccaggcacggtggctcacgcctgtaatcccagcactttgggagtccgaggtgggtggatcatctgagatcgggagttcgagaccagcctgactaacatggagaaaccccgtctctactaaaaatacaaaattagccgggcacggtggcgggcgcctgtaatcccagctactcaggaaggctgaggcaggagaatcgcttgaacccaggaggcagaggttgcggtgagccgagttcgtaccactgcactccagcctgggcaataagagcaaaactccatctcaaaaaaaataaaataagataacttgggctgctgtatggagagtaagtggggtgcagttggaaaagtagagggagagaacaaaagaagcgggaacacacattaaccattagccagctcttaaagtagtccaagcaaaatcttatagtcacttaagctaatgtaatagagcggagagagaggaaagtgaacggatgggaaatatatattggaggtagaaatcatcagacttggtaatgtggaaattaaaagaaaagaaaggaatcaaagatgtctcccaagcttctgacttgaacaaatgggtggatggtgggtggagacatttacagaaaaggcaaagttttcagataaacaaaggaggtggataccaagagttcagtttgggacataaaaattaatgtgtttgtgaaacatcctagtgagtgataaaagaagcaatgattggacctctttcccattacaactaccaaaatagcccaagacagcagcagggagcagcagccatgtcaagaaggttacttatggaggaggcaaggaactcagtgtaagagcaaagtcctggctttcagacacaagctgagcattgctaccagggctgagaaagtcagagaggacactgagcctgcagaaaggcaaccacagtcacaaagatcctgctcataggggttcactggtcattcactttgcaccagcaacaccccaaccacgactcagtcttccatctctgctgggacctccttggtaagatgagataattgcaccaaagtgttgctaaggagctttccttcagaggctttccttcaagtgatgaaatcttgtcactcctcatagtgaaaagcagcatttataggatctatatcttaaaacgtgtactacacacattctccttccccctgtgaatttatatgaagaacttcacagtggcaggtctaaacacaacagcagaccattagagtagatctaacaggacaaaagaaaatacaaagagaagcaagcccagtggtaacagaaacaaggaaaaaacaccaggaatgctgtttaccttgagctttttaaagaacttttatttccatttactatataccattgactctatgacacacaaattttcatcatggaatatccctaaccccaagatacatcttaaaattgacagcaactttgactgccctaaatcaaagttatgttcttagggagaggatctgcatttgcttctgccaattacctgaggacaccaccaacctgatccacttaaagttaaataacctgcttgaagttgttgggggttacaccatttatatgtattcagactccaaaccagcttacaattcaaattctaaagggcattaaaaagttaaacataggttcaccatgcaacttaccaattccacttctgtgtctgtatggcagataatttaaaacatgttcatacaaagactgtacacaattgtttatagcagcattattcacaatagccaaaaactggaaaagactcaaatgcccatcaactgatgaacagataaataaaatgtgatatattcatataaatgaatattattcagccataaaaaggaatgaagtgcagatggtccccaacttaggatggttcaacttgcaattttccaacattatgatgggtttgtcagggtatccaatgcattttcacttactatattttttatttatgatgaagttatcaggaggtaaccccatcatgagtcaaggagcatctatctgtactacacattctatgacatgtgtagacacaaaataatacatattagattattccatttatataaaatatctacaaaaattaaattagtggttgccccagccgagggtgacagaaattagattagtggatgccccagctaagagtgggaatagataatgactataaaaaggcacagatttctttttcagacgataaaaatgttttgaagttagattgtggtgatggctctataattctgtaaatacattaaaatgcattaaattgtataattaaaataggaatatatatgagatataaattaatattgcaatagagctgtttaaaaaaattctctgagtggagaatctcattagagggttttttttccttccctacctaataccaagattgaaatatacacatttccttactgtgccttcctgcaagatgattttatttttcctttcctttatgcaaggtctcctacaaaattcctcattgtgtttttttttttttccttccttaggaatatataagataacaatatgaatggcatcttagatccaataaaatcactgtcgacttggttaagaaaatcaaattaagagaggacaaaactccctttccagacttgagtaacatttatattacctacaggggaaaattggggccaaaaaaaacagcagagaaaaatgaaaacaaatctaactctccctgtagttactatttataacttaaccactctgaagaaaaatatcagatgttttccaactatcattcaccgatattcacccttaattaaaacaggcaaaactattgtatcaccaactgatctaacctaatgaggggaaaaaaaaaatggccctaaaagccttacttcactctcatctacaatttatggttcgaaagagaaggtgtggagaaggaaaaagtttgtgagaaatgttataaaacaaaatatttttatactacacttgatcttagacaaaaggccaagaagcgatcaaaatatttttatttctattgtaagcttctaattacctggctaaaaaaatctgcctatttcaccttctacaggtaagtacaaattcagagcagttcttgaaaatagacacatacatccccactgtattcacaccacctcaggattccattgaacacatatgagtttctatgtaaggataaatttgaaatttccgtaagatgctctggaatatgaaagaccactgctgagaatatattaaacctgcatctgttctaacagtctttgaacataagtttgatctgtctcccctgacttctctaaactaccatgaaaagaaaatcttaattaatcagtgcccaaccaggactcccggttagatttttgtcccattgcccacagtggtttttatgagaaagaggttaatcaaaaataccaccagccaggtacagtagctcatgtctgtaatcccaacactatgggaggcaaaggtgggaggatcacttgagtccaggagttcaagaccagcctgggtaacatagggagactgcatctctacaaaaaataaaattagccaggcgtgatggcacctgcctatagtcccagctacttgggaggctaggtgggaggagcacttgaacccaggagtttggggctgcagtgagttgagaacgcgccactacactctagcctgggagacagagtgagatcctatcaaaaaaaaacaaaaacaaaacaccaaatcacgatgactgtaagtggttagtccattctccccactagacaagaccaggaatcctccatgacccaacttcatttgtgtccagggccccactggtgtttcaaacccactgctctgtgctctggccactgtcctcagaactgttcacccagcatgtccccacctctgaccctctgcactgcctctaccaactgaaatgccacccatccctcaaaacccaaagcaaatgccagcacccccatctcccaaccaaaagatagctttcttttggaattcccaaaacacaatatttactcttcacatgccatatcacagttaattatcaacagatttattatacccaccactacattgtcagagatggcaactgggcactaacactgagaaaagggacactccgtcatcagagcactagaagtgcaaaccagcatggaactgttaaataaggaagcaagaaactatagctaatctagaactgcatgttatttgtgacaaatttctatatatcatgcaacaggtccttaagaggtcacctccttatgccgaacaggtcataaagttcacagactattttaatttttattttttattttatttattttattattattattttttgagatggagtcttgctctgtcacccaggctggagtgcagtggcacaatctcagctcactgcaacctcggcctcccgggttcaagtgattctcctgcctcagcctcctgagtagctggaattacaggcatgcgccacaaagcccagctaatttttgtatttttagtacagatggggttttggtatgttggccaggctggtctcaaactcctgacctcaggtgatccacccacctcagcctcccaaagtgctgggattacaggcgtgagccatagcacttggcctattttaatttttaaaaagaacatggtcaatgtactactaacatttttgtacatctctaatttttcctccagttctaaatggtggagatttttgtatgacctaccagttttattttaacagttttattttattttattttgtgttattttaactattttgagaaactgccagaaaaactagcaatttctcaaaatagttaaaataacacaatcgttaccacaaagatccagaggtaggaaaaatctgtgttgagagtggtaaattcattaggcagaaaaagaaaaataagaaactatttgctttgtggaaacaatttaaggcctccttcatctgttagtgtgaatcctttcattaggcattcaagagaaaatactcactggaagaaattaatcatcaggttggcaagagcactgcatcttgatacagagattgaagcacttgctctctgcaccagaaacataagatcaaaatatatggttcagtaagtgtaaggaaaaagaactctactaagttttgcagaattcacaaagggaatgttatagtatcaccaatttaagaggaaatgtgagaaatattgacaaaccctgaaattaggacaaacaaaaagttcacataaaaacaactgaagaaattttttacaattaacatgtatttataatcagaggcctctgacttggactagaagtccattacttctcctgtgtctccagcttgccaactgcagaactggggacttctcagcctccataatcacatgagtcaattccttacagcaaatctcttcatatatagacattttatgtctcctattggttctatttgtctggagaacccacactcttacaagggagagcagaaaagtaccgatgttcactgagcacttactatgtgttttactcccattatcacatttaacttaaatttcatttaatcctctcaataaatctatgagaggagaaaacaagctcagagaaactgcccaggcctcccagccagtaaatggcaaactgggactacagttcaagtctgactgtcaagtgtggtcagtcccgtctccccaggaagatacatgtagttgtgtgcatgaaggcaaaatgaaaccacaccgctgtgctttggagttttatggctgtgtgtaatattttctttgttctctcactgccattttttgtcatcaccaacaagctctgcttcggaaacaaccccccttacaatacctctcagaacgctgtaaggcaaaagtacgcacaagaccaaaaggcaaagtttattaaaatcagatcaaaatcaactgcagactctgaatggaggcctctgctacaagattcttcgtgtatggactccagcacctaatctggctaccccttctgattttgggctctatctctctctattaggagaagggttcctataatgtgttgctataaccaaggtgagaggagtggaacaattcagcaacattgaaaaggacacacaaacgtttaagcgacagtctaaaggacacgagaaataatgcacaccagaaacctaaaagagcaagatacattctaaaatggggaaacctttggatttgttaaactgagcaggacagggaagttaaaattagacaagaggaagaaactgctggcagataaatacagccacagagaagttctggaggcaatgaagggagaatgcgtggtcattagaaactgaggcagtgttaaggagctgcagtcttcaggatgagaaaaactataacagagttgacagtagaataaaagacaccaagacaatgcttctcgaattccccactttaacagcacatgaaggggtttctctagcaaatatgaaggatgaacaagctaaaaaatctaatgtacaacatgaggattatagttaataagaaatagtacactgtattcaggatttttgctaaattaaattagatttttcttccttgccacaggaggaaaaaaaatgggtaactaggccaggcgcagtggctcatgcctgtaatcccagcactttgggggaggccaaggcaggtggatcacctgaggtcaggagtttgagatcagcctggccaacatagtgaaaccttgtctctactaaaaatacaaaaattagctggacgtagttggcaggcgcctataatcccagctacttggaaggctgaggcaggagaattgcttgaacccaggaggcagaggttgcagtgagctgagatcacaccattgcactctagcctgggcgacagagcgagactctgtcttaaaaaaaaaaaaaaaaaagggaaactatgtgagatgatagatatcgtcatttgttcttctatataacaattttactatatatatatatatatatcttataacatcatgttgtataccttatatatacacaataaaatttattttaaagcaaaaacaaaaagtacacaaaggggtttctgatagtcacgaatcaaaagcatctccatcacaggagtcattttggatgatgttctgagaaccagacaatgctaatattaaaccatctaactcggttgaacaaaagagttgtttttgtgcaaacacaggcatctagatcaaaggaactgaatggaaagcccccaaacagtgtgttattattttaatgaacttatttgacaaaggaggtatcaaatataaattgtttccctcatggacctaacaaatggtgctggaatagtgggctagcaattttagggctggtgtgagataggaatctaaattaacttcagctgggttgaatttagggcttttgtttatttctgtggtttgatttttttaaaaactaatagatgttaaaaaaactgcttgcaatgccttcctgaggtcccaaaggtaaagccactaccagcctactgaagccagtgggagctcagagaagcacaagcatcaatgtgcactgctcaggggtcacactgctcccactggtcagtgagacccgtcctcctctgtgaggtctgcacccctctctgttgtgtgtggcatgctagctcccgctgggaaaagcagtgtctcctctggtgaactccaatcaccagccccaaggcctgatccttttccatcccctggactgtgatcacctactatagcccaagctcaattcctgccaacaccaagggaggagcagggttgaataattataagatttctgaatggcgatcacttgcccaccatagaagtgatttcttaaaaatcacataaacagattatcttccaaagagtactgtataaaaagggaggaggggaaaaagggcaacttcacagtggaaaaacctgacaaacactacccatgccatgtgaccaagttcaacatcggtagtgctaagtcacattgatatcgtggatctttgctatgatgtgataagaatggccctttccatctggggtcttcttcccaaaaacacatgaccacagtcaaatcatgaggggggaaaaacagaccaatctcaattaagggccattctacaaaataactgacagtactcctcaaaactgtcaaggtcaccgaaaacgagagtctgagagactgtcacagccaagaggagcctaaggggacatgacgactaaatgtaaagtggtatcttgggtgggatgctgaggcagaaaaaggacactaggtacaaactaaataaatctggataacgtatggactgtagttaacaataatatatccatattgatcattaattgtgagaaatgtaccatgctaacttaagaaattaataatagagaaaacctgggtggggtacacaggaatactctgtactacctcctcaataattctgtaagtctgaaactgctcctaattaataggttaatcccaatcacaattaagttttttttttaaaaaatcatataaacatgaaacttttggacaaaataaaaatgtataatactaaaataaagaaaaattgcagtctggaggaaatatctatagcaaatatgacaaaagattagggtatatataatttaaagtccataagtatgttaagagaaacattctgaaaaaagctaagagacaaaagaaaattagaagtcatacaaaagatgcaatgtatttttaaaataatttttaaaaatactaaagtaggtatcatttaagttgcaaaactgtttttgaaataatacccagtgatgataatgtgacagtttaaaccactttgcttacatagtattggtagccaagtaaattgataatactcctgtggaagtactgtaaaacaaacggtgcccctctacccccacctgtacatgcacatgttcaagcccaaacccccaatgtgatggaatttaaatatggagcctttgggagacaatcggatttaaatgaggtcaggagagtggggtcctcaggataggattaacacccttataagaaaggacatcaggcagggcgcagtggctcacgcctgtaatcccagcactttgggaggacaagaggggcagatcacgaggtcaggagatggagaccatcctggctaacatggtgaaaccccgtctctactaaaaatacaaaaaaaatagcctggcgtggtggcgggagctgtaatcccagctacttgggaggctaaggcagcagaatggcgtgaacctgggaggcggagcttgcagtgagccgagatcgtgccactgcactccaacctgggcgacagagcgagactccgtctcaaaaaaaaaggacaccagagagcttttgctctcactctctcggccatgtaagaacacaacaaggaggcagtctgcaagccaagaggagagcccctaccagaatcccaaccatgctggcacccttaactcagacttctagcctccaaaattgtgagaaaataaattattgttgattaagccacccaggctattgtgttttgttatagaagctgaagttaactaatacaggaaggcaattagagatatacaaagaacaataaacatattcatcccttttaattcagtaatcctacatttgttatgttaacctttagaaataattcaaaatataacaaagctatacacatgtaaaacttagttctacatttctaagccagtgacaacctaaatgtctaacaatggagaagcaggtaagtaaattgtaatattccatttgatctaatatgatttagcaatttagaattattacaaaaactatataggcttacagtgaatgcttttaataaaactaagtgcaaaccaaacacaaaaatctacaaaatgagactgacataaatatgaacaactattaaaagagttagctataaacaaatactttgttgagaaatattttattttgttacaagaaataatactcagaaatgtatctgaaagtattagatagatcctttcttaaatataatcacatcctctttaattatagaaaagtgactttttttttctgaaaatagccattgccgtactctccaaaaaatgagaatgaaatatttactttttatgtaagacaaccatcaatttttccttactacatactttttattatgttattacttacattgagatggtttccaaggcatcttcgaaaacgtcctgggggaaataaaaaatacaatgagtttctcaagaattctcaatgggtttctcaagaattctaaaagagaaaatgaatacacgcattggggagagtggtcctggcaggaaggtatagcaggcagtagaatcaatcaacttaacgcttatggaattctgtttacagaaatcaagcagatgcatttcagtgacgtttaattttttttttaataaggctggtaaaatactcagcaagtgatcaaactggcctaatttaaagagactatgacgtcttttatgaagttacctttcactcctaaatctcattcttcccaactatagagtaaaataaataagaggacttgcccgatgtagtcttttctttctccatggctagccaagtgagcatcctctgggccttcatttcacatattgcaccaccctctcagctcgtctccctgccaccagcctttcccccagtttactctgtgccacacaggatagccctttgcttcatgccactggcctgatcacagctgcaacaggagagaaacgcacacagtcatatgcactcagaagaccacacacacactccacactcagacacagtgactcacacacaatctcacagtcacacatacaaatacacatgcactcactcaaaaactcacacattcacaacagctccctcacagctgcaaaaaccaaacctaagctcctcatccaggtatccggggtccaccacaacccagcttaatcttccaagcatccttctctgacatccctaccactcttaccatagcccaagccacgagacctccaaagggccacctcactggtctccctactcctgtgcttgacaccctccattcaattcttcacatgacaacaatatcattcttttacttcatgtttttgaataagcatacaccattccagttttctagacctcttcaagagctttccattgcatttagaaaaatcccaaactcattctccctatctacagagccctaaaacagccccgccagcctctgaccacatccccttactcactcgactccagccacaggtctttctttccgttccttggacaagtcaaacatcccacagctctctgcactgtcccctttcttataatgtcctttgctcaattattcccatggctgactcattctcatcctttgattttcagcttagaaagccacctcctcaagaagaacatctctgatcaccctaattaaaattactaggaatagcagcttacataaagttcctcatcatttcatttgtttcattcatagcacttatcataatctctaatgatcttccttgtttacttggtcaccctctgtctccatcagagcaggctcttacatacacagaaaaaacaccagggcttcgcaccagggtttgctcaataaatacttgttgcctaatgaatgaatgaatgaatgaatggaacctggaccgccaagggacttaccgtatcacacctcatttagagttatgcacagaaatgaggaaagggggctagggatcttttcccttgtgtggccattaatactgaacaaggtttagaccatactggattctgcggtgaggcagaaaaaacaaaagtgtaaatactaaaaagaagaacctggccaggcgcagtggctcatgcctgcaatcccagcactttgggaggccgaggcgggtggatcacaaggtcaggagttggagaccagcctggcccacatggtgaatccctctctctactaaaaaatacaaaaaaattagctgggcgtggtgacatgcacctgtaatcccagctacttgggaggctgaggcaggataatcgcttgaacctgggaggcggacgttacagtgagccgagatcatgccattgcactccatcctgtgtgacagagtgagactccgtctccaaaaaaaaagaaaaaaaaaaaaagaagaaccgactggacctggtggcttacacctgtaatcccaacactttgggaggccaaggctggtggatcacctgaggtcaggagtttgagaccagcctggccaacatggtgaaaccccattcctactaaaaatacaaaaattagccaggcatggtggtgcatttctgtaatcccagctacttgaggaggctgaggcacaagaatcacttgaactcaggaggcggagcttgcagtgagtcaagattgccccactgcactccagactgggcaacagagcaagactccatctcaaggaaaaaaaaaaaaagttgtaaacagtggcagaactgagtttgagtttgggaccctgacctattaatctacattaatatcatactccataagggaggtaaaatcaagggccagcacacaggttatcatgtgagtagttacagagaagggaggaaaacgtattctccaggaacccaaatctcactatgataagcccagctcatagtccctccggcagctctgcagactccctctgcacttaccaacaatagggtacatggacagcccactcctgggagccttctgtgccttctcctcctcctcacaaacctcagcatggacactaaaatacttactgagtgagcgacgcaaaggataacttgggaagccaaccctccgtgtaaagaagataagactaatattttcatctaaacaagaagtattcccacccctccatcaaaaaaagaaaaaaaaaaaaaagaatatcaagccaggtggtgcacacctgtagtcccagctactcgagaggctgaggtagaaggatggcttgagttcagcatggacagtatagtaagaccctgtatctaataacttttttatttaaaaaaaaaaacacgatttcaagaatatcgaaactctccattttgttgaaacagtaatcacggggcagagagttttctaaataaagcatatgtggtctataaaggccagacaaaaggtggaagtgtcttaattttaaaaaaggaaaggtgaagagaagaactaagatttactgagtacctatcatgtgccaggcaccttacaaccttacaaaagctatttcatgtgttcctcccaacatacagcaagttaagccagttgtagtttaattacttgcccaacattacacagtgaagaaactggggttcaatctcaggcttaaaaccaaagcattttattaatgtcaatacaaactatctaaaacttggaaattagacagttgggcaggatggggagggggtgggagatgaaggggtgccatatcctctcaatgtaatatggtagcattgttttacaagcctcccaaggattatttaactctctagaagagtgtatttgtgtttaattttgccatctgctgtctgattggagtccgcacactgtgaagttacatgttgacttacaggatttttagtggcgaaaaagactacctcaaagattatgattttgctgctcagtgagacagcagttcccaacctttttggcaccagggactggtttcatgggagacaatttttccacagatgatgggggacagtgaggagatggtttcaggatgaaactgttccacctcagatcatcagacattagattctcataaggagtgcgcaacctagatcacttgcatgcacatttcacagtagggttagctctcctgagactctcacgccaccgctgatctaacacggggtggagctgtggtaatgctcgcccgcccaccactcacctcctgctgtgcagcctggttcctaacaggctacagaccagtaccagtccacggctcaggcattggggacccctgctttaaggtattacccagctttatgtataacctagcaatcttaatctaacattcttccttaagcttataaatactagttcctcaaatactgtttggatcaatttaccatttcactggtttcctaattggtggatgaaataaaattttgacatgctcatttatatctttatgagactcttatttccaattctgggaaattatacttggacccggagatggccaaccgctctctccctgggtaccagcaaatacagtttcctgcatccttgggaaaagtgatgtggggtccacgtggaggatgaaacaccaaaaggcagagactgctcatgcatctgttccatatccctacagaaagaccagtgcttcctttccctcctgtctgtcttggtccccacactcagttcaaattctatcccttttctgctgctgcctcaggaagctccttttccttgtgtgagattcccatcagggcccctaggtttggcactgacagctattccacagtctcccacctggccctcagtagtcacgcatgtattcttcatgtagcagaactagatgtttccaccaaagtctctttgcttctccatactcaccataaatttcctagtgctcctccagtgttggtttcccttagctccccagtactggtgggctcaccgtgtgccctccagttacaacacgcacactcagaggagcatcctgactccttccaacataagtaaagtaagacaggagagctcacactgccaacaaatacaaagtgttacaggaaaacctcggtgtttagttccctccttaaaggcagctgcatttgcctgccctactcccataccagggccaaccttgaagtgctactactgtagggcctggtgtaacagatgttttcattgaaccacacctggctcccaaataatacactgcctccaaacagtatctaacttgttcaagagcctatcttgactctctagttggagtcaagcaccattctattctttatgaatctgctttccagcccagcacagtactctgtacttcatggactcttagcaaatcatggttagctaactaactggctgagcacccttgtctggaggtggaaggtcctcaccttgagcagtttcattttgcacgttaaaaaatgggctcacctgttagttgaaggattccctaggtgagctgacagatataaggccagcacccagggcctgctgcctcctgggagatcagcctgaaccctacctctgcctccagatcatagaaactgccatcctgatcgtagaactgacacagagtgaggaaagctgcatcacctactaaggcttttccaaacaatttccatcttaactcgctagctttgtcatattctgagtagcaaaaatgcatgcaagaacatttgagtggaagagcaggttcttgatgttcatttaagaatcttaatgaagatattaatgacaaaagtgtttacattatttttatctctagagaacaaagagtaaagatgacaaatatgctattaacagtagtaatgtcaatactctccattaactgccaaagagaccaaatagatttacaaatttttcaggcctccctatctgatttttaattcacttcgtggtttgaaaaggaatatgtgacaaatattactgcaagaaggaaaaggaagtaggaagtaacatgacaaaaaataacgccaggtactgtaaatccacaaagctgtatcgcttctctagaactccgttcctccctcctcctccacattcctccctcctcctccgcgttcctcctcctcaccctcagccctgtcctccattttaccatctttctcatagggatgacttcacaggcctgagaacagattctaccacgctcatttaaccaccgcactttagcaaagatgacaaggtttgagagggcttgcagataccttcctcctcaatgaagaccacaggtgggcaggtgcccacccccacacaaccaggccccttctcactggagctttcccacccaacattccattccactgaccaatgaagctgtgtgtttggtatcatggactcaaagaacgctacaactgttgagaactctggcaagtcatgaattcttttggggcatatctggaccattcccatggagatgagacatgaagaggatgccccaacttccccccaggactgaggcagggactaagagccatgggtattaggttctacggaatacaaacacgtgtctacatggcatccactcctgtaaatcaagatgtccaaaatgggaaaccagactgacatcagaagcattatcatagtgactgacacacctggaggattcctcaaatattgaatttctctcataaagagaaacagcacattcctagttaaaggaatcatatgagaaatgcataaactcaagtcacatcactccctattaaaacttgaataaagtactgatttttctaagtcagaattaatttaaaatacacctttattattgtgcaaaattcattttaaaaatatatacgtaccctgagctcatctgttaggaataatttttcattctgctcacatttatcatccaattctctgtaatctatttgtcaagttcaaaaagtagtccatggccttctacagcatttaaactctccaactaaatcccaaggactaccaactagtcgcatcttatctgcagtgccacatttttttaagtttcatattgcatgaaagagcatcaatgttctttgatggcaaatgtaataatcagcttcagctcccccataactgggtttgcaaaggacaagcacccctcataccctccttaaaggattagcatcaaagcaagtcctttgtgaaaccttaactgacctacagaattcttaatcaaagggaaagaaagcaataggggcccacacattagacacactcacattccaagtccccacctgtaacgactgttgttggtccttgcagggaacaaaacatgaccttctcaaatttcaagtatcacacctgaaaaaaaactaacactaagtttatcttcttaatttgtccaggtttgtcaaattccaggcaataatttttttagatttttttaatagacttagaaaaaactggagattttcaaacattttttcagaaatagggattaaaaaaataataacagcaaaacaacagtaaaatcatctgccaaaacataaagctcatgctttagaaatttttaaacattcatcagttgagattaaaaataattttccatgttctccaggtgtaggattaatatagttccctggttgctcttgtgccaggtaagtgctctcatataatcccacgtaaattctgtttttttttttttcctgagatggagtttcactcttgttgtccaggctggagtgcaatggtgcgatcttggctcactgcaacctccgcccctccagttcaagcgattctcctgcctcagcctcccaagtagctgagattacaggcatgcaccactacacccagctaattttgtatttttagtagagacggggtttctccaggttggtaaggctggtcttgaactcctgacctcaggtgatctgcccgcctcggcctcccaaagtgctgggattacaggcatgagccaacgctcccagccagttctgtgttcctttgtattgctttgtttctctaggccttagggttgatgaagtaaggttctatgttttttaaagcttcatttttaccaaaaaatcacagatctaatagtagaaactggggatatggagtaacgggcattttaatgggaaagattactttctatgcatttaggaactaccagcatcgatacgccaagcgctagtgaaactgcagcaaaagagtccttgctttaaggaagtcttctgggagaaggaggatacgcccatgatgaaaccaccaggtaaagggacctcacttcatcaggagatagaggaagggaggacataaggagcttggtggggaaggaattaggcaggtggaaatgtataaggtaaggccccaaggtagaaaagagtttactacagtcatgttgtctacagttgagagaacaataatgcccacagagctcactattatggattaaaggagcagaggagaaacggaaacatagtccatcttcactcacagtgtttacaaagtgctagtaataaagcagcctaaaagtgatctacacacaatgcctttaagatctttttttgaaaaaatttaaaaagacctcaggaatacaggagcattttcaatgtcacatttgtaagaaacaaatgctgatatataaataccatggaaccatgactgactaaccaaagtcccctctgggagcaggtagtttgctagtataaagggccctgtgccttgatttcaactgtcactatgtggaaaaatttaagaaatttaagaggttattagtaggacatcttacttagcctataaaagtcctttggatttggcagcagggttataatgaacttgaagaaaggagtgggttaattgcacctgcctggctcaccatgtggtttatcaacttcagcatgggagggccagatacaacacgagtgtgcttcaggcctgctgttcacccattctctcctcctttttcttccttagtatccctatagaaaatcctttcccccttccactctggagttatcttctgtaaattagagatgcccatagcacccaccctaggaagctgttgggaggaccaaaggagatcagaggggaaagtgcctggcatggagccagtgcccatcaaggtagtcatgacttgatgacatgagccctcccttctctcacaagcacaaaatactcctggatgtgtccacatagtcacaatacaaagtccatgtcatgtgctcaagtgtctaggaagcaaatctgcctctactccctaagtactacgcactataaataaatacacaagtgattttaattacacagcctgtgtagtagagcggaaagcataaatttaggcttggaggttagacctgtctgggactgaatcctggctccacctctgaccctaggtgagtccagcctttcaatcctctacttcctgttgtgtacaataaagattccagccgcccactgggattgtaaggatgtgagataactcacagaacaggtccgacttaaaacaggctcaataaatacaacttcacaggatattaaattctcagatatgggaccaaccagtagactcaggagatggggctgggatccctaactatacttcctcaacaactctttttcatgtcaaagatgctgagcctcttttggatgagagaaaagccgggtgtgggatatttacagcaaataggtagtgaaaaatgttaactccctttgccctctagcctttaccctctagcctttcactcccagacctttcttactagtgggttgcccagcataaaaaacataatttatgggctgggcgcagtggctcatgcctgaaatcccagcactttgggaggcagaggcgggtggatcacctgaggtcgggagttcaagaccagcctgaccaacatggagaaatcccgcatctactaaaaatacaaaattagttgggcgtggtggcgcatgcctgtaatcccagctacttgggaggctgaggcaggagaattgcttgaacccgggaggcagcggttgcagtgagccaagatagccccattgcactccagcccgagcaacaagaaactccgtctaaaaacaacaacaacgtaatttatgagcacagagcccaatgccacactgctccctggtagcacaaaacccataagttatggaacctctgctcaccaagaagcaggtgaccttggccaacatggtgagaccttggccaacacagtgagacattgcccaacacagtgagacattggaagacacagtgagaccttggccaacacactctatttctcagggctccagcctcctcatgagtaaagcagagaggctggcacagataccatcccttattcaaaatcctaagttctctgaattaaagagaaatccttcccaagacagtgttcgcccatcacaaattctaaaatgttcattcatccaaggaaggctggtgttcccttcagagaagggctgcgtccaaatggagcactgaggttttcaaagttcaagccacgtcaatgggactaacttgattctcaatagctagctagtgttaaatgccaagcgaagcagttcacacaatgattcttcggaatttccaacaaccagccaagcacagagaaatcacgagaattaaaaaggaaccaccagatgtcactgtcacaaaaaaaatttgaattgtatagcattgctttagtttctactaacacatagattagagagctaaaaaagaaatgaaaaggttaattaattatcggttatttaatttatggaggtgggaaaaatgttccttttctgcatttcattatagagttgagctgcagcttaaggcaggggttaagtcctaaggtcagtacttaaaagaaaaatcgtgtatatagtcaatcttaacattgaacaaatactttaagttgccattatcatagaatactcacagttctggacataaccccacagagaaataagtatatacaaaaaatatgcatagtgatatatggtatataatagagtgcatatgtaaaataaaacttttttacaattaggttatcactgaaatttaacataaatgagcaaattattttactctcctgtgcatatttctaagttactgcttttatggctgtacaatccaccttgtaaatcatttactatgtcaagcatatctatcctctagtgccaactctatccaatctacctaatttacagtaaacaggaatatctggggctgtttttgcagggagcaattttacccaaaacaaacaaaaacaaacaaaaccaagagactgacttttaatattttaatgtttaattttaaaaccatcaccagtggaggtatttttaaattaaaaggaacagaactttacacagtttcttcctataaataatcataagttccatctattaacacctaggcactatgttgaatactcacgtgcttatttctaattcacaaatactcataaaaagtgagcatttcacctctacaattactactatgttctaataataacagcaacaataacaggtaacactattgagtgccaaacattgctcagaatccttaacatgtgttaactcatttaatcttcatagtgaccctaacagataggactatcataatgtccacatgaggaaactaaggctcagagatttaaataacttatccataactgagcctcaacttttccatctgtgcaatgggaataataccacttaatttacagcattgtgagattttaaccaatattatatatttaatgcacttagcacagtatcaacaaaacagacacttaataaatcatctctactgttattaaagtgcttctgcagttgaaagtctctggtgtagaccagggatgagcaaaaagaaacctcctgcatgatcttgctccacccttgaactatccagctgtaacagaaaattggcagagttagcagtcctttacttgtagctctgctccaaaataaatgtctcaaaaagagaacacagaaccttatccactcaatatgagtgttcggaagaggcagttcccaaagagtaaggcttcaaagatgatctcaaactgagaaatcctataatgggggagagagaaggtaaagggacttgagctcacaagcttagaaccactctatctgggttcaaatcccagtttcaccacccactggctctgtgaccttgagcaagctattttccttaggacctcaatttcccatgtcactcagctgtccatagattaatgtcagatgtgaaaagcacttagaacaatgcatccagtagaaagatgagttattatcactattattgttgtgccttgaatctcctaaaggtactcgtgagtggcactgtgtgctgcagcctgggaaaggttaggaagtggaccacacacaatgcttggcactaagaatcctaagtcaccttctctgtggctgacatgtcctgatgtccccaaatagatcagtctattactattggtgtcaggaaactacaaacagggccaaattccacctgctgccttttctttttttgtaaataaagtactttttttcttttctttttttttttttttttttttgagacggagtctcactctgtcacccaggctggggtgcagtggcatgatcttggctcagtgcaacctccaccccccgggttcaagcgattctcctgcctcagcctcccaagtagctgggactacaagtacatgccaccaaacccggctaatttttttgtatttttagtagagacagggttttgccatgttggcctggctgatcttgaactcctggcctcaagtaatcggcccaccttggcctcccaaagtgctgggattacaggtgtgagccaccgtgcccggcctgtaaataaagtgctattgaaacacagccacaactcaatcaattgacatattgtctaaggctgctttcctgtaacagtcacaaactgcatagctgcaactgagatcacagagtcctcaaagccaaaaatatttacgctgtccctttacagaaaaagtttgcctacgtttgcgcaatgaatgaaacatcaggtttccttccctaccgcattggatgctttgaggatagagtgagaaacaaatgttaaaaatctataaagttcaaagggttggcaaatacgagaaattatttagcccaaaaaactcactgccttcaagatttaaattcaagggagaaataacactaagaacaaagactgcagagtcccgctatcagctccatcacttaccaactatgtgtggcccgaacagtgatgatgataccccgcttttgcttagctgagaccaccaagcagcctcctggcccttggtatggttgctgcagctagctggcggaaaaggggccagcaggggagtttgctagaagagggtcaggagaggcagtgggtatccctaaaagttaatatattgagaacttagcttgagtctggtccttcccaattccaaaagtaggaggagtaaagaatgcgaatgcttgcagtggggtttagtagaatgcctctctcagggctccccctaccattctagagagtcgaggcaccagccattcttgccagtctcatcacagtgcttcccaaagaggctgttttgtgtgttgaaaagatgaaaacaatgcaattatcccaaacagtattgagaagaataatttatttcttttttctttcttttttgtctttttttttgtttaaatcatcagtccctattctggaagaggtacatcccagcatctagcccagatgtccttttatgcaatagttattttaacaaactttctttatttccttccttttctctttctaaactaaaaggaaaaaaaatctaaaaacaacaacaacaacaacaaaaacccactgtgtgtggtcttgggcaaggtacttctctaagattcttattcatcacctgtaaaatgggaataacagtgccatcaaactcatggggttgaagaattaaatgagatgtacgtaggctttaacatgatgcctattcacagtaagtacgaaataatgtcagctcccattaaattattactttcattatgattactgcagggaaaagttgtgtgtccaaatactggaccactcatacagtgccctccctctcttggtatctatccttataggtaattttggtattagcaaagcagagatgctgagaagttaaatctgtccttttggggcaatctaagggagaaaagcttaagacttctacatattaatttctgctaagactaaattatcctccactcctaccaacatcccccctgcaacagcaaaaaaaaaaaaaaaaaaaaaaaaatggcaaaaagctaaatgcctcttctgcattttttttttctttttgagacagggtctcactctgtcactcacgctggagtgcagtggcacaatctaggctcactgcaatctccgcccccaggttcaagcaattctcccacttcagcttccctgagtagcagggactacaggcacatgccatgtagtccggctaatttttgtattttttggtagaggtggggtttcactatgttggtcaggctggtctcaaactcctgacctcaagtgatccacccacctcagcctcccaaagtgttgagattacaggcatgagccaccacacacagacttacctacatattttattatgtaggaaaacaaactttcaattataccgtaaaacaaattaacttgttttacagttaaaagaaatttaactataaattaatttgttcaccaaattgcttggtgaaccaatactatcataagtaaaatgctgacattttggtttctaacaagaagcaattaaacatagacacttactcaaaactcgcaaaaaatagagactgccagaagtgataattagtataacagaccatataactagtatctcaaatttcatatacattatccaccaaaaaatgaattaaaaattctaaacatgttaaaagacaaagactgacactctggtaaaacaaatgcagtaaaaggaatttgaaatgactgcagagggatagataccaaggaaccctgggggctcatggaaatattctgccttagttgtactggggattaaatgggtgcatacatttataaaacttaatcttaacatggtgctactcttagcacgtactcttaacatgggtttactgcatgtaagttataccatgagaaaggtggtctttaaaagaatttgggaaaaataaataattctaaaattccatatgaggtgttaaaaatttggatgctaacgaagtcacaataatggctaacacaccctctacaacactctatgagccagacactgctccacaaacttttacatataacaactgatttgctcttcataaaaaccctcggtagtggcttcatactctactcagtttacatatgatgaaactggagcacagagaggttaagtaactcacccaaggtcacaaagcatgtataagtggcagaatcaggatttaaacccacagagtccagcttcagaatctgatctacactcattctcattaaagcttttaaaatgatgtttgagaagcaaattttgtaaattcaacaaactgagctatttgacaaagtgaacttcatcaaactgagccagagctgtacagacactgtaacttttcttcacaccgtatttctcaatcgtaattacaaaattaggtacaactatttgtttcacgtctgccctccctccaggcggcatttaccataaggcatatctataagctctatccacaagcaccaagcgccacgcctacccacagcaaccacaccaagatactactggaaggaatcaataaagaaataaatgaatgagtacaggaatacactaatgtgtttatttatgtatcaagtggaatatcactaaagacagaaattttattcacatgtgtatataagtatgctatttcttaaatgaatgcaaggctattctgattaataagctataacactgtcacagaacatatcatttctctgtcactatggagatatacataatattttgtaagcatgtctgtacaccaagcattagcttttgcacctttatgcattgtctcatgtaaacttgacatttctgtaaaacaggtgcaattatcattcccacagctaacaactggtttatacacaggcctatttgattccatagcctgagttccttttcatgccaggagaactttttacatacagagaactcagtcaataagattcgcagcagaactctcagtggaacctgacaagtagttctaaagttatcaagaaggaaaaaaaattgtaggatttgccctgaaaaattgaaactatggaattggcacaggaacatatatacagatcaatagaacataataaagaatacagacagggattcctgtgcatatcggaattttattattcagttacgattttacagtagagagaaaatatttaataactgatgctaaggatattggttgtctactaagacaaaaatgaaattaaacccatatacaagtttccatataaagagataaatataaaaattttaaaaaatgggtattttttaaaataatcttaaaacagggacagtctttctaagcaaaacacaaagaccagaagccttaaagaaaagagtaaaagattttgctacataaaaattttaaacttctaagacaagcaactggctaggataaaataattaaggcactttaacaggcaaaacaattactatttagaataaacaaagaacactcctacaggtcataaggaatagacaaccaaaaaggacaaaagataaagggtgtgacatgcactcgtacactgaagaagaaatccactagccaataaatgtggaaatgtgcacgtaaaaagtcatattatttttgtccctgtgattggcaaaaatttacaaggttgataatatccacagttggcagagatgccggaaaataagcatatactatcattacagtctgtttagaagtccgttttgcaggacctattaaaaaatttaaacacacatacattgacacagcaatactacttccaggatgcattattaaaattttcatgtaccacggtttcatgtaccaagattatgatacacactgtgctgcgaaagaaattagaattagacccaaatgatcttcaatagataattaaataaattatagtacaattacccaactctcttcagacattatataaataaagcaaacagtgaaaacatatctctaaaatatattaagtgaaaaacgtaatcctgggaaaggtgtagggtacaaaatcccatttattttaataaaagctggatttgcatttatttaacaaaagccagatttgcagatttctatgactagaaagtcacaaccaaattcttacttaagctggtctcttctgaggagaggaagggagggaatatagtaaaggcaaaaatcatgtttggcttctgaaggatttaaatcttttacagtgagaataattttatgtattactatatatgtaaaaataatgaacaatttaaataatattaaaaagggtaaagtattacttcgagacaagcaaatcgaacgtacctagagaaaaattcaagccaattaaggtaagacaacatttcagctaaatttgttttataactaagatcctttcggccgagctcggtggctcacacctgtaatcccagcactttgggaggccgaggcgagcggatcacgaggtcaggaaatcgagaccatcctggctaacacggtgaaaccccgtctctactcaaaatacaaaaacaaaatcagccgggcgtggtggcgggcgcctgtagtcccagctactcggggcgggggctgaggcaggagaatggcgtgaacccgggaggcggagtttgcagtgagccgagatcacgccactgcactccagcctgggcgacagagcaagactccgtctcaaaaagaaaaaaaaaaaaaagatcctttcatgcccagtgtatttgtttgtttactttcagtctctagacaactttttaaaaactttttatttagaaataagttcaaacttaccaaaaagttgccagaataagaatatacacacaacgaaatgataaatgcttgaagtaatagataccccaattaccctgatgtgattactacacattgtatgcctgtagcaaaatatcacatgtaccgtataaatgtatacgcctattatgtacccataattaagaattgttttaatttttaaaagaatatacaggccgggagcggtggctcacgcctgtaatccctgcacttcgggaggccgaggcgggcggatcacgaggtcaggagatggagaccatcctggctaacacgatgaaaccccgtctctactaaaaatacaaaaaaattagccgggcttggtggcgggcgcctgtagtcccagctactcaggaggctgaggcaggagaatggcgtgaacccgggaggcggagcttgcagtgagccgagatcgcgtgactgcactccagcccaggggacagaacgagattccgtctcaaaaaaaaaagaatatacaaaggacacctgtgtgccatttaccaaatttatctattgtgaacactttgccccatctgcttataatctgctttctcaccctctccacctccttttcccttcctatcgatcaatcaatctagccaaacagtatttttttcctgaaccatttgagagcgaattgtaaaccctgtggtcctttacctctaaatacttcagtgcatgtttcctaaaaataaggatatcctcttacatggccacagtggagttctctacttgcataaattaaactactttacactattgcccacaatccaattctgtcaactgacccagcaatgtccttcacagcattttctcccctacagaacaggaatcagtctaggctcagctttcacatctggcagtcacaactctttagcctcctttaatctgaaacattttcacagcccttatgttttatgataccagcagtcttggagactacagcctttctctcttttaaacagtagtatcttcctgttcctcatttaaagcttctctgatgtttccttgtgattcgagtcaggttagacgactacagaacagacagtgtcctcctaagggcatttatatccagaggcacagatgttcatctccttccacctgtgatgttaattttggtcacctggtcaaggtgttgtcctatttctccactgcatagttactgtatttgtcttgcaactaataagaagtctccggtgagatagtgtaagataggtaaacatcatgttcctcacccaaagtacccctagatttagcacctagggtggtactgcctgactcattatttacaatgacgctgaaactgagcttccaacctcagcactccttccattcctgccaatctgtctctggcattctactaaagcaaaagtcttccatctccctcatttagctatctagttatttctttatcatccatatgcactcaaggattcctattactttctatggcccgtaatactccactgttcttaattattttgttgctcaaattgtcccaaatttgacctggggaacttttaaatttctcacaatttatcccatctcagaaaattctaatacctagaactagcttattatgagaattctgttttgtcaaggaatcttagaaggctaaggaatagctaaacttcagcaataagactaaattatttttctaattctttttcattccaaaatggactttattaaaatgaggatattgggggtctgcttgatttgccattctctaaagctgagtttcattactaaatcttaattgatctgtttactctttgctctaaatgcttggaggggagcccaaagggccatcagtatttgtatgacaataatagcgtacatggctaaaacactatctcttaaaatcatttctcattaagagagagggagagaaatctatagtgacatctgacaaagctgaatggtcaatctgaaaataaagaactgccaaaattaagaaagctgagaaacagctagagacaacagaacaggtcagtcgtaacagagttacggaagagatgattgtctccaattgccacagttgaaatggaatgctttgtggtctttaacaaagagataagagttcattaggcatgtcacatgtccctctgtcttaaaatgtcagagcctaatctattgccatgtggtactcgcttcccggagcttacagacctgaagtaccctcttggactggacttgcatatatcaaacaggggcaccttcatttaagttaaaatgtaagctcctctgccataaactgtaaagggaggtaaagacaagaaaacctttagggaaaaaaaaatgattctttctggctgggcgcagtggctcacaaggtcaggagattgagaccatcttggctaacacggtgaaaccccttctctactaaaaaatacaaaaattagccgggcatggtggcatgggcctgtagtcccagctactcgggaagctgaggcaggagaatggcgtgaacccaggaggcggagcttgcagtgagccgatatggcgccactgcactccagcctgggcgacagggcgagactccatctcaaaaaaaaaaaaaaaaaaaaaaaacataaaaaaatgattctttctaagctagtacctttcctttgtaaatttcaaatataattagctatacaattaagcttatggaacccgacaccttaataaagtcatttctaccatttgtgaaatcaaactacattttgatagattgccagatgaaaaagcataccaagaatctcaatgttttctatcaaagttgtgagaaataccaatacatccatatgatatggacaggagacagggaaatactggatagaagagagcagttccccagcaaaggccccattctcaggcctggaaacccgcagccctaaatgagaatgggcattcctggttttgcacccaaaagttatctttcggcccaccacatcccctatcctgtacccatataaacgccaaaaccccggctccacaaggaaatgaacagaagagcagaagaatggcagaatggcacagcaaagagaagagaaggagtatctgaatgtcgtcgagaggagttcagctggggatggttggagaggagattggctgctggacaaccacactccaggggaagatcatcttcccactccatcccccttccagctccccattcatcccactgagagccacctccaccattcaataaagcccccacattcatccttcaagtccatgtgcaacctgattcttcctggacactggacaagggcctgggtaccaagaggacactatgctggttaacacttaagccatccacggatggcaaggttaaaagagcgcactgtaacacaacacatgccacttgggctttgggagtcacagacacccacccctggatgctgccgtgaggccggagcccaggggcacttgccccagcttctgcacctgcccatctttgtgctcccccacccataaggggtttgagcatgcatggcagccgaacagacaagccacacccagtcacacatcccatgaggggagtcagggaactctcataggctattattactaaataagcaagttgttagaaatgtgaacaccccagacctctaggagcacttaattacacgcttttaaagtataattatccttatttttgtgaatgttccttatctaccccaggtagcaagttgcatacattatatcatttagccccactgtataagtgaggaaactgtggctcaaagtgccttgcccttggttacctggcttcagccagtcctccaaaaggacatttaccagtgttggtattttaaaataaaaacaaaacctttcctcccaaaaataaaatgactatcagtaaatgaatatttaataccaaaatgttcaatatggctagttgcagtattttaaataatcttattatgattctttcctgctctgtaaaactctagtcatatgaatgtacttacaaaaagtaaactttatacacaaatgctaattaaattaatggatgcaaataagtatttaaagtatgccaggcactgaggcaccagagctgcacacagccactatgaggcagacattagaatccccatttgcttggtcaggagactgaagctcacagagaggttaagttacttgctcaaaggcacaatgccggcaaatggcagaactccatgtgtctgctacctcgcaagcctacctatattctttcctctctcgcacatgtcttgctaggaacagataccacaaatctgaaattcaggtatgccgggaaagaggctgatttttttttattctttgtcctacttgagactttggatccagtgatatttccttttgttcactcgtaatggcttagaaatgcaactgttttgcatacttccagcaggaacctaaacatgttggacaaatagcagctgccttaaggaatgaatagaaaatcaggaaaagtcatcatccatatgaactacatatcatctgctttcttgcaagtggaacaaattattcatgtgggcaggagtaattcatacagcccttgacccccctgatgatgtccagtgtgagagccaaagccaaacactgacccaaaagcacccgtgctctcccggtcttgatttgtgacacctaacacttgtgctttatcctaatcatatataatgactgctcatttttatttctgtctgggaaactttactttctcctggtgatttttaattttttaattattttaagtattacaagtgtactaaagtgagaaaaaaatggttagagaaatccttataggatgatagaaatgttcttaaattggattgtggtgatggctatgcaactctgtaaatttactaaaaatccactgacttgaacacttacattaaaggaaaataaaatctcgggacctaaactcatcatgccaaagagaaaatttaagcttgggaactgagtcacacaaaaacttcctcccttctgttcctaaacagatagctgcaatgatagaaggccacctatctccccaggtggtctccttcacaaattgctcacaaggaaatgccttgtgggccccagaatctttaccataaaacagagttctgttcaatctcaccctgaaaatataacttaacaacttatcttcacaggtatgggacaaagacaagactagaagtcatcctaccatccacccagagacaaatgcacgtttgacgtcttcctctactctatgtttactttgttttacgtaaaatgcagatttaaaatgcagaatgcataactgactgttcctctactccctcctttcacatgtaacatgtggatccagtgaacgctaatcaaagcctcacaagaatgtgaccccttacctcactgcatatctacctcttttttttctttcctgctttccccttctgccactctcccctttaaatgttgaactcctcaaaatcgtctttggaaaatgcacagggcacagatcctactgcaactgtgtctccttcccaggcgtatcctctatcttggcaaaataaacctctaaattgagatctgtctcagacattttttgggttatacgtaaaaggagtaatgcaaagcacaccttaataaagctgggcgtgtttaagtgtattgagataatgctaatggattaccgaggtaaagtctccctcctgagaggataaaactctcacattgttagacagcattaaaggaattcctttgctgctttctatggtgaagaagggccaccctctcttgtggaaacacattgtccacatgaataatttgttccatttgtgatatggtttggctgtgtccccacccaaatctcatcttgaattgtatctcccacaactcccatgcgctgtgggagggacccagtgggagggaattgaatcaccagggcaagtcttttctgtgctattctcgtgatggtgaataagtctcatgagatctgatggttttaaaaatggaagtttccctgtacaagctctctctttgcctgctgccatgcacgtgagacgtgacttgctcctccttgccatctgcgatgatggtgaggcctccccagccacagtgaactgtaagtccattaaacctctttctttcataaattgcccagtctcaggtatgtctttatcagcagcatgagaacggattaatacaatttgcaagaaagcagatgatatgtagagttcatatggatgatgacttttcctgattttctattcattccttaagacagctgctatttatccaacatgtttaagttcctgctagaaggatgcacaaacagttgcacttttaagccattaccagttgaacaaaagggaccgtcactggatccaaagtctcaagtaggacaaagaattaaaaaaaaaaatcagcctcttccctgacacacctgaatttcagatttgtggtatctgttcctagcaaggcatgcgggaaagaggaaagaacatgggcaagcttgcaaggcagcagacacagtggagttctgccacttgctgccaatgtgcctttgatcaagtaacttaacctctctgtgagcttcagtctcctgatcaatcaaatgggaattctaatgcctgcttcacagttgctgagtgcagcctggtgcctcagtgcctggcaccctttaaatccttattcgtggccattaacttaattagcaaatatgtgtaaagtttactttttgtaagtacattcataaggctagaattttacagacaggaaagaatcatagttaatgcccacatcccattcctgttggatgccacagcatgtatgccaaagaaggaatagttcttctcaaggcagccaggaatgctaaatacagacaaaagccgtgtaactacaacaggtcaatgatggaccacatacaccacggtggtcccataagattggagtggagctaaaaagttcctgtcgcctagtcacagccattataacacacagtgcaatgagttacctacatatttgtggtgatgccggtataaacaaacctactgcaccaacagttatataaaagtatagcacatacaattatgtatagtacagaacaataaaaacaactgttactggtttatgtatttattatactgtactattaatcgtgattttagagggtacccttctccttctacctattaaaaaaagaagagttaactctaaaacagcctcaggcaggtccttcaggaggtatttcagaagacggcattgttgtcataggagatgacagctccagccatgttactgcccctgaagactgtgacattggtgatccttaccctatgtaggcccaggctaatctgtgtgtttatgtcttagttcttaaaaaaagtttacaagtaagagtaaaaaacttttaaaatagaaaaaagcttgaataaggatataaagaaaatattttgtatagctgtacagtgtgtttgtgttttaagctaagtgttattgtaaaagtgccaaaaagttttaaagaatttaaaagttcataaagcaaaaaagttccattaatcaaaggtttattattaaagaaaaaacataaatgtggtgcagcttaagtgtacagtgttcataaagtctatactaatgtgtaataatgtcctaggccttcacattcactcaccactcactcactgactcacccagagcaacttccagtcctgcaagctccattcatggtaagtgccctatacaggtgtactgttttttatattgtataccacattttactgtgccttttctatgtttagatacacaaataccattgtgttataatggcctacagtattcagtacagtaacatgttgtacaggcttgtaacctgggagcaataggccatgccagagagcctaggtgtgtagtaggctgtaccatctaggattgtgtaagtgcactatgatgctggcacaatgatgacattgcctcataacacatttctcagagagcatatactcatgtaatgacatataactagttgctgagcacctggaggtgggctggtacctgagggaggtctgaaatgattcaaaagaattgtccaggtgggggaacagtgtatgaaaaagttgggaagaaatgaccaccttttaggaaattgggcatgagaaaagaaaccacaagcacatcagaatggctgatgttaaaagtccatgttaggaatgcaagatcctaggacctactgagcaagaatcgctggcggtgagacacagggatgtgcattgtaacaggccacctgtaccccagccaggtgatttctatgcacactaaaatatgagaaccacttaggaagatgctaagaaaggccttacatgtgttaaatcaagtttagcctaaagctgcctccttacatattttaagtttggcctaaaggtttctctgtacatcgtgagctacaagtggaggtgtaaacagaccttacctacacttgtgccaatcaccgagttttggtccatcaaatgtagccaacggttggaaccgtgttcaaataaagcaaactgtgggctgtaaccaatccagctgtctctgtacctcacttccgttttctgcacgtcactttcctttctctgtccataaatcttcttccaccacatggctgcactgcagtctccgagcctgctctggctccagagatcgactgattcacgaatctttcattgctcaattgaactcctttaaatttaattctgctgaagtttttatcatatgtcatgctaaggtatttgcatgttactttaaaggcaatgagaagctgtgcacagattttaagaggcaaggcgaaaatggacttgcattttagaaagagcagtctattgtcagctgctagcagctggaaaaaaaaaaagcagtctagcgcagtacactgctttagggcacagcaagaaccctagagtccctccagggctcaggaatgcttgcacactcttacttcctttaccttttagcctcttacgttcagtaactgaacacaaacataccttttacaggccatagtctcctaccaacatctaggtgctacctgaaaaccctgtaagaactttatgacattgaccaaaatgtttggagaaaacaaaggttacaacaccatttatgtgtcagcgaccaaatgctgtttccaaaatattgctggcattatcacctcccttgctgacaaatattaacacttttcagttttagatagagctggaacagatggccctttgagcccctgtttactgctctcttttgtgtgaagtggtttcccctcccactcaggaaaggaaaggaaaggtgggaggatgtaaacttgaagaatttcccagctggagtcctgggtattagcctgagaggtgacttatttatcctacaggactccatcacagaggaaggtttttctgcaagactctggctgggccaatctttacacaatgcctgtgagcagccacagagtgcagccttgacaatgccacaagccaacttctgggccccccacgataagcgctgcataggcctccctgaaccctcacaacaggttctattatcgccatttctctggtgaatatggaatagatagattgagttaacttatcccaggttatacatggaggagcagggattcaagcccacgtccaactgactccagaacttacaaccaaaccaattaatgggatgtgtcaagtaattttctatttttcctattttttgatgcttacatgcacatgaaggaaacaagcacatttaattcataaggcttacaatacattacaaacaaacttaaacaccccagaaggtcagaagtttgctgaccacctagtaccagggtcagcaaacttcctccataaaaggcatataaatatttaggctgtgtgagccacacatctgtttcccaactgtaccacagtagggcaaaagtagccataggcaacacctaaacaaatgggtatggctgtgctccaattaaactttatttacaaaaataggcaggaggtgggcaggctgcatttaacctcttagtcaagtttgagaagtttgtggctgcttgacctagtgtaaagggcaaagggtttagagttagggaatctagcttctaaccctgattctgtgcctaagccagctgagtgacctcgggccaatcacttcccttctgcttcttctgtagaattctcttttcaattgactgcaaaaataaggtaaaaatatatttcaacatactgaaatgttagctgcagattcttcattaaatccatagataatgaaccagtagcagcaagactttaaaagcataaagagaaagtaaatttgcattttagtagtaccttctatgtgtcaggtgctttataaaatataatctgacttcatccttcataaatgaagaatgtcagaagtgaaatcacatgttcaaagtcagagaggaaatgggaagccagaatctaagcccagctggccactctctcagaaactcagtgctgctctgcacatggaggacctggtatgggtcaatgagcccttgattgatgattctgcacagggggtgacatatgagtacttttgggggaggattttggagtcaggcctcacttccccctcttgaggactctccctctctgtcctcatctgtcttgtctacctcctctcaaaaagataatactccatttggtctgaaaaacaatgtgagactctgaggtttgtttcctttggttctgagtgtaaggactgtgactcatggttgtccagaatgccaggacaaagtggtctgagaaaacagggagggaaaaaaggaggaccaagcatttcctcaaagaagctgtgactggtcctgctgcccacacgagcaccgtggctcaagttggttttctatctcagaacttagtccgaaggtaaaagtctatgtgatgaaatataaacctgtgaaattacccaagtgcctctgaccttgtctgtctccttaaccacccactgcatttcagtttacaggcatccgtttaaaactgtaccttagaaatggggttgggaaagggaaagtgaaaccaaacaaatggaaatcattattgttgcttcctttaccccaaaagaagaagaaaagcaaaaatattccccaaatacagaagggtgcatgtgtgtctccactgtcaaaaaaagcaattttttttttgagaaggaatttcactctttttgcctaggctggagctcaatagctcaatctcggctcactgcaatctccgcctcccaggttcaagcaattctcctgcctcagcctcccgagtagctgggattacaggcatatgccaccatgcccagcaaatttttgtatttttaatagagactgggtttcaccatggtggccaggctggtctcaaattcctgatctcaggtgatacccccctgcctcggcctcccaaagtgctgggattacagacatgagccactgcgcctggccaaaagcaaatttttttaaaaggcagggccaggcatggtggcttatgcctgtagtctcagcactttgagaggccaaggctgggggatcatgcgagccaagaggatcccttgagcccagggggtcaagtctgcagtaagccatgatcacaccactctaatctagcctgtgtgacagagcaagaccctgtctctttaagaaaaaagaaaagaaaagaaaaaagaaaagccaaactcggtagctaagcattcaaggccagattctgatcaatctggctggaacacactcacagcagctctcctgcattaatcacttaaagggggcatatactgtgctccaaccacatggcctccagcctacttcaccacgcctgaggagcgcagttcccctgctgttccctctgcctgaaggaatgaggggtgatctcctcccttgctgcctgctgaaattccacctcatgaagcccaggtcgaatgtcaccttctagaagacacatgtcaaaaactcaaaggaacttttacagacagatcatcagtttcaactccttcgtgtcgcctatgaggaaaacaaggctcaaaaacattaagggacttgctctaagtcacacagctagtcagtaaagacttggtctggaaacaagtcagcaggtggggtgggcagcaggcaggagagagaatgtccaggtggaccaccctgtgacagccctcttctccttggagcacaggacacttgaaccctctctagactctaccctgcactccaggttacagctgtctgtgtccatatttctaactgcctttttcagagggatccacaccatatcttacccatcatgttgccttaattattaggtacccttgggtcgtcagtgagtcccaataatcattcaacaaacaaaacaaaacaccagcctccgtcactctgggcttgtctacctccaatcagcctccacgccttgccagggagccacctaaaatactgcttgctccccaccactcctcactgaaacccgcagatgcacaccatgatctccacaatctgacatgaaagtctctgaacggcccttcttacctgtgatggttaattttaggtgtcaagttgactggattaagggatacccagatagagagaacaggtaaagattttatttatgggtatgtctgggagagtgtttccagaagagactggcatttgaatccatgaacagggtaaggaagacctaccctcacccaaagttttgggtaccatccactcagcagaggacccagatagaacaagaagacagaggaaagccaaatttgctttttccctcttctggagctgggaagtcctttttctccttctcttggacatcagaactcaaggttctccagcattcggtctccagaacttgcacctgtagtcccccaggttctgaagccttcatcctcagactgagttataccatcagcttccatggttttgaggcctctgtgcttggactgagccacgctaccagcctctgcagctctccagcttgcagacagcatatggtagggcttctcacgctccataattgtattagtccattttcatactgctgtgaagaaatacccaagactgcataatttataaagaaaaagaggtttaatggactcacatttccacacggctgggaaagcctcaaaatcatggtgaaagatgaaggaggagcaaaggcacatcttacatggcagcaggcaagagagtgtgtgcggggaaactgccctttatgaaaacatcagatcccatgagacttattcactgtcacaagaagagcatgggaaaacccacccccatgattcaattacctcctactgggtcccacccatgacacgtggggattatgtgagctatgactcaagatgagatgtgggtgggaacacagccaaaccatatcaataatcatgtgagacaactcccataataaatcccctctcatctatctatatattatgtcccatttctctggagaactaacaaagtacccttccagccttgattcctgacactccacctgtccagagcaccacaggatcttcctcacctctgcaccttatcccgctattccctctcctggaagacacttcaagagctcccccttccccacatcacttctccatggctaacccctactcattcttcttgactcagaatgtctaagaaatggcctcctccaggaaatcattcctgactaccctctctcccaggagaggtgccctcctctgtgctcacaaagtaccctggcatccctcctccaccaggtggttctcagaacacacatgtccccactctccactagaccataacctgaggcaggagctgcatttgcttgtccagcacctaacacaatactcaacacattaagtcagactgaaaattgtcactcactagttaccttcagatccaacaaacatacaatgtatcatttcaccaaaatattttaaaatacgtaggccctatgtatatgacagcataatatcagcagtaccaaggggacacatccacagatcacaacaaaaagcatttactacacacctagtctttaaataaagagctgaagatgcatgatggcattaggaactgccaggcactccccacttcagaagtccctttagagaggtgtgatgacatcaccaatacagcaactggccgcggtggctctgggtataaacggacttggtgcatcaggaggcagcacagatccacgaagcacagggggagaaaaggagagtgctgactaaggtggtggccaatgggaggctcaaaaaaggaaaatctctcccccaggaagcctcaaaagcacccacaggagtccccaggtactcatctttgggaagtgaatacaaagtaacttcaggagactccgcctgagatgctactggggcatccaagactggagattggtcggctgtcaacagatggctagatggaaactctgagcttcactgaactcacagtatcagattcacactaaatgactggtaacagcacccatgggcaggaaactgagataagaaggcaagcagctagcacaggaagaactgatacttgtctgcagaagcatatgtgttacccagacttgaagggaaggaagtgggtatccaggtacagggggaggaaaagtttcactagaaaaacagctgtcaaaaaacagggtttcaagagactcaagattgaacatttcaggaaacatttcaggagaatgtctgtttgttaacctgagctggagttgggactgacggtaaagtgatgctgcttccctccactaacttgcattaccaatttacaaacaccctttcttaattctgcccaaatgcataccctcatgaacaaatggcccatgctccgcaatcagaaaattcagtgaggcataggggttagtttcatctgcttgctgtccttccccatctcctacccagctgaaaggaaacaggaataaactctactccttctccttaggggacagcacccctacccagccacacaaggaacccagaattattactcaatggctcctccctcactgcaccactgaccctcaaactgggggacaggccaccaagtcaagtcctctttcacgttctgagaaatcctttaactctggcctcttctgtccaatgccacagcctctactctacttcattactcatcatcttccacactaactgttgcaacagccttttgtcctccttctgccacctccacatcctggcttcatccacttcaccagatttatcttcctaaaatcagcaatcttacaacaattgcctcatcaaaaaccttccatgtggctggttgcagtggctcacgcctgtaatcccagcactttgggaggccaaggcaggtggatcacctgaggtcaggagttcgaaagcagcctggccaacatggcgaaaccccgtctctactaaaaatacaaaaattagctgggcgtggtagcaggcacctgtaatcccagctactcggaacgctgaggcaggagaatcggttgaacccaggctgtgggggcagaggttgcagtgagccgagatcccactacttcactccagcctgggtgaaagagtaaaactccgtctcaaaaaaaaaaaaaaaaaaaaaaaaaaaccttccaggttcccattttttaggagatacaacccaaattccttagcgtgacattcaggacacaatgactcacgacccaagtcagcctttttggtttctgcccttgacactctccttcccactgtaccaagtgctctcttattcccgcccatctcaacttcccccaaggccttcccactggggagcccaacacaatcccacttgccctttgaaacctagttcaaataccatctctcctttcaagtctttgccggaccctaaacaagggaagccaatcatccctgtttgtacctgttgtcttagtgcaattactgaaagcgctcatttactcagagtgccctgctttgaatgataaattatatgaccttcctacctaaaacctaccctaacccaaagatagaaatagtacagtgacttgtgttaagtgttttgcttgacgttgtgctcctcaagggtaataactgtcttgttttagtgtgtacatccagcatttaaagactgttaggacctgccaggcgttcaatgaacgttggtggaatgaaagaataaatctcagctgggagcagtggctcacgcctataatcccagcactttggaaagcccaggtgggcgaatcacctttagtcaggagtttgagaccagcctgaccaacatggagaaaccccgtctctattaaaaatacaaaaaattggatggtcgtggtggtgcatgcctgtaaccccagctactcgggagactgaggcaggagaatcacttgaacccgggaggcagaggttgccgtgagctgagatcgtgccactgcactccagcctgggcaacagagagagagtccatctcaaaaaaaaaaaaagaagaagaaaagaaagaaaattgtggtaatgaattttatcaaaacttcatctaaacttccaaagagaaattagccaaatcagaattagatctaaaaattcctgggccaaaaagcaggcggtaaaaacatgtcacataagccatttatttcctagtcagtgtcttaatttttttcattatcaaccctcaaaggagcctaagtataaagcttacttttttaattcaataacaggatcagaatgactcaataaatattttaaaagttaagtgtaaggttgggcacggtggctcacgcctgtaatcccagcacattgggaggccaaggcgggtggatcacttggggtcaggagtttgagaccagcctggccaacatggtgaaaccccatctctactgaaaaaaatacaaaaattagctggatgtggtggtgggcgcctgcaattccagcttctccggaggctgaggcaggagaatcacttgagcccgggaggcagacgttacagtgagccaagatcatgccactgcactccagcttgggtgaccaagcaagactctgtctttaaaaaaaaggccgggcgcggtggctcacgcctgtaatcccagcactttgggaggtcgaggtgggtggatcacaaggtcaggagttcgagaccagcctggccaatatggtgaaacctcgtctctactaaaaatacaaaaaaattagccgggtgtggtggcacatgcatcacgccactgcactccaatctgggtgacaaagcgagattccgtctcaaaaaaaaaaaaaaaaaaaaaaaagccggtgcagtggctcacacctgtaatcccagcactttgagaggccgaggtaggtggatcacctgaggtcaggagttcgagaccggcctggccaacgtgctgaaactctgtttctactaaaaatacaaaaattagctgggcatggtgttgggcgcctgtaatccaagctactcgggaggctgaggcaggagaatcgcttgaacccgggaggcggaggttgcagtgagccgagatcatgccattgcactccagcctggatgacaagagcaaaactccatcccccaccaaaaaaagaaaaaaatgtttaaaaagctatgaacatttggccgggcgcagtggctcatgcctgtaatcccagcactttgggaggctgaggcggccggatcacgaggtcaagagatcgagaccatcctggccaacatggtgaaaccccgtctctactaaaaatacaaaaattagctggacgtggtggcacgcacatgtagtcccagctacttgggaggctgaagcagcagaatcgcttgaacccaggaggcagaggttgcagtgagccgagattgtgccactgcactccagcctgggcaacagagggagactccaactcaaaaaaaaaatctatgaacatttaactttataactgtatttgctgagtgacttttaatataatgttaaatataatgcatcaaattatatatacaaattatcaatttctatacctacataatagcaatgtaatcaacttttcaaaaaacattcaaaactgttattttccagcaaaagtaaaactattgaaaaaatcattttctgaaaagtgattttttttttttttttgaaacggggtctgtcacccaggctggagtgcagtggcatgatcagagttcactgcagcctcaacctcctaggctcaagtgatcctcccacctcagcctccagaataacttaggactacaggcgggcaccaccatgcccagctaactattcatatttttatttttgtagagacagggtctcactgcgttacgcaggttgaaaagtgatttttagtgaacttttgtttcatatgagaaaaattttttttttttttctgagatggagttttactcttgttgcccccgctggagtacaatggtgcgatctcagctcatgcaacctctgcctcccaggttcaagcgattctcctgcctcagcctcccaagtagctgagattacaggtgcccgccaccacgcccagctaatttttttgttatttttagtagagactgggtgtcaccatgttggtcaggctggtctcgaactcctgacctcaggtgatccacccgcctcagcctcccaaagtgatgggattacaggcatgagccaccacacctggcctcatatgagaaaatttttaacttaattagctgctagatattaattcaaatactgtcaatgttttcctttttggcacttgagataattattggtgagctgaataatcttaattgaattaaataataaaatataaatgattttcattcaattctcaaatccttatatttgagggccaaatataagcaagccacaaggcacccaatggtagcccataagtatgtgaaggtaaccaactaaaatgacttcaagatcaggcaactagagagaaagtcttccaaccacagccatctctacgttataaatttgttggattgaccttgaatatattctgtacatcttccatgaatccattatcaatgttgctagtgtaatacacaagaaaacccaatgagagaaattcaaatattaagaaacaagcttttgttgattgagctttaaatggccacacaccattataatatctaagatgcttgtgctccccaataaccaatttttgcctccaatgaggatgcaagtcctaacttctatgctcccgaatttatcatactagcacctaaaaaacacaaattaaaaaatcaatttagccaagaaaacctccatcccacagctaccatgggagcttctctaccattatcattcattccttgggtacttttaaagaaaaagatttccatattattagcccttctcccaaaagaaactccctcttccccaacctcccccccgacccctctcccccatctcaataaaaacccagatctttagagctggaagaacacttagggctaatccagcccctccttcttcagataagggaactgaaagagccctctgaggttgacagacttgctcaatcaaggtcaacagtcatgggaaggaccttgtctgtcttgttcactgttgtacctccaggctagtacagggcttggcacctagtcagctgtttacacacataagtgatgaacaaagagaagaaccaggttacctaaaaacctaacctggtacttttccaactatatcactttgtcccttttaactcccccagaatatcaaataatggccattaaaaactatcaatatcaaataaagactatcagactcttcttaaatacgtgaaaagcttcctagctgaaataagctatttgcgcacccagtaaaattgaagagcagggtcttatgaactcgaggttagagttcttcaagcccatttacggtaagggactttctacaaataaatcaagggtatccagtctacaacacactacttcttacttgcttacatttacttgagctcctttttagagttcttgtacccaggtcatatctccctaatcagactgagaaccataaagaggcaaaactatgccttctctaaggcacctaccaagtttgagcccaaagtaaatgctcaataaacgcttgctcagtttatagcaatggaagtggtaaactgtgagggacaaaagtaaatttggcatgaacaaagaattcaatttgtattttgctcatcaactaggactagtacagtacctagcatgtaacagaagcctaatagttaatgaatgaagaaaaataaatgaatgatatggcaaaaactgagttgttattaagcaacatcttttctgcagtctttcattcattcaacaaatatttatttaccaagtatctgtgtgccaggctctctgctactctgaaacctaacttccacccagagtttcacccacagaaacctaacttccctcctcatcggctaatgcatctcaaccgttcatctagtaggcagtgagcatagctggggtgaccatttgtcaaagtatctccgaaacagtcccagtttacacctattatcccagtgttaattaataatagcaccgcctcaacaatgccctaatctagagaattacatagttctaagcacagcaaatctcctacaaacagatcgggattcaaatatttcattctacagtcttgggatcctcaatgcaagggacaggctgtaagcaagggtctggacagcccggcttgccctcttgtctctctgtcatgcagaggagctgtagttcagtttttgttttttgtttattttacggagcacatttaaagtatagtcttccttgtcaggagattcctggcactaaagagatggacgggaaacttaaccgcctcctccagatcgtccactattgcatcatttgaaaccaaagccttctaaaggcagcgactcgcacaattcaagtcaggtaagatggcaggaacagcagctgtgggtgctggctgctgctggagcctcggtctcaacttcaagagcagggagagcgctgtctctggagttgccaggtgctgaaatgaatagtcaataaatcaacaggtccggcgcgctagcccctgggtgctcaggcccgggcgcgccacgactgaaggagtggctaattactcaaacacagttgaaaccaaaggaggccggagtcggttctcaaagtggtttccctccggccaccaccgactctgaggacctgctaggggaagtgtcccggccccgtggagggagagggaagcaccacagcctgggctgcggctctagccctccagccccagcccctggcagccctgccctgctgtcgcggcaggtacccctctactcattgttcctcaggctgccccctcttttcatcaatcgtaagcctttcggttctgccaccaggaaacttccatagaaggtgagattcccaggtcgagggatgattccacgaacacccagagagccagtgccaggacttcagggtcagacttcgtaaagcccaggcgtcgctgggccggcccggaacagctcagagctgcgggtcctatggtcccgcgccctcacgcccatccaagtgctggcaggacgtgggtcctccatccccacgactcgcggggccggcgctccgaacctcggcactgcgtccgctccgcgcgccgcagggaccctcctagctccagcggggacagacctaccaaggccgggcgcccccacccggcgcccgccagcccaccccagagaggggaccaagggggcggggcctcggccgtcctagccgggctcactcttctctcccggactcctgtccagggcttcaggggccgggcccgcaatccccatcggatcgtacctcgtccgcttccagctccgctcggctgcctaagagcgccatattcctcctctggctgctgccacccaaaaaccaagcagggaactcagagccgactcctgctctcggctctgggctcagcccagcgcaaaggagggcaaaaggggacggcccggcgctccctccgggtctcgggcggggcctgagtgcagctactcgatttccccgcccccggagccggcaggccagcacagcatccatttcctccccggacgccgcgccgctggccgggccacttgcccggcccccagcgggcggcagccccgcccaagtgggtggagtcacctcccagataaagtttcccggtctggcacgccctctgggagggtttcctaagctttcctgccgcctgttctctgcggtggctgggcacacctggaaagaagctagagagcgcgggcatgacgaagccaaggtcaaagcagcgccccacctggggtccgtggaagcatccacctggtctttggtccggtgccagtccttttccctcgccaggtggccaccgcatctcgcagatggtgtggcctgagggcagccttgggtcacggtcactggtccccgagaggcctctgacacaccacccacctggactgtaggtggaaggactctgcttgcttctgtgttcaaaaaatagaaaaaaacgcgggacagagatttatacatattggaactcctctacttccccctacccggacagtgtattctccccatagcatcctgtattttgtaactccaaacataggtgtataattcgtgcttgaactataaactccatgggggtaggatgctatctgtcctcttcaagactgtatccccaacacccagaacagtgtcttgcacatcgtaggtgctcaacagatatttgttggctgagtttagaaactgaaccttgcttctgacatgtaaaataactggaaaattaaaagctagatctttaagagtttgggggagagaggtcagatttactttacatacagaaaaatgcaccaagttaaatgtgtgattcagtgacaagtgtttacaaagcatcccagtcataatatagaacatcctgaaaagttttctgtgaccctttgctgtcaatttcctacctccgctccctagcctctgtcaatcactgatctgctatcaacatcgatttgccttctctagaatttcatataaatttaattagagcatgtggtcttccatgtctggctcatgaaaggctatttaatagtcatccagtgataactgtaaaaacagctaatagttcttgagtccttactatgtgccaggactctactgaacctcttgcatatagtatttcatttattcttcataaccccataaagtagggtgctgttctctttcagatgagtaaactgaggctcagagagttcaagtaatatgcctgaggccagacagcagttaagtaagtagggatgccagcatctgaaccccagcagtctaactctagggcctagctgataaccattgctttgtactgtactggctctagccaccctccctctctttctttctgtgtcagtagagcagttgtctgtgcaagtccattacatacattttcagtgagtcactttgcatccttaatacttgctgtacaattttaatggcttggcatgtacttttgtactagaataataaaatggtttctacagcagaaacattgaaaaaatgggttagatcgtgtgatggttgctcaactctctgaattgtctaaaaatccttgaattgtgtacttacaataggtggaacttatgattatgtaaattatatcttagtaaagctgttttaaaaaaactagctgacacaggctaggtgtggtggctcacgcctgtatgggattacagcactgggagactgaggaaggaggctaacttgagtttaggagttcgagactagcctgagcaacatagcaagacccaatttctaaataataatactttttttttttgagagacagtttcactctcatctcccaggctggagtgcaatggctcgatcttggctcactgcaacctccgcctcctgggttcccactaatctgtaaattgcttagaaggaggcactatcttattcatcagtgcaggtactcaataaaaaagctccaggtgcagtggctcatgcctgtaatcccaacactttgggagaccgaggcgagcggatcacgaggtcagaagttcgagaccagccttaccaacatggtgaaacccagtctctactaaaaatacaaaaagcagctgggcatggtggtatgcgcctgtaatcccagctactgaggagactgaagcaggagaattgcttgaaccctgaaggcggaggttgccgtgagccgagatcgtgccattgcactccagcctggtgaaaagagtgaaactccgtctcaaaaataataataataataatacttttattatttagaacacatgctctgaacacttagaatcagatggaccagaagagacatagagtttgtttaattccaatacccttgaaagtttccattccttcccagacccccaacccactcctacctcctcctatgtttcactttctgaggctagaattcctatccaggtccagattctactctgtattactcatgcatggttctgtttttcaaagttcattggttcctgaattgatagcacatccttttgacatgaagccatctcactggtagcttcttctcccatatgctgttattctgcctttggaatttcaactcttcaaattttgaagagatccaaacaaacttcgctctaattagtgacagaattatgttataatgaaaatcgagtacaatttttcaaaaatctatacttataattgaagcttgattggtgtttttgttgttgaattttttacatatcagggatcaaacctgaagtctcgtatgttttaaattcacggcaggagataagcaacattcatgtttcaattataaacactgaatgaataaatgtattctagccactggaacgtctaatcaaatttgctttgctcagggcagctgtcagctttgcctatacaagagtgattttatcgtgaatcacaaatataaaagtttttcttcaaagaacaattagaatggatttgtttttacacagaattccccttgcaagtttgctgataatgttatactctagcagtcaagtgagattactcagatattccatatcccagaagtaattagcatagagatcaagcaagagggtatctgaatcatttcattttgaagccacacctactgggagctgtttgtgtttcaaaataaatctaatattgtaaacaatctaatcttcagtattcctgaacatgttacctttagctgatagttttttgctggtacttgatttaagtgaaaattgaatcttcatgatttgtgtggtaggagaagctcaaatccatgaaataagtgctcattgtaaatcatgtgtttgtcagtgactttgtctcacattcgtgtcttagctcttcaaggaagacgtccccttctaaagcagtccctccctctcagtcacactctaccacatcctcctgctgtatgtatagcactgttcactacctggaactttctcgttcacttgtttactggtttatgagtatgtccttcaacaatggcacctcacacacactataatacaagctccatgagggaaggaactttgtgttttgtgtctacagcaaaaacccgaatgcccaacacataatgactacttaataaatggctattgagtgaatgaatgaaagtataaaaagttcatagtacattaagcattattgtttagacctagcagccaatgttttagcataatccagtaataatgagggagatttaaagaatgcaaatcacgtgtagtctaaaatgtaaattgtttcctagggtaatgtaacaggcatgaagattatctttaatgcctactcagtttttcaaagttacataagagctaagcacttagaggtccctcagtgacctaagaagaataattcacctccctgggagaggttgcgatgctaaggggaaaaacctcatcatttagtggaagctgaaatcttcccttcagaatatcctttttccaggcacttggggctgggtaaacatttattttgccccacctattagttgtttgttaacttttttgatatatatatatatatatatatatatatatatatatacacacacacacacacacatatatatatacacgcacacacatatatatacacacacatcaaaatatatattatatatatatataatctttccaattgccttcctgttgattttcatatctctttaaatttgattaatatcgttttttcagacaaagaaagtaaaacccaaagaagagagcaacaacatgaagagtaactttggctatatgcaatctcagggcagagtgtcaaagatttaaaaaccagaccaagcaggcatggaggtacaccagtagtcccagctactctggaggctaaggcatgaggaggataacttgagtctaagagtttgagtccagcctgggcaacatatcaagaccctcatctgaaaggaagaaagaaagagagaaggggaggaagaaagagagaaagagagaggagatagagaaaagaaagaagagagaaagagagagacagaaacaaaagaaaagcaatatcaataaaaataaacaggtaattggcagcttgttgccacctgctgttcattctcccatagctccatccataggagcaactgcctagctgaaagactacatttctcaggactcctttgcaattaggaatggccagtgtaactaaattctggccaatgaaattcatttgacatccgggaaggctatttgaaggaaaatgactcaactagggcatgggcccttttgccattattccagtgaacatatgaataataagaaagcaaaacagccttattgctgatattaagaaagttgcagtagtctgatctaaccagccacaacattctcttaacccaaagcctaatccagagcaaagctttaactcttcaattccatgaaggctgagagaggtgagaaggctgtagaagaaaagttgcaagctagcagagattggttcatgatgtttaaggaaagaagccatctccaaaacataaaagtacaaggtgaggcagtgagtattgatgaagaagctgcagcaagttatccaaaagatctagctcagatcattgatgaagttggctacactaaacaaaagattttcaatgtagacaaaacagccttctattggaagaagatgccacatagaatttttgtggctacagaggagaagtcaaggcctgacttcaaagcttcaaagaataggctgactctctcattagagactaatgcaactgatgactttaaattgaagccaatgctcatttaccattcaaaaaataccaagtcccagccgggcgcagtggctcacgcctgtaatcccagcactttgggaggccaaggcaggcagatcatgaggtcaagagattgagactatcctggccaacatggtgaatccctgtctctactaaaaatataaaaattagctgagggtggtggtgcgtgcctgtagtcccagctactcaggaggctgaggcaggagaatcgcttgaacccgggagatggcagttgcagtgagccaagactgtgccactgcactccaccctggcaacagagcaacactccatctcaaaaaaaaaaaaaaaaaaaaccaaggcccttaaaagttatattaaatctactctgccagtgctctataaatgaaacaacgaaacttggatgatggcacatctgtttacagaattgtttactgaatattttaggatcactgttgagacctattgctcagaaaaaagattcatttcaaaatattgctcattgacaatgcagctagttacccaagaattctgatggaaatgtacaaggaaattaatgttgttttcatgcccactagcaaaaaatccattctgcagtccatgaatcaaggtgtaattttgactttcaagacttagtatttaagaaatacttatttcctaaggctataggttccatagatagtgattcctctgatggatctggtaaaggtatattgagaacccataaaggattcactatcctagatgccattaagaacatttgtaattcatgggaggaggtcaaaatatcaacattaacaggagtttagaagaagttgactccagtcctcatggatgactttgaggggttcaagatttcagtggaggaagtcactgcagatgtggaagaaatagcaagagaagtagaatcagaagtggaacctgaagatgtgactaaattgctacactctcatgatgaaaattgaatggataaggtggtggtttttttggttggttttgttttgttttgttttgttttgttttgttttgttttagagatagggtctcactctgtcacctaggctggagtacagcagcataatcatagctcactacaggctcagactcctgggctctaacaatcctcccacctcaacttcccaagtagctaggacaaccagcaagcaccaccaccacacccaactgatttttttcctgtagagatgagatctcactatgttgcccagaccagtcttaaactcctggctttaagcaattctcctctgttttagtccgttttcacactgctgtaatgacatgccggagactaggtaatttgtaaaggaaagaggtttgactcacagttccacatggttgggaaggcctcaggaaacttacaatcatggcagaaggggaagcaagcacatcttacatggcagcaggcaagagagtgagcgtgtgtaggaagaggaatagtcaaacacttagaaaaccatcagatcttgtgagaactcactcactgtcacaagaatagcatggggaaacctccctcatgatacagtcatgtcccaacaggtccctccctcaacatgtggggattgtggggattttggggattacaatttgagatgagatttgggtggggacacagagccaaaccacgtcatccttcctcagccacccaaagcactgggattacaggtgtcagccaccatgcctaacctggaattgtttcttatggatgagcaaagacagggttttcttgagatgaatgtactcctggtgaagatgctatgaacattgttgaaatgacatcagctaatttagaatattacatcaacttacttgataaagcaacagggtttaggaggattgactgccattttgaaagaagttccactgtgggtaaaatgctatcaaacagcatggtatgctacagagaaatctttcttaaagcgttaacagataccaggcatggtggttcacggctgtaatcccagcattttgggaggctgaggcgggcagatcacctgaggtcaggagttcgagaccagcctggccaacatggtgaaaccctgtctctactaaaaatacaaaaaattagccaggcgtgatggcacatgcctgtaatcccaatcccaactacttgggaggctgaggcaggaaaatcacttgaactcagcaggcagaggttgcagtgagccaagattgcaccattgcactccagcctgggtaacaagagcaaaactccatctcaaaaaaaaaaaaaaaagttaactggtatagcagatttcattgttgtcttatttgactaagttgctgtggcttccccagccttcagcaatgaccaacctgactagtcagcagccatcaacaacagggaaacctcttccaccagcaaaaagattacaagtcactgaaggctcagatggttgttagcattgtttaacaataaagtattttttaatgaaagtacatacatttttaagacataatgctattgcatatttagtagactacagtgtagtataaagttatcttctatgtgcgctggttaatcaacaattttgtgggacttactttattgaaatatgtactttattacagtggtctggaaccaaacctgtgatatctccaaggcatgcctttatgtaccgcctctgtcctgaggagacctccccaggtctctgattctgttgtgcgttttattctggcatctttcttctcatattgctaggatcttttattgtcccacaaatccaaatattctctactttttggaggatactagcatcttttaaaaatgatattctcattgtatttcctgcatagtttaataaaccagtaattattttgaccatcttcagcaattctactctcactgcctcttttaggcctagcatttacacttctgattgggcactttgggtttatattaagcagctcctaaattcacctacctatagaaggagtcacagatacaaacctttgtaagagttactcatagtaacatttatattctaaaatcattagctgggtgtgatggcacgtgcctgtagtcccagccaccttggaggctgagacgggaggcttgcttgagcctatcagtttgaagggctgcagtgagctatggtcacatgactgccctccagcctgggtgacagagtgagaccctgtctaaaaaaaaacaaaatacaaacaaaaaaaaatcagttatgactcagcactataatgattagttctaagtgtctctaaaaaacaatgtttcgttgccaggtgcggtggctcacgcctgtaatcccagcactttgggaggccgaggcgggcggatcatgaggtcagcagatcaagaccatcctggttaacacggtgaaaccccatctctactaaaaacacacacaaaaaaattagccaggcgtggtggcgggcgcctgtagtcccagctactcaggaggctgaggcaggagaatggcgtgaaccctggaggaggagcttgcagtgagccgagatcgcgccactgcactccagcctgggtgacagaatgagactctgtctcaaaaaaaaaaaaaaacaaaacaatggttcgcaagcttgaacacacacctggaactcgttaaaacacagatttttggctccaatccccagggtctccaattaggtcagtctgaggtaggccccacttgctgctgctgctgctgctgccgctatgcaatcacgttttgagaaccactgttctaaatcatggcaagcaatttgcaccctttcaagcataagcagcctacctggcttccagatgtagcccatcaactacgagttcaggaggaaagactagaaaagtacttttgtgttgtgctatggtttgaatgtttgtgtccccctaaaattcatgttggaacctaatgctcgatgtgaaaggattaagaagtggggcctttggggaaatgattaagtcataagtcatgaagtctccatttttatgaatgggagtagtgctcttataaaagaggttgaagggagctgccttgccccttctaccatttgaggacacaaaccatctctaaagcagacggtgggcctttaccagacactgaatctgttagcactttcaccttggccttcccagcttccagaactgtgagaaataaatttcaattatttataaattagctagtctattttattttgttatagcagccttcacggactgagacatgttgctacttagcacatgtggtctaacctaaatgaaaagctgtaacaatttttcccttggtatttttccttcaataaggaaaaaaatctaagcactgatcttaggagcagtttagggatggtcagaatcttgtagcctccagctgcaggactcctaaaccataatttctaatcttgtggctaatgttaatcctacaaaagcaacctagtccccagacaagaaggaggtcggttttgggaaacggctttcgtcatctttgttttaaactataaattaagtttctcccaaagttagttcaacctaaatcccaaagtgctgggattacaggcatgggccactgtgcctggttaaagtgaaacaatttatgtgactttttttcatgtgactcaataaaaccactttattttcataaaattttattttgtctgattgactgataaatatacgtaaagcttggttctcactgctccaagccacagcctgactccacacagataacagaccatcagtaataaagccgcatctcctagtccttgagacctg

SEQ ID NO: 1233 - DNA, 166065 bp, Homo sapiens
aaaaaaaaaaaaaaaagaaagaaagaaaagaaaaaaggctcaccgtttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgatctgcttatttctttgactaccttcttccatggaaccagttttccctgacagccttgggattctagcatagatcattttggagtttgtcatttaaatttattttcacggcctgctttggacattttttcagctagagctgttagaatttcagtacatttaagacagtgatgacatgctccagtcctttcatctctctctcctcagttaatagaaaggaaacatagcccatctatctggacctgtacagaagaatttggagggaaaaaaaagaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctggaaaaaagcttgccacattttactcccataaagataccaaaaaggcgatggactgggagtcagtgcaccttagtttaatgtataaaatgaaggacttgaaccagaaatggaaatgatcatctactgtgaatctaaaaacactcaaggctgggcacactggctcatgcctgtaatcccagcactttaggaggccaagacaggcagatcgcttgagcccctggagttcaagatcagcctgggctacaaagtgagaccccaatctctacaaaaagacttttaaaaagtggaaacataaatataaataaataaaaacattcatatcatttggtttgtggaaaagagttgctgtagagtcctcaaacttgagccattgagccagttcccactcagtctctccatggcccaggcacaaccttagtcaagaaaagaatgccttagaacaggaggaaaagaggataatatcgaatggccctacattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgctaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaagaggtagccgactttgtacagagcccaccagtggtcttacaacttttcatgccaaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttctttccatctgccagcatgtttggtcttctggcacctggtgttctatacagcacaacatgcttctttgtgttaaattgagacttgatccacataccatcaacgcagtattataaagtgtacaattcagtggtggttagtatattctcaaggttgtatagcaaacaatcaccattatctaaccccagaacattttcatcatcccccaaaaaaacatggtacccattagccatcactccccagtgctgtcttccctcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatttggttgtttctactttattttggcttttatgaataatgctgctatggacatgcatgtactactttttgtgtggacatgtttttaattctagggtgcatccctagcagaattgctagatcatatggcaactcttatgtttaactttttgaggacctgtcaggctgatttccacagtggctgctccattttacacttccatctgcagtgtttgagggtttcaatttccccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcaaatcctctgcctctgcccatttaaaaaattgatttgtctttttattgaattataggaattctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttactcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgagatttactcccatgtgtttgtctaagagtcttatcattttggctcttacatttaggtatttgacatattttgcatcaattcttataattgtgtgagatgtagggggtccaccttcattatgttgcacatagatgttcagttgttccagcaccatttaaaaaaaaaaacattatttccacgtagaattgttgtagcacccttgtcaaaaatcaattttccataaatgtgagggtttatttctgggttgtcaattctattctattgatttatttgtctgtccacattccagtatcacactgtgattgctgtagatttgatttgggttttgaaattgggacatttgagtcttcccactttgttattttacaagattattttcctatttagggtgccttaaattgcattataattttagaactagcttgtcactttctggaaagaagccagctgggattttgataagaattgtactgataatagcaaagatatgtaatcaacccaaatgcccaacctaactgctatgttattcctattccaatactttgcaatatatgtagctttttagaaagaggatatgttagcagggcgcagtggctcacacctgtaatcccagcactttgggaggctgaggcaggtggattgcctgaggtcaggagttagagaccagcctggacaacatggtgaaaccccgtgtctactaaaagtacaaaaattagcagggggtggtggcaggcacctgtaatcccagctactcaggaggctgaggtaggagaatcacttgaacccaggaggtggaggttgcagtaagccgaggtcacgccattgcactcaagcctgggcaacagagtgagactccaatggagacggggtttcagcacgtttatcaggctgctctcgaactcctaacctcagatgatccacctgcttcagcctcccaaagtgctgggattacaggcatgagttaccgtgcccggccaataaatgaaaactttttcactcaaaaaaacaacaattgtagtgaaaccatagatcaatttggagaatcgtgctattattatctgcttcatgtttacagaatactctgttgaatttggtttgccagattttgtcaagcatttttccatctacattcataagaaatactggtctgtaattttttgtgtgtgatgtctttagtttggataccaggttaatatcaccctcatagaataagttaggaaatgttctctcctcatctgtattttgaaagactttatgaaggattggtgttaattcttctgtaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatccttttcatcatattataatcctttatgtctctaagaacaatagtaatgtcccctctcatttctaattttaataatttggtcttctgtatttgtgcagtgcagtggctcacacctgtcatcctagcactttgggaggctgcggtgggaggattgcttgaccccaggagttcgaggccagccagggcaacatactgagaccttatctctacaaaaaaaaattaaaagttagctgaacatggtggcacacgcctgtagtcacagctactctggtggctaaggcaggaggatcacttgaggagatcagggctgcagtgagccatgattgtgccactgcactccagcctgggaaacagagtgaaaacctgtcttgaaaaatgaacagtaaaaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttatccgagtgtggtggtgcgcacctgtcgtctcagctacatcttaattttataacgttgtagttcagattaattccaactttgtttcaatggtatacaaaaacttcgcttctctaaagctccactctcaccccctcctttatactgttattgtcacacattacatctttatatactttatgttcatcaactagatttataattattgcattatgtaagtatctttttcttatttttttttgttttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccaaccagtgctttttatttctttgtgcagattcacattagtactccttatagggcaggtcttctagcaacaaagtctctcagtttttatttatctagaatatcttaatttctcttcaatttcaaaggtagttttgacaggtatagaattattggttgacagtttcttcagcactttgaatatgccatttcattgccttttgtcctccactgttgtgtgtggttgctttgtttttagacagggacttgctctgttacccaggctggagtgcagtggtgcaaccactcacatcgttgcagcctccacttcccaggcttaagcaatgctgtcacctcagcctcctgggtagctgagactgcaggcatgcaccaccatgcccagttatttttaaattttttgtagagacagggttttactctattgccagtgctggtatccaactcctggcttcaagcaattcttgagcctcaagcctcccaaggcactgggagtacaggtgtgagcaaccatgcccagcatctccattgtttttgaagagaaatcagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccattatttcttcaaatattctttctccttttttctgtttttcttctcctgggactctcattatgtgtatgttagtaagcttgatgatgtgttccacaaacaggtctctgagattccattcactttcattcatttttatttctgttcctcagggtcaacaatctcaattaaccttcaagttccccattctttcttcggcctgctgtaatgtgccattgagaacctctaataatttttccatttcagttaccatacttttcaactctagaatttctatttggctcctttttatggtttctatctctttattgatattctctatttgatgagacattgctttcatactttcctttagttctctagtctacagaactgaatcatttctcttatctctttgaatatattttaaatagctgaattaaatccttctctaggccaggcatggtggctcatgcctataatcccagcactttgggaggctgaggctgaggttgaggctgaggccaggagttcaagaccaccctgggtaacttcgcaagaccccaactataaaaaataaaaaaatctttgtctagtaagtctaatatctggtctttctcagggacaatttctgcttatttctccccccaccaagtgtttgggccatactttgtttccttgcatctttcataaatgtttgttaaaagttgaatattttaaataacataatgtagcaattctgaaaatcagatccatgctgccagggtttggtgttactgctgcttgtgttagtagttgctatttatttagtgacttttctgaacttcttctgtaaagtctcgcattatatgtcatgtgttgccactaaagtatctccttggttagcttaccgatcagctaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaagatcagccaggggtgagagtttatgaacttagtaggtctttcctgaccatgctggcagcctgccctatgcatgcgcatgacattgcaaattgccaggaatatgtcttatggacttctagtttcccaagcatatatcagagtgtttcaaaattcctgtggacatcttattactcagcttttcctattaagcttttcgattaggctttttttccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctgcttggggatgtgggctgtttttcaaggcaactactgagctagagagtgaggaatggtctaaggcaagttaacacaaatctcactgttcttacagaaatttttcttgaataaatgctcctcgggttgctgcaagactttggttacatttctagagttctgaaaaagtttattatggtcaatttttttttttgcccttttcttggtgtttgttgcttttatgaagggatgaatttttggatgtctctttttttttttttttttttttttgagacagagtctcactctgttgcccaggctggagtgtgcagtggcgcaatctcgtctcactgcaagctccacctcctgggttcacacaattctcctgcctcagcctcccgagtggctgggactacaggcgcctgccaccacgcccagctaatttttgtatatttagtacagacggggtttcgccttgttagccaggatggtctcgatcccctgacctcgtgatccacctgcctcagcctcccaaagtgctgggattacaggcgtgagccactgcgcccagcctcgatgtctttattccaccattttcactgatgtcacttacaacatggttttaaatctctgaaggctcactgggcacatgcctgtagtcccagatactcgggaggcaaaggaagaaggatccttcgagtccaggaattctgggctgtagcatgctatgctgattgggtgtccgcactaagttcagcatcagtatggtgacctcccgggaaaaggagaccaccaggttgcctaaaaaggggtgtcccagcccagttcaggaatagagcaggtcaaaactcccatgctgatcactagtgggatcatggctgtgaatagccactgctctccagcctgggcaacacagtgagtgagaatgtgtctcttaaaaaaagaagtctcatcgaccacagactaattaactatttaatcatgggaaatgattaggggaaagacataaaaagagaaactgtaatccacttttttttgctctatcgcccaggctggagtacagtggcttgatcttggctcactgcaacctccacctcccgggttcaagcaattctcctgcctcagcctctgaaacagctggaattacaggcaagcgctgccatgccctgctaatgagaaattgtaattctcatagaggtcctcccagaggagtagaagaaggttgaaaggcacttctgtatttagtcttctcaatattaaggctgggcccagtggctcacaccagcactttgggaggccaaggcaggtggatcacttgagatcaggagttcaagaccagcctggcaaacatggcgaaactcccatctctactaaaaacacaaaaaatagccaggcgtggtggtgcgtgcctatagtcccagcaatttgggagactgaggaaggagggttacctgagcttgggaagaggaggttgcagtgagccaagatcacgccactgcactccagcctggtcaatggagcaagaccctgtttgggtggggaggggaggggagtggacaggagaggagaaaggaaagaaaggaaaggaaagaaaatagaaagaaggaagggggagggaaggaaggaaggaaaaagagagagaaagaaaaagaatgaagaacgaaaataaaaattttttaaaaacctaaggttaaaataaaccctttttcttcatatataaacacatgagttcaaattacagctttgctgcttaatagcttggtgacccaggacaagttatataacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggtcaacctaaaggcagattttcttttatttcttcctgtttcttttatttttcttgttcaccttaaagaattaaaaagaaaatcgattccagcattttggaataaaaatttgcatcaaaatcaatttattcattttattgacatataaacaaaatgtcatttgtttattcaataaacatttgttaaatgcctaatacatttcagacatcatgccaggcacggggatgacagggcatggtggcgggcacctgtaatcccagctactcgggaggctaaggcaggagaattgcttgaacccgggaggcggagattgcagtgagccaagattgcgccactgcactccagcccgggcgacagagtgagactccatctcaggaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctattttttttaactgtgcaaattaagccatgaattttaaaaactttataaagataaaagacaagcatccagcccagtggctcaagctggtaatcctatcagtttgggaggctgaggcaggtagatcacctgaggtcaggagttcaaaaccagcctggccaacatggtaaaaccccgtctctactaaaaatacaaaaattagctgggcatggtggtgggtgcctgtaatcccagctactcggaaggctgaggcagaacaggagaatcacttgaacctgggaggctgaggttgcagtcagccaagatcaagccattgcactccagcctgggcaacaagagtgagactccatctcaaaaaaaaaaaaaaaaaaatagatgaacaacgaattatgatgagcaaattgaattatggaggatgctagaaatagtgtttcctccacagtcagggcttcctaccaacatagtcacttttagggtttttgacctgaaaagttctgtggcatattttttctttgctatccactttttttttccttgtagtctcaaaggtttgtcagtatactttaaaacaatcctggtaacagttctagattgaaggagactaaagaatcatgtactaagtgtaatgtctgatgtttgattggattctcaattttttaagccatgttatgattgggacaattgtgaaaatgtgtatatggaccacatagtagacaatgataatatgaagttccattgggtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaacttgggggcagaaaaagaataccaaaaattttgggctcaagcctgtaatcccagcactttgggaggccaaagagagagggtggcttgagcccaggagttcgagaccagcctggacaacatggtgaaaccccatttctacaaaatatataaaaattagccaggcgtggtggcacacacctgtagttctagctactcatgaggctgaggtgggaggatcacttgagcacaggaggcagaggctgcagtgagccaagattgcaccactgcactcagcctgtataacagagcgagacctggcctcaaaataaacaaaagaaacacctttgtggcagaggtaaggctgctatataacaaaatgctgggttacggttccgggtccattccatatgaagatcagaggcttccactggacccaaaggaataatactagtcacttgtgattgttcctctataggtttgaaagatgtgtcaggccaactcattggatgcagttttaatctaaaactctatacattgtactcccaattcatagacttcttgtatccatgaaaccctcttctgttttcacagtctcaatgtggccccaataaagccatccttttggaggactcagaaaaggccccccacaacctctgcaacataataattatagttaactcttattgagcactcactgtgcaccaggcatttttcaggtattgattcatttgatcctcaaaattcattagaggtaggtactattataatgacaaggccaaggaacagagatttaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggttacctcttttgcccaaatttacgtattgaaaaaaattcaaacaagccagaaagatgaaagaatagtacagaatctaatcaaagatcaggcactgcatgtcatgtcttcatttcctttaatctaaaacatgcttctactttctttgatctttcatgacattggcattttttaagagtcaaagatagttgtcttgtaaattgtcccacaacccggatttgtctgtttcctcatgacgaaattcaagttaagcatttttgggaaaaatactgcataggtgatgtatccttcctgcctcgtaactgcagatggcctgtaatactaagtttgatcacttgaccaaggtgaacttccagatctctccattgtaattattttgctgggtacagtggctcccacttgtaatcccagcactttggaaggctgaggtgggaggattgcttgagcccaggagttctacaccagcctgagcaacatggggaaaccctgtcactactgaaaatacaaaagtacaaaaaaaaaaaaaattagctgggcatggtggtgcaagcctatactcccagctactcgggggactgaatttggaggatcccttgagcccaggggggttgaggctgcaatgaggtataattttgccactgtatttcagcctgggtgacaaaataaaaataaaaaataataattttccgcttggtaattaataaataatctgtgggttgttactttgagttcagtgaagatcctgttctcaaatgtcttttcacccaaatgtgcatcagtgataatccttgtctgaatgaatttgtattacactgatggttgcaaagtgacaattttaaaaattctgtcattccttctacatttactagctggcattatttcattgaagaagaactccccctctttctttttctatatcactcttcgtggattcttctttatattaaatatgttgtaacttattgttgttattcttttgaatgctcaaattgtccagatttgaccaatgcaatctttgttattttttaactccacaatcgaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgagttgggaagagatacttctgaattaaactactaatcactgtcacccaattctaatcccaaccatctttattctaggcataccatactcactgccatgcttacccttcagttgggcacctttgccctccttcctattggccttctggttcctacccaactgtccagtccataggcttcaatgacacctttttcccacacctgtggcagcgttggctgcctcctttacctactcaagtaaccgctttaccgctaatttattgctctctgttttcatctataggatcttacctagccatatggcctgctgcctctgccaacttaaaaacagcattgaggctgtctgcaagacagtcaagctgcattgcaacagtgcatgtctgacaaacaccatacattgtcgtgagtccaaattgcgcggtgataaattgttacattaagtatttgtttttaaactttttatttttaatgatgataaaattttaagctaatgacataattgctttatttttatttactcattcagagttaaactccctcaatttctgaactactcccttgctgagagtcaggttctcagttactattacaaaatttaataatagaactgttccatatgcacaaaggaccaagacaaaggaatgggaaggctagagaataacattaacatccacacactgtgtactgtgctctctgcttgatgctttgcccacagtgataatttcttcatatagtgcaaagtagtttgtaaggtggttttaaattcatgaggtctcaagtactctctgccttataggacagatgtagatacggtttcggtttttctgtttttacagttttataagagtacaagtgatgctgttttatttgaagcctgagagcttctggttccataaccagaaattgctacctggctcttctaatagaatggagggcttttccattcttagaccatccaactctgaacttgctctgaatctcaaacctttctgttcacagaacaaatgctcaagggctttcaagagtgtttctgtagattaggtttattagcatcaacttcatgacttctaaaatgtgactactttcatgtccagatagcttgaatacaggtatctaccagtgatatggggtggagaattaataatgcttggttacataaagtcagtgttgcttatttttcaaaactttttttttttttttttaccaattatattattcccttctccccaagaagtgggcagaaaagctttgttaacctccttttacagatgaagaaaaacaagatcagaggtgctaagtgctgtagcctagtgccaggtcttctggccccaattctgggttctccccaagcccatgcttcttccactttctcacaatctttacttcttcctctgaccctcaccaccacccaaaatacttttaattctggaaaagaaacccagctgcacactggcacacttgaccttcatgcagtcagaagctttggctgattccccatccaaaatattagagatgaaatgaaagcaaagtaggcatctgacaaaagttgctttttcccttctgcattttaggacctcaagtaatgtttatccagaaactgttatcataccagagattcactgtgtatttaacaacataggcatgcaatctggcaaatttgaaaaactcttaacatacaccccaaatccctgcccaaatttaagaactagggtggacacagtgcttttttccatgtcgcatcttctgtgatggggctacgatatgtgggagcagagaatggggagggtggagcgcatgccagatgaggatctatcagcaatgggagggggcctccactttagcatctccaccctgctcctctcagaggaccgcctttcattgcattcagctgtgatggtagcaagaacacaggcgcaccgaggacgaggagagcgggagccttgtgctctctctgcatctgaggcaggacagcacagggtatggagcagtctgcagagaggccagctcatcagctcatcagggaagcacttgtcttccaccttgggctttgactgagcactgggcaattggaccctggggatcaatgaaataatcctaagcagagttactctatgtcacactatggaatgttccaagtagatggccgtgttttcaaaagatatattttctccttttgttgttgccatttcataggtttaggattgggtgtgtgtgtctcctctctgaatggcactcaaatgtttgctgactcctactctgtgtgactggggtgtacagctatggactgatgcatcccatcccatcatctttcatgagcaaagcagtctcttttttgacagctgaagaagaatctgtagggaatccagaaggagcattcatgaagacgttacaagcccggaagaattacacaagcactgagctgactgttgagccggaggagccctcagacagcagtggcatcaacttgtcaggctttgggagtgagcagctagacaccaatgacgagagtgaggttatcagtgcactaagttacatttgccatatttctcagcagtaaacctagatgtggaatcaatgttactaccgttcattaaactgccaaccacaggaaacagcctggcaaagattcaaactgtaggccaaaaccagcaaaaagtgaatagagtcctcatgggcccaaggagcatccagaaaaggcacttcaaagaggtgggaaggcagagcatcaggagggaacagggtgcccaggcatctgtggagaacgctgccgaagaaaaaaggctcgggagtccagccccaagggagctggaacagcctcacacacagcaggggcctgagaagttagcgggaaacgccatctacaccaagccttcgttcacccaagagcataaggcagcagtctctgtgctgacacccttctccaagggcgcgccttctacctccagccctgcaaaagccctaccacaggtgagagacagatggaaagacaacacacacactatttccattttagaaagtgcaaaggctagagttacaaatatgaaggcttctaaaccaatttcacattccagaaaaaaataccgctttcacaaaactcgctcccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactcagaactacattaatgagagcacggaagcccagagtgaacagaaagagaagtcgcttgaggtgaggaccacacagaaacatgagacccagatttcccatcatttagcatatcccaggaaagtgcccacacagaagaatctgggactcccaggccatagcttatcttggccatgtaactttggtcatgacagtgatctcccactttgctcatgtagagagtgaaatatagattagggcacaagatgaactgtaggccaggggtggtagctcatgcctgtaatctcagcactttgggaggccaaggtgggtggattacttgaagtcaggagtttgagaccagcttggccaacatagtgaaagcctgtctccacaaaaaataaaaaaattagctgggttgatgacacgtgcctgtagtcccagctacttgggaggctgaggtgggagggtcacctgagcccagggaggtcgagtctagtgaacggtgattgcaccactgtaccccagcctgggtaacagagtgagaccctctttcaaaaaaataaaaaagaacctgtaagctactcacctggaatactggggttttgaatagttagctctcattctggtgtgtttttttttgttttgtttttttgttttttttagctcacaaaataagttccaggatatggctatactgacaaactcatcttggcattaattgtgactgaaatactaatgatttttattatacttttctgcctcattgtggtaaggacaataattaattcaggttgtcagaatgcagtcctgtttctgtgtggattcagagctcacaaactgaaaaccaaagccactttcccacctgctgctacttgacatacttcttcagtcatttaaggctgaggtgtatgctttgttcttttattgcagtgtatatttcaggatttttaaaagatcctcgcttccagatctctgtgaattgaaaccaagttaatcccactagactattttaagaagtcgatataatagcaaaatttctccacccaaaactatgtcaacaattggatgtactcatcaagtcacccttactctgccactaatttatttccttggtgctgaaatgatgagagaggtataatctccaccctcacggatttgtcatcaccctggagaggaaggagagagccaaaagacagaagtattgtcttgtagacttattagatttacacagtatcgtcctccagtgtgtaaggcattgtctaaataggtccagttaaagcactacagagtagccatcttttacaaaaattgttggccacatttttaagttcacaggcgagggggaacgtctcatactctagccctcctgagcctagaccctctgtgagatgtgtcaccatttcttggacaccatgtgagacattccccctcagattagagatgctcagcctgcatcaacttatctaaagcctacatctggctactctggggcaagtcctgtttacagtgcccattcctggagcttgcctctgtttgtcttttgttcgattacatgatatattacttttcccaacaggccagtgctagcatattggaagagtgatttaataaagctggcaaccttgacgctatgccaccagtccaaccttatttgcctcatttaccatttccattattgtggcagccctccattccagccacagcagcccctcactataccccagtcacaccacccacatttctgcttctgtctgtgtgtttgtccatctaaaatgcccttatttcactctgcctgtgggagtcctatgcatctctcaaaagccaacacaagttcatctttcttcttgacaccttccctgaatattccagccgtgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagcgaggccctgtcttaaaaacagccaccaccaaaaactatcttgggatttgaataggattacgttaaatttgtagattaatttgagaatttacatctgtacgacattgtaggaatgtgctgtctcatgatggaactaacaaggatacacctgctgtccccagcccttttgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttctttttttcccctggatactagaactgaggaaacactattttctcatcttactggtttttgcgcccccactctattccttttacacaaacctcacagaattttaaccagaaaggccaggcaggatggctcacgcctgtaatcacagcactttgggatcacttgaggttaggagctcgtgaccaacctgaccaacatggtgaaaccccatctctactaaaaatactaaattagctgggtgtggtggcacaggcatgtaatcccagctatttgggaggctgaggcaggagaactgcttgaaaccaggaggcgcaggttgcagggagccaagatagcaccattgcactccagcctggggaacgagccaaactgtctcaaataaaaaaaaacaacaaaaaagaattttaactacggagaacttagatagtagtttgtccttttatgacaggaaaactgagaaggagaaagggagagtgtcttaccccatggtcacacaatgcactctgccttttcctattttattcaaattcaaaaataacatgttgtggtttaagctgatttcgcagctcactcactcatcagcgacagccagctgtatgaagactgtgagatagagaacttggctagctgcactcaggcatttgcttgaggtgatccaacttatagaataaagtatctagaaaaggaagaaccacttcatctcccaccccccatcaaatgatgcctgtgagactaagtccgaaggggactgatataaaatgcttctgcccagcatggttgtgcagtttgttcactgcacaagggcacttggccaaggggatgagtgggaatgaacatcctgcccctgctccatgctgagccacatacaaagtccccccagtatattgtggggcccttctggacagacatggagagcttctgaaagtcccacatgcatggaattattttcaagaccccaggtatgtggtctgtggtggttcttctccctgtgattatggactgagatactcatttagttctaataagaccagagaagtacattgtgagatacgtgggaaacggctgcatcactcactgtcttgtgcatgtgtctccccaggggcattttcagatttctgccacggagatgctcttcgcaaagggagagtcaggtacattggaggattcattgctgtgaccagggaaagcagaggacatgcaaaattaatatttccctttctatcttctaggatggacttttttcattcagaaagccgctctggcttaaagacatgtacaaacctctcagtgccacaagagtaaagaatcacgcatggaagctgcacaagaagtcatctaatgaggacaagatcctcaacagggaccctgggtaaatgacgggaccctcacagttcccatctaaaatgaggagggggtgagacgcttaattgctcctttcaagaatgaaaaccttggcattgttattcttatcccagggacagtgaagccccaacagagaaggaggaggagagtgaagccctgccataggaggagaacccagcccacctcaggcctcctgcaaaaacacatagcataaacaataccatcagaaagaaaagcaggactgaagccagcagcccacacatccacagaggcagcgggcagagcaagcacagggccatcgttcctgcccttgtttcccagtctaattagtcacccagacctgaaaacatatcctcagggggtggagattttacaattaaataccattgtttttggtgccctctccctgggttcatcaagcaccagtcatataataccacatacttgaactcctgcccacaggggacctcccatctcctggcccctattataggatcactgggcctacctgcactgtggggccaagccctgtctttttcccaagccctcaagcacacgcatgaatgttcatcccgacttggtagggggcttttcacccttacaagatggcaaaagattcacactgctttttttaaaatttgtttttctttttaaaaatcccaacccttggatagcaagggaggtgctggaggggtagggtcaagaagagtgtgtgagaacagtaatttcccaagactgccctctgcgggactgtatttcagaaaacacactggtggggctacctctccattcacatgtactgccctagcctctccccatccccggctgatgcacttccatatctgcactgttccataacagcagtagcatgttgcagaaagcgctaggattcctccactccatcttcaaagaaaaagtcgctaataaatcacatttggtaggttagtgaacgttaaacacattagtgagcaaaagaaaataggaatgaacaagaattggtcatctacctaactgaacacaaatgaactctggcagttcggtaataggaggtaaagaaccgcgctaattgcagaacagcagcccccctaccttcccaggagcagtgtgactgggaagcagccccgtgtgtatgctggtgcaggttctaagcaaagtgagctgcccatcagttctgatgagtttgctgatgctagacatatgacatctgttctcttgctgcctgccccagttatctcccaaagttctttactgagaatgaaaagcatctttctctgtgtggtgacttcagtaggccaacaaatatttgagtttaaagcacaagactaaatagtcataggcagagcagtgctaccatttacaatttgcttacttgatgctaaaccatgggttaggcattttacagtcatatcatctagcccagcaagtcatggaagcatagttgttaaaatcatctgatactttgggaggctggggcgggcagatcacgaggtcaggagatcgagaccatcctggctaacatggtgaaaccctgtctctactaaaaatacaaaaaaattagccacgggtggtggcaggagcctgtagtcccagctactcaggaagctgaggcaggagaatggcgtcaacccgggaggtggagcttgcagtaagccgagatcatgccactgcactccagcccgggcaagagagtgagacttcgtctaaaaaaaaaaaaatcatcatctgacagataaggatacagggcttgaagaacataggtgacctgccccaagtgtccaaagccacacatccaaaatgacaaattagggttttaagccagcactcttagacttcaaagcctcttaaccattccactgccctgctgtagggcatagggagataagggggataagctatggttgccatcaaagagttaatatatcaataatatgcggatggtgaggatgatggcagctgctaggggtctacaggcgtgtaccaccatgcccagctacaattcttattattcccaaatgctactgtgtccggaattggtgggttcttggtcttactgacttcaagaatgaagccgcggaacctcgcggtgagtgttacagctcttaaggtggtgcgtctggagtctgtccgttctgatgttgagatgtgttcggagtttcttccttctggtgggttcgtggtctcgctggctcaggagtgaagctgcagaccttcacggcaagtgttacagctcttaaggcagcgcgtctggagttgtttgttcctcccggtgggctcgtggtctcgctgggctcaggagtgaagctgcagatcttcgcggtgagtgttacagctcataaaagcagcgtggacctaaagagtgagcagtagcaagatttattgcaaagagcaaaagaacaaagcttccacagtgtggaaggggacccgagcgggttgccaatgctggctcgcgcagcctgcttttattcttatctggccccacccacatcctgctgattggtagagccaagtggcctgttttgacagggtgctgattggtgcatttacaatccctgagctagatacaaaggttctccacgtccccatcagattagttagatacagagtttcgacacacaggttctccaaggccccaccagagcagctagatacagagtgtcaattggtgcattcacaaaccttgagctaaacacagggtgctgattggtgtgcttacaaaccttgagctagatacagagtgccgactggtgtatttacaatccctgagctagacaaaggtcctccaaggccccaccagactcaggagcccagctggcttcacccagtggatcccgcactggggcggcaggtggagctgcctgccagtcctgcaccatgcgctcacactcctcagcccttgggcagtcgatgggactgccccgtgaagcagggggtggcgctcatcggggaggctcgggccgcacaggagcccatggagggggtgggaggctcaggcatggcgcactgcacgtcccgagccctgccccacgggaaggcagctaaggcccggtgagaaatcgagcatagcgccagtgggccggcactgctgggggacccagtacactttccgcagccactggcccgggtgctaagcccctgactgcctggggccggcagggccggccggctgctccgagtgcggggcccgccaagcccacgcccacccggaactccagctggcctgcaagcaccgcacgcagtcccggttcccgctcgcgcctctccctccacacctcccttcaagctgagggagtgggctccagccttggccagcccagaaaggggctcccacagtgcagtggtgggctgaagggctcctcacgtgccgccaaagagggagcccaggcagaggaggtgccgagagcaagcgagggctctgaggactgccagcatgctgtcacctctcactaccccaccatatttctaaaaactcccaaagtaagattctactttgcctagtttgtcctcaattgagcagttttgtctaagcccagagtttctgctgggccagactatggataagctgtctctcccaggctggtgcccatgcctgcctgtagccggggggggggaggggcacccggggtcatgtggaacaaaacatgactgcctagggctgcctctgtctccatctcactgatcgcaaatcacagttcagacagccagctcttaagtgagacctgagtgccagagagaggtggatacgaggccaacagttactaaatgaatgaaaattgtgattccaacgaagcctgccagagaaataaagcattttttaaaagatggaaataagccgatatctgattagggcaaacatgatgcagacaagaaatgcactggttcagaggagggaaggtcaggccgcctggggagagtccatgaaaaagatggaacgtgccagatgctgtgcctggtgctgggaaagagttgactaggccagcatccctttcctcaaagggctcctagactggggggagggctggatatctgaatacatcctgaggagacagtgtgggacagcatggtggcagtggagccagccgtggttctgctcttggtcggctggaaaggagacgtaagggatggcttagaagaagggaagtggaagaaaagttttctgagctgacaagaggaaggaaagggcttctagaaggacactacaaaggcatagaagccctaagcagagtgaccaccagactccacaggttaagggctcagtcacatcggaccacccccacgtcagaccccaggtgcaaggccaagcatcacctatgcatctgaccaactggctataaattggaggtccccaaaactccctcctcaggtttgaacatttgctagaacagctcatggaacccaggaaaacagttttcttactattgctgatttattacaaacgatactttaaaggacacaaatgaacagccagatgaaaagatacacagggtgaggtctggaagggtccttgtggagttggggtgcaccactctcctggaacatggatgtgttcgccaacccggaagctctccaagtcctgtctttcaaggagttttctggaggctttatcacgtaggtatgattgagctccagctccatttcctaccccagaggatggggaatggggctgacagcacaacgcttccacccatagtgaggttttttgatgaccagtctccaaataaggagcccaccaagagtcacctcatgagaacaaaggacactcctatcacccagaaaattccaagggatttaggagctctgtgtcaggaaccagggtcaaagaccaaacgttagaacaaaagatgtgcaaccataaaaaacagcgagatcatgtcttttgcaggaacacggatggagctagaggccattatcctcagcaaactaagacaggaacagaaaaccaaatactgtatgtttttacttataagtgggaactaaatgatgagaactcataaacaacagacactgggcctgagagtggagggtgggaggagggagaggagcagaaaaaactactgggtactaggcttcgtacctgggtgatgaaataatctgtacaacaaaccgccatgacacaagtgtacctatattacgaacgtgcacatgtatcccctaacctaaaataaaagtttgtttcctaaaagaaaaaaaccactcgagaaaagaaaaatgatacattttttacaaaaagaagacaatgctcctagcacccccatcattcaggaatttccaagggttttaggagctttgtgttaggaactgtgggcagagaccaaatatatatttcttcttatgttacactaccccagataggaaaacagaaattactctagatatttcaaacaaaaggggttgtatataggcaattagtgcttatcactggaggggctagaggtggtgaaggttgtggggacggggttgcaccactggctttcaggctacacagctgatttccagaggatggaagaaggcaggaaacttgggaaaccgctgctgaggtccttgcagccccaccgtccccaggctggtgactggtgggggagtatggagtccagctgaccaccagagcctgcacgcctgctgctatggggaaggaaaggatgacttctacctcctttccacattccaaattccacgtgactacattttattggcagcaccctgctggcaagtgagccttgatgtgtgcttcctgggcttctggcacctgcacagaaaggggtgaaatgagtgtcacgagcagccaccactctgcatcacacctccacgtccaggcgtgctggagagccccacttatacttggaggtgtcctggcgccctacccacttttggtaggcgtttgggtatttgaggctttgcaaaagaaggcggcgtggagtctacggtggagtcacatggtggagacctagctaagtcagaggcctggagaggtgtcactctagctgggcagcaggtgacacaccatcatcctgagctgattggagaaagacctgggattgacctggagtttgttctggaatgttttcactggaatgaaagctgagcggtctgcaggccatatagtattggagaaaacatagccctcagtgaaaaaggctgccagagaaaaggtgtccacagggaaattcaggggttttgtttgtttgggttttttatttctttttcttttgagatggagtttcgctcttgttgcccagtctggaatgcaatggcacaatctcagctcactgcatcctctgactcctgggttcaagcaattctcctgcctcagtttccctagtagctgggattataggcatacaccaccacacccagctaatttttgcatttttagtagagatggggtttcaccatgtcggccaggctggtctcgaactcctgacctcaggtgatccacctgccccggcctcccaaagggctgggattacgggattacaggtgttagccactgcgcccagcttggtttttttttttttttttttttaatgagacagtctcactatgtcgcccaggctgcagtgcagtagtgtgatcttggctcactgcaacctctgcctcccgaatagctgggattaccggcacccaccaccacgcctggctaatttttacagttttttttataaaacagagtttcaccgtgttggccaggctgctcttgaactcctgacctcaagtgatccgcgctcaccttggcctcccaaggtgctgggattacaggcgtgagccactgaacgccgccaggcaattcagtttctgaaaatacacctgtgggtctctagccttgaacatccttggatgctgctttaaatggctgatcctcaatgcttcccttctaactcacaggcccgctcccctacatcaatctcacagaaaaagggacctcttattcatttttttgttttgcagagacaggctttgttgcccaggctggttttgaactcctggccttaagtgatcctcccgccttggtctctcagggtactgggattacaggcgggagtccccgcgcccggtgaagcctatattaaacccttttatgttcactctgcggtactgcagagagagcagggagggagcagagatgccatggggacttcagtggaggaatcaggaacctaggattgttctgaagtgccttgattatggtatatgtggaagattttagagcttgttgtaaaaagtgatgacccatggctctccaggctgggtctgggattgccttcgtggattataagaggatattatgcagcagttcttaaaaatgaggcagactgggacaatctatctccaagatgcataggtgctgttaagggaacaaagcaagatttagtggggcgtgtatagtatgctactgtgcgctgtgcattatctgtacagaactgtgaggtctgatacagtagccactagccacatatggctatttacaaataaatttagtttgggcctggtggctcatgcctgtaatcccagcactttgggaggcaaaggtgggaagatagcttgaggccaatagttcgagaccagcctgtgcaacatagtgaaacctgttttctacaaaaattttatttatttttaatttatttattttttgacacgggtctcactgtcacccaggctggagtacagtggcacagtctcagcttcttacaacctctgcctcctgggctcaagcgattctcatgcctcagcctccctagtagctgggactacaggtgtgcaccaccatacccagctaatttttgtatttttggtagagacagggtttcaccacgttggccaggctggtcttgaactcctgacctcaggtgatctgcccgcctcagcctcccaaagtgctgagattacaggtgtgagccaccgcacttggccaaaaaatttaaaaatgtaaaaatcagccaaacatggtggcatgcatctgtagtcccagcaacttaggaggctgaggtgggaggatttcttgaacccaggaggtcaaggttgtagtgagccatgactgcaccactacactccagcctggacaacagagtgaggccctgtctcaaaaaataaataaataggagtttgaggccatgttcacacctctgcactccagcctggtaaacagagcaagacctgtgtcttaaaaaaaaaaaaaaaactttttttaaagttagctcctaagacacactagccacatatcaagtgctcaactgccccatgtggctaatggctaccaaactgggcagcacgggtgactgttttcatcattgaagttctgttggacaaaactggcacagaatacttctggaagcacacacgagaaactggtaatggtggttgccttcggggagggaaattgggagggtgcagggctgtatgtccttttgtacctcttgaatttcatatcatgtgtttgtattaggtgttcacaaattattttaaaaacaaactggaaattaggaatccccatatggaatcactgcagtgggacagtggttcccaaaaaattactttgcaatttgcctaaaacaaattaagctaatagctaccatgatttcatatttaatattttttcacagcttagagctacttaggtcctgttgctatctctctgctcttatgagctcagagggtgacaaagcaaattagtaagtagcaggagaacattaaaggaaaaactcctgggcaacagggcaaaacgccggctctacagaaaatacaaaacattagccaggcatagtggcatgcacctgtggtcttagcgacttgggaggctgaggtgggaggatcgcttgaggcggtaactcaatcccagaggaatcccagggagcgaaggtggctcatcccaaaagaaaaacaagaaggaaattctattaccagaagacaaggggatgaaatgagggatgcagaaccaaagactgaagctactggtgttcatttttatttattaatatttaattttttcagagacaagggtctcatgatgttgcccaggctggtcttgaactcctggcctcaagctatcctcctgcctgagccttccgaagttgttgagattacagatgtgagccactgcacccaactctggtttttgttagtttggctggatttggttttggtttttgacagaattttgctgtgccacccaggctggagtgcagtggctcagcctcggctcactgcagccttgacctcctggcctcaagtgatcctcccgcctcagcgccacccaccctccaaacgccctccaacagctgggactataagcgcgcgtgaccgcgcacggctaatttttgaactttttgaggagatgggggtttcatcatgttgcccaggctggtctccaactcctggactaagcaatcttcctgccttggcctcccaaagtgtgagccactgcgcccacccatttaagattgaagatagactgggcaaacccttaagcctaaaccagtaacagtttttcacaagttcatagatgttactgtggtaaataacacacaaattcatttaaaagcacgtgtgtcctcatggtaatttttgggccttttgttgttgttgtttttcaattaatggatattaaagatacaactttttttttttttttttttgagagggggtctcactctgtcgcccagactggattgcagtggcatgatcacggctcactgcaacctctgcctcccaggttcaagcgattctcctgcctcagcctcccgagtagctggaattacaggtgtgtgcaaccacacctggctaatattttaattttttgtagagacgggttttcaccatgttgcccaggctggaaataaaggccccaacccaggaagcagttaagcaaagttccaggatgactgcgtgtgacaggcttagggggtaacttgaccacatggaggacagaactcggagagggcactgtgggcatgggccccacccgctcttccagagcactggcagagaacgagggcatgataatggccgatggcactgaaagaaaaggaaagatcatgaggcactctttgggaagcagctgttatatgtaaaatgtttatttagaaagagaatgcttgtcccctggtactgcaaagaaatagcacttgaaggccaggtgtggtggctcatgcctacaatcccagcactttcggaggccaaggtgggtggatcacgatgtcaggagattgagaccatcctggccaatatggtgaaaccccatctctactaaaaatacaaaagttagccaagcgtggtggcgtgtgcctgtagtcccagctactcaggaggctgaggcaggagaattgcttgaacccagaaggcagaggttacagtgaggcgataccatgccattgcacttcagtctggttgacagagcgagactccatctccaaaaaaagaaaaagaaagaaagaaagaaatagcactagaatataaatttaattttcttagtaaggccatttttactttctgcagaaagggtgctcatcatagatggaacaatggcgagagcatatctaaataaaggagggatgcaatttttattctttacgtagtttgtccttgtaattgtattgtgtctccgttggctggagccagatcttaaaatttaaactaaaacttgattgggtaacagtttaaaactttttaaaacaggtaaaagtaatggaaagacaagggaaaagaggaagtagtttacaaaaggacttagaaaagtaataacattccgaaataaaaaaggggcataggctgtgagctgggacatgcctgcgagcacgtccagtacagatattttggttaaagtatacggacatagaatgtactacatgcctgtgaccatgtttaacagctacataggatagggcctaacaaaacagttattagcataaaacaagggggcttgaagaaagtttttaaaagaaattattatttttaacacttacgatttttcaataagggaaactctgaagagtaacttttactttttataatttctctcttttacataatttttaaacttatttaatatgttttggtttagctgctttgtttgatcttttagaaggaatagtttttctcaatagggtggaggaggggctggggatattttaataagagttgtgtttatcagtttctgtttaagttcccggccattggcagaactacttcttgaatgaatttgaaatagggttgttaatgctggaattttttgctaacttatttgataaggtagtaagttcctggagggcttttgttatgctcccagtgggagcagtgttgtttgggataaaggtgtaacactgagttttgattataatgaaaataccacctttctttgctaatattatatttgaagctatcttattcttctaggctatttgattagtggcttttgtttagctatttttttaatagcatttttggtatagttaacaagtcgttgctggttgtaataaatgtagtttaacctatacttttattaattattacccactaaaacactgacttgcaactatttgatttttggctttaaatgtatttggtatttcacgaggaattttagttgcatttaaatagacatgggaattaaaagatccataagggtctgctgcttcttttgtggcttcttctatctgtttatttattttttgattgatgaaatattagggtaaaagggatagccaactgaattagagcataagtattgttctaattatttggcacagcgttcagtaaaggccctccataataccattatatatttgcttggggatgaataagggcggactgatgggtcagctcttggaagtgcctgacctcactgcattttgttaaatcttcaaggaatgctaagttctccccttgtggtgagagacacgaggcaaacttcgccttggaagatgggaggctggatggctcttgggagcagacccgcagggtactactgcacttcaggaaatagcagagagagtttggtacagtttactatcctaggctgtaggattttgaaaaggagataccatgtcgtctatgtcttgttgattagaagactatttgagtggaaagtggataacctggacctctggttcaccgtgcgcacaagtgtaacagttgtttttgtttaaagagtgaacggaatatttcatttattttagccaggcatttatattttgatgtcttgttgtttgccttaggttttttacttttactatagagactttggttttgttatttggtaagagaggagtgataactaaacaggcattaaaagtaataatttgaggtgagttagatttagttacattaataagatgggaagtagttgaaggagagaaaagatagataaagtttttttagttttaatttggtagggcttgaccctggagcaatggcctatgacttttatggtgatgacattttctcgacttgggtacgacgtgttaatttatttttttgctgtgcgaatggcagtcttggtggtcagcagcttaaggtaggtttcttcctaggctggcttgcatttttcttttttttacatctttcgataaggacgtggttttcaagctggtgctggtgtactggaaatgttaggggtggtacctgtgctaaaaggcttttagttttgagggaagggaaagtggaaaataagtatataatttttgagaaactgattttttgttttaaatgtggggacattagcagtagaatgtaagtaaggcaaactataggtattttttggtctataagtccttagtgccttcttaagtttttttttttttaactttttcttatgttgcttttgaaggaaactttggggttttttcttagaactttgtacatcttggggcttgaggccccatagtgacacctccaactccttccccgctgagcgctgcctaggggacgcggcggcctggctccccttaaggtcttggcctccctgtggcctttattgctcccttgcgttgtggccttagggatgagtggccctgtgacttacctggcagccctcggaccttgctcctgcccaagcccctgccgttgggccccggtgttgggttcggttgtgctgtctaacggctgcctggccccctcccccctcccctgtacaggaagtgtctgttggcggctaggtcccccaccagatggctcatgctgtggccactctaggagcagctggaggtggaaactcgttggtattaaccctgtgctggagggcccttaatgggttttttgatgcaattggaacaagatttatttattttttatacggggcttagataacatttctctttggtttagcaatatttattttcatttggaaaatttttagcacctatttttattagtttttagaataaagaaagtcaaacatcattttatgtttgataatgtttcctgtatgattttataagagataagttaaattttacctttatattagtgtactattaatgttaaactacattttaataaaaccttgtagatattatttaattttaacgtttgactataaggtaagatttttatagattctttttaaccctttataatttttgttaaagagcaggttagtgctttaagaaaaacctattgtgcttttatttttatgttcagttcatagaaaaactggatgatacccctttaactttagccgatatgtttatacacagaattttttttataattaacattttaaaacttgcttaaacttttaaaacaaatttttttgaccttttaatgtaggtaagaattcaaatttttatgcctctttataatccttttattaaaagtgtattttattttccttatacaccttgcacataaacttaatagttttacatttaggaggccaaattagttttaaattatataatatgttttgcataaattctttttatagcattttttatgacttttacagataatttttgacatgccttaacattttgccttccttttatactatttatttttttagtattatccttttttcaaaatttctgttttttccaatctttcttattttttccatttctctatttgcgttcttttttttttttctttctgtcatttcctggtttcttcctcattcccgagttctcctgctcctgcagctggcaggccgggcaacggcatgggtactgcccctgcgcacgcactgccgtccatctcttttgtttttttctgattttcctttttagtttttcccttctctcctcacacttacttttttgggctgggtgggatttgcgcagccgtagtccagccccaggaagttggtgccctgttgagctcaccgctttcttctggataactccgatctcagccttattccaagtcttaacagtgtcttctcatccttagtctcctagccactgtataccttcttttccgtctcctgccgtcctgaggacaccccatccctaagtctttgctaaactgtcctgaactcttactgcctcctttcctaccaccctcacccaatcttgttaaaaaatgacatctccgtgtcctttcacccccgctgacaccaccgcatgtctttaccccaactctgcgtccattgcttccctcgaccccactcccattcaacctgagaacttagtgcagagtctccttccaccagctgcccctcaacagccaaatgtaggtgctcactcagacccacagttagagactgagcagcatgattggtgggtgcaggggctcaggtggtaaataagggtggaggagcagtgggctctccccaactcttgggtcagccggggtttttcctggcatctggtctcctgcacctgtcctcagggattgtgtttctggcattcatattaaatgacttgtgctggctgctggaatggtaggtatcattcaaatatctggaaggtgagagatggccactcactcagctcacttagcacagaatgatggaagctgccccttccttctggttggtgttcttgccctggagagcctctgggaagttctgtgtggtgttggctgtggtcacagaatattgttcatgtttcttttcctggcatttgtaagggcctctccctgccagagctgatggcagatcaatcctgatgccaaattcaggggatgtgatgggtgccagaggcaatgttacctgttgtgaagagtataggtgagtaggtcctggggaggctgaggcctaggtgggtacagaggctcttgaatggctttcttttcttataagtgctggatcattgacttttggccatctgggttccatgaacacagggaaccatgttatctcagagtagctgaggcagaaggacattccagaggcacccaagtcccatgctagcatttagtttcctgggggctttttggtacacatgttctctgaatcctgaggacctggcatcagatgggtgggccatttgaccacagttttaaagggccccaaagaaccttgtctctgcttgccatttatagtcttattccgttgaaaaaatgaatgctgtttaccttcaatgtcctcccattagtatatttaagttggtttcagccttattggcagcttgacttaatggaaggagctccacagtcatcttaacacttcagagttatataccccaacttcccacagtgtgtgaaatggagatacctgccccgtgcctcatttttattttattaatcaattcattcaacagcttattttttgagcaccagtgtgtgccaaacactggtgaatgggtcaggcaatggtcctgttttcattcagagtttggtccttgttagaatcctctgggatatgggacaagaatatagagaagattctgccctcatccactagccctgagtctgggaatcacaagctagaagtttctcacccttcatctggtatttaattacttcaaagctccaacccccaccaccccacccatcacagaaatccaactttcctcaggtggacagaggtgcggtttcctcagtcagcactcacatgcctgaaagatcagctgcctttctgaatcagagggtaactttgtcattcttttccaattgaaaaaacgtgactcatcaattggtacagcagttggatggcttaaagccaggctgtggctctgaacagccaggtacacaattcaggcagtggagagaaggccgtagggagtggctgagaagtccctcaagagaagaggttgctgttcactgatggtagagtgttttgagagtggtgaaaccaggttatccctttcttcttttaacgtaagtctcatccaagtcactctctttttttgcttccttgatctctggaggaagtgaaattggacatatagagaaggccaggcagtataatgcaggaaaccaactggaactgttccttcctaactatgttggaacatttaagaaagtatagctctgagacttcaggagcattggtaggacctggtctcagctggttggggctataaatctgattggcagaactgtttcatgttggtttctgaccttctgtgatgaaatggagcttccgagtacctctgaggaggaagtaatagtttgcctgaaattctttgagccaaagacctgaggccatttggtccaggggaagatgcgggagttgggatgaagaaaccatatgtttctttgacatattttggaatggccctgcaaagccatctcttgtgggggaaatttatatcctgcagactcccttccctttctaggccttttcctgatctaggagagatttaactaagagtctgacactttttagggtctgataagagaccatctgtcatctcccatgtgatgatagaccagtcaggttggagttggtatcttaattgctgagagtctgttctgtcagtcttaggattctgttttaatgttaatgctggtcagttgtgtctaagctccaaaagggagaggctaggatgaggcatggcccacgccccacttcctgtcatggcctacgccccacttcctgtcatggcctgaactcagtttttaggttttttcaaaatccctttggccaagagggggttcattcaggcagttgggaagcttagaattttatttttggtttacagcactcactcaggaattgggtttttctagggctggggttggcttcctcctgggggctggtggtggagtcaggccacttattagccctgggacctcaggaacttccttgacctgggtcagctgccatttccttatctgtcaggtggagacaataaaacagcactcctagggtccttaggaggaacataaattaggcaatatatgtaaagagaactgagcccatttaacttttcttggttttgttaacttctttttttttttttttttttttttgagacggagtctctctgtcccccaggctggagtgtagtggcacgatcttggctcactgcaacctccacctcccagtttcaagcgattctcctgcctcagcctcctgagtagctgggactacagggtgcgccaccatgtcggctaatttttgtatttttagtagagacggggtttcaccatgttggtcaggctggtcttgaactcctggtctcgtgatctgcccacctcagcctcccaaagtgctcacaggtgtgagccactgcgcccggccggttttgttaacttctttatgcggtgattgtttgagagctgagagacagccatcacctttcccggcgttcccctgatgctcagccaggcatttgggacagatttgtttacgtgtgaatgtgcctccctagcccaggtctgtccaagttgctggggtggggccaagccagccagcagtcccctcaggcacaggccaaagtccccaccccaccccaccacagcccacccattcccaggaggaagctggcagccctgagggatttaaccactcactgatttcaactcttcctgcatacccatttaggcgatgacattcttggtctgtacacttaggtggccacatccactgggatgacagataccaggtacaacatatcaggtacaggtacatatcaggcctcgtgacaggcattttacacattctccatctgagaggtctgagcatgcctacctggttagtggcaaactgcgatgagacctcatggtcatcccggttagacacgtccctgtctgtgctgctcaagccagaccctcgaagcctaaaggagaagcagaagtgtttccctttcaaagtcattccagtcgtactttttaactactgaggtgacagatgttggactgggacaggaatgaggggtggggggagggtgctgcaggactcagcccctgaatgtgacttgtgaacccctgcttcctggtcccagtgggttcctgccaccttcagctgcagcctccacctcgaacccacagctctgtatttgaatcagcctgtcattccctgcttacgggtttagatcctacagggccctggctttctgggcagcatttgatgtgaagcgcccttaccacctactccttggggtggacccacccctggcacccaggactccttgcctcccaaggactgagccccctgggctttccttccttgcttccttctttcaaatccactctcaatttttactttcgtgttcctcaaaggcctttcggttgtggtttaaggggggctgacctcctactgcttgctgggaatggactctggctggggggaagttgcctgcccattcatctggctgccatctgtctcttcagatgtcatgtgattctctgagggagcagctgcgtgagtggagatgctctcagtggtggaaaatggactggacccccgggctgccatcccggtaggtgggtgagggaggagcaagtaataaaataaataaaacatattctaccataaggagcttatgttcatctggccttggacagacaagtagacaaagtattatgacagtgctataacagaagttgagagaaggtgatgtcagagcagaaaagagcctaactgaagagactgatgaaagtgaggctttacagaggaggtctacataattacttaacattccccaaaatatatttaatgtattttgagctatacttattcattaactatacacttaatgactttgcccttttctgtatacaatgtttcatatgccacaataacatttatttcggataaagtttactcatgtttaataaccatgaaaagaaaggttagcattagctgagaaaacttcataatgttctactccacacctgtcatggctaccccaacatgggcttccctaacattccaggtttaaactgggtcagtgttgaatagctgtggcattagcctggtgccaataaacttagggctgctgtactatgaaatagcaaccggtagaagccgaagaaaaagatcaagagtctccttttccttcgccatgtcccgagtcagagccaggatcatgcttaggctgcacaggcctagaaaactccaagggtgaagcaagcttctgctttacacaaggaccaaaggaactggaatgggtcacagttacatgcaaccttaatacctcctaagtgattcctctgtggatgaaccctctcttaactgtatttgcaatacagctaacaggcaatttcacatacttccttacatcactctatcaggtcaatcttccctatgcacctcaaaataaaccagtgaccccactgcagaccagttccacaagaattactctgggcttcctgaacaagatagctgtctacaatgctttaaaaaccctattaagatgagaacctcaacacctttaaaaaaattttggagagaaaggtgtcctaagcttctgcagttcccattcagctccttccgtattcaaaagtttcaatgctcttccacctcccatcctcaataacatttccatcctcaactacagctgtgtaatctcagaaagtagtcaggagaagggatttttaaaaacaacctaagggtcaagccagtgcttctgggaggccaaggcaaggaggatcacttgaggccaggagtttgagaccagcctgggcaacataatgagaccacatctttacaaaaaaaacctttaaaaattagccaggcataatggcactcgcctgtggtcccagctgcttgtacttgcaaggctaaggtaggaggatagcttgagcccaggagtttcaggttacaaggaactatgatctggccattgcacctcagcctgggcaacagagcaagaccctgtctcttacaacctgcttagtccctattctttccccttatttagcaggtgtgaaatttcaataaacaaaattttcaataaataaatatgtttcagtgaaatgatgaaaaggacacaacagcaaagtatgttagaaaaaaaatgctttggaatcagataaaaggtcctgagtttaaatttagttctgccttttacaagcctctgaagatttactctgaacattaaacaaacatacataagtaaacctttaattagtatacactcaaggtacatacattgttttcctttctccttctaaagcatggaagagattttttttttaaataagctgacaaaatatgaaaattaaaagaacacaaccgcatgcagaagtagcacagaggacttcctagaaattgtattctttctccagggagcaacaagaatcgttattcccaaaagggactctattcacttcacagcttggaaggtaatacctacctctgacagaacagaaactggcgtctggatcctagaatcacctagcagtagtcacaaatacctttttttttttttttttggtaatacgccacttaaagaaaattaatgttaacatgcaacaaagtaaatccttaaaaagaaaaagaaaagccccaccatccctgcaatctcccacccaaagacaaattataactcaacagcctatcaccaagattcagcccatcatctagattcatctaaaaaaaaaaaggcctgtacaacccaggaagcactggcaaatcttggtgcagcagggaaaacatgaacaccaacccacttaaccaaaacacataagaaaaaatttcttccatttcagtaactaaaaaacaaaacaaaaaaacaacaagcacttaaagtgattactaacttgagcaatagctctgcaccctgatactcaaatctcagctctgcactcacttggatgtataaccgtgaacaaactacttgactgctctgatcttccattgtttatcttgaaaatcgtgaatgagagtaaaatgcttagcacagtgcctggcatatcacaagtgctcaaaaacttctattaattatagtgttacataaagactaaatgcatgtgactatatcattggggggaaattccatggcttgttagagcgagttgaatattctcttccaaatttatgttcgctcagaacctgtgaatatgaccttgtttggaaacagggtctttgcaattgtaataaagttatgatgagccttttagtgtgggccctaaattcaatatgactgatgttcttctaacatggaaatctggacacagatgcaaagagaaagatggtcatatgaagatggaggcagcaactggagtgatgtagctacaagccaaggaacaccaaggactggcacaacaccagaagctggaaaaagacaaggaaggattcttccctagagcctccagagagagcatggccctgttaacaccattatttcagacttctggcctccagaatggtgggagaacacatttctgattttttaagccatcttctttaagtaaaagattatctatgatgttgtattttacagaccaagaaactgaagctcagaaatgttgagtgacttttcttgtcaaggttcatgttaaatagctgtgacatgtaagcatctggtagtaaagccatgactagaagcaaaactttaccaagtccaagtatggtgcttaatacaattcgctttgaatgatgaaactcttggacaatcagcatacattcatgtgccaaataacattatggtcaatgacagaccacataaacaatgatggtcttataagattgtaatacagctgaagaattcctatcttagcacaaagcactactcatgtgtttgtggtgatgctggtgtaaagaaacctacagtgctcctattcatatagaagtataccacatacaattatgtccagtaagaatataatagttgataataagaactatgttactttttttttttttttttgagacggagtctcactctgttgcccaggctggagtgcagtggcgcaatctcggctcactgcaagctccacctcctgggttcacaccattctcctgcctcagcctcccgagtagctgggactacaggtgcctgccaccacacccagctaatatttatatttttagtagagacggggtttcacagtgttagccaggatggtctcgatctcctgacctcatgatccgcccgcctcggcctcccaaaatgctgggattacaggcgtgagccattgtgcctggccaagaactgttaactgttaaaaaaaaaaaaacttattttttatgataagaagaagtgttatgtatttactgtactgtacttttaatcgttattttagagtgtacttctactcaattaaaaaacagttaactgtcgggccgggcgtggtggctcacgcctgtaatcccagcactttcggaggcctaggcgggtggatcacgaggtcaggagattgagaccatcctggctaacatggtgaaaccctctctctactaaaaaaatacaaaaacaattagctgggtgtggtggtgggcacctgtagtcccagctactcaggaggctgaggcaggagaatggcgtgaacccgggaggcggagcttgtagtgagccaagatcatgccactgcactccagcctgggcaacacagtgagactccatctcaaacaaaacaaaacaaaaaaaacccagtgaactgtgaaacagcctccaacaggtccttctgttggcactgtcacaggcgatgaaagctccgtgtgtgttgttgcccctgaagacctaagagtggaacaagatgtgaaggtggaggacagtaattccgacaaatctgacactgtgtgggcctacgttcatgtgtgtgtttgtgtcttagtttttagcaaaacagtttaggtagaaaaaagcttgtaggataaggtgtgaagaaaatatttttgtacaattacaatgtggttgtgttttaggctaagtgttattacaaaagagtcaaaaagttttaaaattttaaaagttaataaagcaaaaagttacagtaagctaaggctaatttattattgaaaaaatctttaaaataaatgtagtgtagcctcggtgttcagtgtttatgaagtttatagtagtgtacagtcatgtcctaggcctttcacattcagccacccttcacccgctgactcacccagagcaacttccagtcctgcaagctccattcatggtaagtgccctatacaggtgtaccatttttatcttttctactatatttttactgtattttttctatgtttagatatgtttaaatacataaatctttaccactagttgcctataccattcagtatagtagcatgatgtacttgtttatagcctaggagcaataggctataccatgttctctaagtgtatagtaggccataccacctcagcttatatgtatgtaaatatgtatgtatttgagacagtctcgctctgcccttgcccaggctggagtacagtgtcacgatcttggctgactgcagcctccatctcccgggttcaagtgattctcctgtctcagcctaccaagtaggtggggttataggcactcgccaccacacctggctaatttttttttgtatttttagtagagatggggtttcaccatgttggccaggctagtctcgaactcctggcctcaggtgattcacccaccttgccctcccatgcctcggcctcccaaagtgctgagattataggcgtgtgccaccacgcccaaccctcagcttgtatttaagtacactctatgacattcacacaccaatgaaatcacctaacaacacatttatcggtttccctttcgttaagcaatgtgtgacggtatacacaaaactccagattattttccagatatttagaaatacttttcagatattttgaaagtttctgaaaactgctctgtcattacttctgagtgatgagctgaagaataaagcatgaaccaaatgaggtatcttcttatacacagctagtgagactataaactgacacgaccaaaatacttctctaaagtatgcattaagaacataaaagagcattcatacctttgactaagataaagatgtttatcatggcatacttaattttaataataaacgtaacttaaatagtcaacgaggaaagccaatagcaggcagccattaaaaatgttttccaaaaaccaactgggaaatattcagggcacatatataacatgactgtgtttaaacaaattattcatgtgctaggaaaatgtaccataatgtgggtagcgagataattttgagctgttggttttgttttgttttgttttgggggggcggggggagggtgtgtcttttatacttctgtgtaatttcaaagtttcctgagaattgatacacagtatttcttcagttctaagaggtactttccccacgtcaacaacttttaaaacaagatgcatcttacaattgctgttatgccctagtttaatggaaataatttctttgttgtacttaaaataatggtacatcttacaatcaatagcatcttaagttctatgaagtgtggcagttttataacaggcaactaaaataacataacatatacacatatataaacttacatatatatatttatgaatgtatataaaaagatgaagcaacacttatgactactattgtactaatctcagttgttactaagagactctagttctcaaatatagaaattcccacttaactactggctataaaaacctagaaacagacaccgaagaggtgtctctgatagagaaagactgtgtttttctcctcagtacaggcatatccagtcacctcctagttattcttagtcaccaatccagttcaagttctacaaatctcactttaaaatttcctttgtgaagagttgagaaagcaaaatattgaccaaatctagaatgtttattagttttgttctagctaatttttaaataagtaaatcaggatttagctaatttttaaataagtaaatcaggatttaatttttacactaccctaagggaataaattaataataaaaactgtgtcctcaattaaagtagctctatcaaatgtttggaaaatatatatatatatatatatatatatatatatatatatatatatatatatatatatatgtatctccaatctggaaagaaggtagaagtctccagtgaaatttttggaataaaagtttaaatgattagacagcccacagaactttcacttcaaaccctgatcattctgttcattttatcagttgatcaaccgttaacttttggcctactaatttaacggatactgttcacaggaaagccattttcttaaggctttgactagtactaaggtcaaaaaggcattttgacccttatttttagtagccacagactttttctagacatgggtctagataaagatagagctcagccataccaagctaatataaaaaatactttgcaagaatgtaagcttcatgaaggtaggatttttgttcactattgtgaccctactatggagaacgctgctgagacatagtaggcacttttccataaatctaacaaatatgacagttacatcaatggcttgcttgcattatacagcatttttcttgtttcctgttaactcagatacccacactgttttgttctaaatacacgttcaattaaccattatattctaatagtgttttccttttaatgagacaaggtcttagttgcccaggctggagtgtggtggcacaatcttggctcactgcaacctccacttcatgggctcaagtgatcctcccacttcagcctcctcagtagctgggactacaggcacgtgccatcatgctcagctaatttttgtattttttgtaaacacaaggtctcactatgttgcccaggctggtctcgaactcctgagctcaaatgatcctcctgccttggcctcccaaagtgctgggattaccagagtgagccaccacgtgtgatcccatcaggttcttaaacaaattaaaccactatatcaggtcattaaaccacttgtcttgaaatagttaaaaagggggttatggggaggggattaccaaagaggtgggaggggatgggagaaaagcaataatgatagttttcagctgtactaaaaaacaccagacacctatcccttattagcacatatctgtttgtaaatgtctgtttgctgacgaatttgatattccaagtcagaaacatgagcctgaagccagttccagcagctgacaatagctgcccggtctgcagcccatctccattctgacctgtgtctcctaaaaagaaataaattgagtgaagtccaagagtagtagtaatatctataccagacttgggggtggagggtggaatttaacttctaaaggcccttgcagagactaactctagtgtcaagaaaaacccaaaacagacagagacagataccccccactcctcaggatgcacatggatataaactttcaaataggtatttcccaaattaagtggaactgccttctaccatcctgatcctgcggcacacggtttctctgaaattgcattaatttctctagagataaaaatattgtccatgttaaaataaaacatatattaagaataatctatacaggaaatccaactgacaataagaactattaaaactaataaagaatttagcaaaagtgttcagtaaagaatatttgaaaactaataaaaaagtagaaaatattcattttttaagtatcattcataacaacgacaaaactaatgatatatttaaaatctttatagagaaaacagtaatgcctgaaagcatgaagctctatacaaatggtaggatacattttttaaggatggtgattctcatgaacatctataaattcaaagaaattccagtcaaattgcctacagtatttttaatgaaagctgagaaacagatccaaaagttcacatgacataaaggaccaacagcaagaaatttggaagaaggcatgatgcaaatacacattaccagatagccagatttgctgcaaaactgtagagagcctcaaaacgtagaactagatacataaaagataccgggaaattttcttttaatcagatcagtggggaaaaaatgaaactattcaatagtactaaactggccagttctttagaaggaaaaagtaaaattagttcccttcttcatgatataattacaaaattttggcacttcaaattgctaaacatgaacagccaaacttaaaagaacatcttcgggacttagagcaggaagtatttcttagataagacacaaaaatatcacctacttttcaacatgcaatagaaaatctaataaaattaaaaggcaaactgtactttggtggaagatatctaatacatataactgaagattaaacatcagaatatgtaacagaactctcagaaatagattaagagaggccgggcatagtggctcacaacctgtaatcccagcactttgggaggcggaggcaggcagatcacctgaggttgggagttcgaaaccaacatgaacaacatggagaaatcccgtctctactaaaaatgcaaaattagtcggtcgtggtggagcatgcctgtaatcccagctacacaggaggctgaggcaggagaatcacttgaacccaggaagtggaggttgtggtgagccaacatcatgccattgcactccagcctgggcaagaagagcaaaactctgtctcaaaaaaaaaagaaacaggtcaaaagaaaaaatgacaatcttaatagaaatagaaaattcacataaaaggcaaataattaataaatatatagaaatgtgtcatctcattaaaatttagttaaaatgtaaatattaggtaaaacattaagatgctgtttcaaatctggatgggaaaacacgtagtccgataaagccaacaggtggtgagaaatggataagtacaattcatacattgctggtaacagttaaaactggcaacaccatttttgaacaataatttggaagtacttggctaggcgtaaaatgtgcatacccaatcatcatgatattctatttcatttttcttttgtttgtttctccttttctgagaggcagggtctcacactctatcattgaggctggattatggtggtgcaatcatagctcactgtaacctagcgttcctttgcttaagctatcctcccacctcagtctcccaagcagctaggatcaggagcatactactgtacctggctaatttttttttttttttttttttgagaccgagtttcgctcttcttgcccaggctggagtgcaatggcacaatctcggctctttgcaacctccgtctcctgggttcaagcaattctcctgcctcagcctcctgagtagctgggattacaggcatgcaccaccacacgcggctaattttgtatttttagtagagacggggtttctccatgttggtcaggctggtctcaaactcctgacctcaggtgatccgcccacctcagcctcccaaagtgcaggcatgagccactgcacccggccctggttaatttttaataaaaaattttgtagagatggggtcttgctgcggtgtccaggttgccctcaaactcctgacctttggcctcccaaagacatgagccactatgcccagccatgaaattctgtttctgagaacataaactatacattcctctgaatgaggaaacaggttcactggagtagagtctctaacagctaaaaactaattatattataattctgttgaagttggtaaatagactatattcatttaacagatctttctatagtaataaaaataaaattaactatatgtatcaacatgactcaatctcagaacatattgttgaatgaaacaataaaaaaatactaaacaagattaagtacacacaagtagtaaaggaatttgacgaaatactatctagcaatttaattactgtatgtatcaacatgacctaatctcagaaatgaggaatgcaaaagctgaatgaaaacaaaaataataaacagataaacattaataagcattgttaccaatacagataagggatgaatatattttaaaatgcacagagctgatatacaacaaatttacaatcaagctcctcattagctctggaaaggggatggagaggttggattttagctctacttataatgtaatgtttgacttctcatgtaaaaacaaaagatagaaatgtgacaacattaacattctttaaatattaagactggggttacatggtgtctactgtattccgtaatcaaaatacttcataatccaccacaaaactgttttcccagaaagcagcagcagtcacacagccctcagccccacttcccatcaggatacacacactcactactaaaacttgtgactataggtgaacttgaacacagtctcccataggggcaaaatacaaaatgtcaaaaataaaaaagaacaaatctgaccgcaacagggtaagacgtaaattaaaacttaatcataccataataattaagaccaaggatagcaatggtattttaacttttgtatggaccaaacataaaccattcaaatcaaccactgtgataaagtattatcaattatgtctcttcttttagaaagaagacattttacagttccctaattttggtggaacctcttcaagataaaaagatacttttaaagtacagttatctgcttcaatgttggctgcaggtctagctctaccctaaatccaggaaatgatctcaagagatcaataagaacctagggatcattcttgaacaagaaaaatgccccctacccacaaagagacaaaactagttaaccctcatattttattcccacctttccttactcttcaaggcttaccacctttctatcctgcaaaatcttttggatttatagattcctttcattcctaaaactaccaccacaccaggtccccatctatcaccactggacaaccccaacagcctccttagctgctcttcccaacaccagtcaatcatactacttttcctcaatcaactcccctcaaactgttttcatcctggtattctaatgtttaaggaaccacacacttcctttgtttgaaaataaaaaaggaaaataaaattacttaaaacattttagttcacaagaactttgataaatacattttttcttggatattaatgaaagtcttacatcccctacacaggtatttccctaaataacaatacaaagtgagcctcctgataatatgttttggataatatggttaataaataactaaagaaaggcaaggcagcactaaggaatactaacaattcccaatttatgaacaagtttcattttaccagtgtatctgtgatatgatggtttagaactggaagtgatttctaggagaaagttgttacagtattgttcttccataatgctggctcaaactctgatcatctccaatgaaaaatggaaaacctcaactcaagtgtccaaaaagtatcttgtgttcaaaatgccagcaatatgagcagaaaactaagctgttattaaacgtgagaggtgtacagttaacaagtttggagtaagttagctttcatactccagtggcagagcagagcatcacaaaataatatcacaagaataaaagcttcacattcttgtgttccttaaaaacaagccatacaaactcagcttatcagaggtaaagataagacttcctccttaacattcaaaaggtaaatttattactctgacaatttacagctcaacaagggacattgattgaacattagggacatgtttaatgttatactatacagacttcaggaaagaacacaggactaaggttgtagaatgatactttaaatacaatgaggacttggtttctaatacagtcattatcaataatgaagaaaatcatgtggattctgacattgatgagtcaactcattcctgttgcttgtttctgtgctattagtaaaataactgttttaattatgtgtctgggtaggacactagaatgccttagaacatttgattttactgtgtgctttatcccagtccatacaaaagtatgcgctgtatgtactgtaatgatcacctgagtgggaattcttttcaactcatattttgctccttgactcgcaagtactcactacctagctcaaaagcagtgtgaaacaaatagaggaaagatcaggagacaagttctcacttttacttactttatatgatcctaaacatataaattgatctctggaaataagaacaacatctacttcacaaagttgtgatagccatacaatgatgtaatcctaactgcaacctaaaatgtgtgtattagataagaataacaatttatttagtcattataaccatggattaaattccataccaaaaaggtacaaaaaaggaagaaaaacaggataagattaaagaaaaacctctcagataaattcaggaaacaagtgttttcagttagcaacaagccatattctgagagtttcttgagctttgaactttacagtcatttaaaagttccactctaaacagaaaaatcaaggtagtctagtagaatagacattgcattattagtgacattacccccaaatttgaaacgatggaggtaataaagcacaaagaggaaaaaagaagagaaccaaactgtccagagttaaatatcccacattttagttgtaaagtaaaacgcaggaagaaacttggatacacacttcgtcttaacccattctcatctgtcacatgacctaggttgtgtcagcttcctatagatacctgtagtaatgtggaacaaatgtaccagagcccattctttttttttttttttttttttttttgagatggagtctcgctctgtcactcaggctggatgcagtggcagcatctcggctcactgcaacctccacctctcgggttcaagcgattctcctgcctcagcctcctgagtagctggaattacaggtctgtcacaacacctggccaatttttgtatttttagtagagatggggttttgccacgttggccaggctggtctcgaactcctgacctcaagtgatctgcccacctcagcctcttaaagtgcttgagttacaggtgtgagccaccgtgcccagccctagaaccaattatatctagactgccagttcatcctgacagacccttgaaattgaacacagcacttttatcttactggttagaccaggttacctctaatacagaaatgaaatttgtgtatttttggtagtttatttcagccaagcatttagcccaccatgaactcactctatcctccttccttccatttaacaagtatttaaacaactattagttaccaagagttagatgagggatacaaaaagatacaaaaagaactgtggctcaagttcacaatttaatgtggaagatagatgttaataatcaaataatcatataaaatgtaagataagagatcctaactatgtcagatttagactgggggatctagaaagacttgtgatacaaacatttaaacagacctctgaagcataaattaggacttggatgcgcaaactggtaggggttggggatgtggagcagaagatactaggtggaactgtggtgtgtcacaaagaagaaacgacatgtatacaatggttatgttgttagagctccaacagtgaacaatgaaaagaattcattcaacttgacaatggatacaggtaggcagggccaggtcacacagaacctggcaatccatgttaatcttataaaacaatataagcaatcctcatcttccctcacgctcttttatttatctcagaccctgtttgaaggaaaatttacaaatacaagctaaaaggtaataaactcccacataaccaacaactaatttcaactatcaacttttggtgaatcccaccctcatctataacatctatctcctacccctatgaattatttttaagccaattcccaacatcacatcattacctctaaatatttcagtatgtgtttctaaaatgtaaggtctttaaaaataggtacagatatatttcataatttaaaaaataataattccttaatgtaaaatatccagttactggttaaatttcctggactgtctcagttgttttctccaaatcagaatcaaataatatccacacaattcatttggttaatacatctcaagcttgtaacacgcacctcctcttcctccttttccttcctcacaatttgtggaagagacagcgctatctgtcctctagaatatcctacattgtggattttgctgactgtacctttaacacaaagcccatacttttgaacttgataaattgacacttctaggctgggcgtggtggctcatgcctgtaatctcagcactttgggaggctgaggcaggtagatcatttgaggtcaggagttcaagaccagcctgaccaacatggtgaaaccccgtctctactaaaaatacaaaaaaattagccgagtgtgttggcatgggcctgtagttccagctatgtgggagactgaggcaggagaattgcttgaacccaggaggtggagggtgcagtgagccaagatcatgccaccgcactctagccagggtgacagagtgagactctgtctcaaaaataaataaacaaacaaactacctttagtagtttgatatattttgttttctgtaagtcagctcataaattattctttttgtacattacagttttacatgtttaagattaagactgagatatgttttaaaatacactcaatctttaaagaatcatttaaggtactttaaactcctttcaatacccatcagtcagatttttcatcaaacatggtaaacatatacatattatatactctgcctagcacaataaaagaaatgtaattgtcataccctatgcaaatttccaacctgaaaatacccagaagcatcttataaacactgaaacccacgtctctccaggaaagtttttccttgtgcatcgtacctcacaattcactactttgtattcttcaagcttagttggatcctcttattttgttatttgtttgtgctattatttccaagtcatgtcatgtatacgactggtctccaactagattatccttccctttttataggaactaccacgtgatttaactgtaaaacaatttctaatggtgtctgcacacatgtagtttacaagtaaatttgcaaaaaatataaacaatatgacagagatttagctgatgccttatcatgtctaattcccaaatgtttatattttaaaaacacctaactgaagtattctaatggagaaaaaatggcatgacaaagaaatatggaaatggcttacagttcttggctggctgtacgactggacatggaatttgagcacgaagatttcgaacaaaacactagcctagttactgtgtctttttaattttttttagacggagttttactcttgtcgccaaggctggagtgcaatggcgcgatctcggctctctgcaacctctgcctctccagttcaagcgattctcctgcctcagcctcccaagtagctgggattacaggtgcctgccaccaagccaagctaatttttttgtatttttagtagagactaggttcaccatgttagccaggctagtcttaaactcctgacctcagataatccacccaccttggcctcccaaagtgctgggattacaggcgtgagcacccgcacccggtctactctgtcttttttagagaataagactctggtatgtttcaagaataaaggaaatggcaaagttaatagtgaaaggttctcggttatttaaagtactgccattccagagtagctcctccagagtgaatcaattttctgtctacttttcttcctttcaaaagtcaaactggggttagaatgttcgaattctatatgttatattaatttctctttcaaaaagatcacttgaggccaggcacggtggctcgcgcctgtaatcccagcatttgggaggctgaggcgggcagatcacttgaggtcaggagttctagaccagcctgaccaacatggtgagaccctgtctctactaaaaatacaaaaattagcagatagtagtggtgggtgcctgtaatcccagctacttgggaggctgaggcaggagaattgcttgaacccgggaggcagaggttgcaatgagccaagatcacgccattgcactccagtcagcgtgacaagagtgaaaccccttctgaaaaaaaaaagattgcttgagctcaggagtcaagatcagcctaggcaacaggtgaaaccccgtctctacaaaaaaatacaaaaattagccaggaatagtggtgcaagcctgtggtcccagctactcaggaggctgagaagggaggatcgatcgcttgagcctaagaggtcaaggctgcagtgagccttgtgcacagtgagattgagccactgcctccagcctgggcagcatagcaagaccttgtcacaaaaacaaaacaaaacaaaacccagaagagtgaaggatcagaaaagtacaatgtattgagacatggtctccctcccatccctaccccagccccacatattccatagggagaacttgcctccagctatctctagaagaataggagaattttaatactaaattgaatagaaaaacatcttttttctcactttaaaaatacagtttattggaaaagagtaggtgtttggaatcagtgaacaccaagttccaaatcctactcacacttcccagaatacataccatggcaatgccaaaatatgaccatgcttgttaatatttaggccaaggcattaaatgtttataacataacacaaatacttgtaatctaaatttgaatgaatgtcttcaattttcagtaaaataagaccctattaaagccctaccattaatatatattcattcataaacatactgagtacctaatgaatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggcctcttttctgaagcttgcctaaatcatcccaggaatgctaaaattgggtgttatttaggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaacagttgactgccaagtgtggtggcatgtgcctgtaatcctagctacttgggaggctgaggtggagaggctcattctagactagtctggacaaatagcaagaccctatttgtgggggagcggggagaaggcaaccaagctgggtgtgccatgtgcctctagtcccagctacttgggaagctgaggcaggaggagtgcttgaaaccataggccaccgtactccagcctaggcaacataggaagaccctatctctaaaacaaacaaacataaacaaaaaggctgggcgtggtggctcacacctgtaatcccagcacttgaggaggccgatttgggaggatcacttgagatcaggagttcgagaccagcctggccaacatgataaaatttttgtatttttagtctctactaaaaacaaaaattagctgagtgtggtggcgggtgcctgtaatcccagctacttgggaggctgaggcataagaatcatttgaacctgggaagcggaggttgcaatgagctgagatcacaccactgcactccagcctgggcaacagagcgagactccatctcaaacaaacaaacaaacaaaaaaacagttatacctttaattattatcttcattcagtaattaggcaattagaatttgattgctaaatgaatgttcaaagttcaaccaaaattagtccaagatgaagccaagaacacatctcaactcattcaataaagccattattactccgatgccaaaaccagacacagatatcacaagacaactacagaccaatatatcttatgaatacagatgtaaaagtcctcaacaaagcaaaatgcatccagcaacatataaaaaggcttatacaccattgctaagtatgacttaatcccagggattcaaggttggtttaacttctgaaaatcaattaatgtaatacacggtattaataaaggatacaaaccacatgatcatttgaatagatgcagaaaaagcacttaacaaaatccaacttgctttcatgataaaaacactcaacaaagtaggaactgaagaaaacatcttcaacctaataaagaatacctataggagaaaaaaaagaatacctacaaaaaccccatagctaaaatcatacttaatggagaaagcctgaatgctttctctctcaggtcaagaacaaaacaaggatatccactcttaccactctgtttaacactgcactgaaggttccggccagggcaaataggcaagaaaaagaaataaaaatcactcaggcttaaaaaaaaaagaagtaaaactacctttatttgcagatgatataatcttgtatatagaaaatccaaagaaaatcccacaaataaactattagacccaataaacacatccaacacagttacaggatacaagctcaatatacaagtagtaatcgtatttctatacacaagcaataagcactctgaacatgaaaagtttctaaaaattccacttacaatagtatccaaaaaaaaaaaaaaaaaacacatagaaagccggacacgatggctcacacctgtaatcccagcactttgggaggccaaggcaggcggatcacttgaggtccggagtttgagactagcctagccaacatagtgaaaccctgtctccactaaaatacaaaaattagctaggtgtggtggcgggtgcctgtaatcccagctactcaggaggttgaggcagcggaatcacttgaacctggaagcagaggttgcggtgagccgagattgcaccactgcactgtagcctgggtgacagaatgagactctgtctcaaaacaaaaaaagaataatcagaaataaatttaacaaaagcagtgacaatcttatactctgaaatatataaaaattgccaaaagaagttaaagaaatcctaactaaacggaaaggccaggtgtgatggctcacacctgcaatcctggcactttggtagactgaagtgggtggactgcttgagcccagaagttcaagaccagactaggcaacatggcaagacctcgtctctacaaaaaatacaaaaatgagctaggtgtggtggcatgcacctgtagtcctagctgcttggggggctgaggagggaagatcacttgaacctacttaaggctgcagtgagctgtgattgcactactgtacttcactccagcctggatgacagagcaaaactgtgtctcaaaaaaaaaaaaaaaaaaaaggaaagacatcctatgttcatggatgagaatggattagaagatgtaacactgttaaaatggcaatattccctaaattgatctacagaaccaccaatgggatcccagtatacccaaaagaatcttgaaaaggaaaaacaaagctggaggactcacacttcctgatttgaaaacataattcaaagctacggaaatcaagacagtgtggtagtggtataaggataaacatgcagatcaatggaatataattgtgggttcagaaataaacccttacactgacagtcaattgatttttttgacaagaatgccaagagaattcagtggaggaaagaatggtctttttaagccaagtgctgtggctgacacctgtagtcccagcactttgggaggccgaagcaagaggactgcttgaggccaggagttcgagactagcctgggcaacaaagcaagaccccatctctacaagaaacaaacaatggtcttttcaacaaaccatgctgggacaactgaatattcacatgcggtagaatgaagttggaccactgtatctcacactatacacaaaaattaattctaattaaatttaaacatggattatagacctaaatgtaacagctaaaacaataaaattcctagaagaaaacaaaagctaatcttcatttcatttggtggcctgacatcaaaaccacatgcaacaaaggaaaaaacaagtaaattggacttcatcaaaattataacattttgtatgttaaaggacaccatcaagaaattgaaaacacaacccatagatgggagaaaatatttgcaaatcatgtatctcacaagggatttgcatctagtatatttaaagaactcttacaactgaacaataaaaagagaatccaattttaaaatgggcaaaggctgagcacggtggctcacaccagaaggagaggatcccttgaggcaaggattttgagacctgccagagcaacatagcaagaccctgtctctacaaaataaattaataataataaaaaaaaacaattagccaggcatggtggcacacacctgtagtcctagctactcatgagcctgaggcagaaggaacctttgagtccaagagtttgaggttccagaaaccatgattgggccaggtgcggtggctcacgcctgtaatcctagcactttgggaggccaaggcggctggatcatgaggtcaggagttcaagaccaacctggccaagatggtgaaaccccatctctactaaaaatacaaaaattagctgggcgtggtggtgggtgcctctaatcccagctacttgggaggctgaggcagaggatcacttgagcccaggaggcagagattgcagtgagccaagatagtgccactgaactccagcctgggtgacagagcaagactccatctcaaaaaaaaaaaaaaaaaaaaagagaaaactacgattggccactgcactctagccagagcgacagagcaagacctagcctaaaaaacaataggtgtataaaaataaaattaaaatgtgcagagaatttaaatagacatttctccaaagaagatatatgaatggccaataagcacatgaaaagatctcatcaagttgagcacaggggatcaggcctgtaatcccaacactttgggaggccaaggtgcagggactgcttgagcccaggaatttgagaccagcctgggcaacatggcaaaaccccatctctacaaaaaatacaaaaaaggccaggtacagtggctcatgcctttaatcccagcactttgggaggctgaggcaggctgatcacgtgaggtcaggagtttgagaccagcctggccaaaatgctgaaaccccatctcttctaaaaatacaaaaattagccgagggcctgtagagccagctacttgggaggctgagggaggagaatctcttgaacccaggaggcagaggctgcagtgagctgaggtcacgccactgcactccagtctgtgtgacagagtgagactccatctcaataaataaataaataaataaataaccagctgggtgtggtggtacacacttctagtcccagctacttgggaggctgaggtgagaggatcacttgagcccagtaggtcttagctgcagtaagctgtgatcgtgccactgcactacagtctgggctacagagcaacactttgtcaaaatgaaaaaaaagaaaaaggaaagaaggaagggagggagggagggagaggagggaaggagagagcaaagcgagggagggaaggagggagtgaagggagggagggagggagggagatatcttataattagtcatcaggaaaattcaattcaaaaccacaatgatataccacttgacatccactaggatgctataatcaaaaaataaaaaaagatagacaattacaaagtgttggcaagactgtggagaaaccggcaccttcacatgctgctagaaatacaaaatcgtccagctgctttggaaaatagttttggtggttactaaaaaagttagaattaccatatcacccagcacttctagccttaggaatatacccaagagaactgaaaagaggtatccaaacaaaaacttacacaagaatgtttagggccaggtgcagtggctcacacctgtactcccagcacttccagaggctaaggagagaggactgcttgagcccaggagttcaagaccagcctgggcaacataaggaggtcacatctctacaaaaaaaaaaaaaaaaaaaaaaaatagcagggaacagtggatcacacctgtaatcccaacactttgggaggctgaggtgggaggattacttgagctcaggaatttgagaccagcctgggcaatataataagactcaatttctacaaaaaaattttaaaagtagctgggcatggtggcacatacttttagtcctagctacttgggaggctgaggtgggaggatcacttgagcccaggaggttgaggctgcagtgagccatgattgcaccactgcattccagcctgggtgacagagaaagaccctgtctcaaaaataaaaataaaaataaaaaaagcaaatgtgccatacaaagcgtagatatggatggacttctaaatattttactaagagcaatagatcaaaacaggtgcccaaccaaaatttttattttattttttttagagacagggtctcactgtcacccaggctgctcgagggcagtggtgtgatcagagctcactgtaacctcaaactcttaggctcaatcaagtgatcctcttgcctcagccccctgagtaatgaggactataggcgtgtgccaccatcctcagctaattgtttttattttttgtagagacaggggtctcactctgttgcccaggctggtctagaactgctggcctgaagcaatcctcctgccttggcctcctaaaactctgggattacaggtgtgatccaccatgcccagcctcaaccaaaaatcttaaatttctaacgagcatggaaagggggaagtgggatgaaaaactttcctcaaaacagaagaatagtgcaaatgaggaaaaacaataaaagaccataaagtggtcaggggcactaagacctatgcaggcaaaacaacaattaaaaccttacaagaggccagatgcggtagcttacgcctgtaatcccagcattttgagagaccaaggtggatggatcacctgaggtcaggagttcgagaccagcctggccaatatggtgaaaccttgactctactaaaaagacaaaaattacccggtgtggtggcacacgcctgtagtcccagctactcgggaggctgaggaaagagaatcacttgaacccggaggtggagggtgctgggagccaagatcccacaactgtactccagcctgggcaacagagcaagactctctctcaaaaaaaaaaaaagcttccaagaaaattatgcaagccgggcgcagtagctcacgcctgtaatcccagcactttgggaggccgaggggaggcagatcatttgaagttaggagttcaagaccagcctggccaacatggtgaaattctatctctactaaaaaaaaaaaaaaaaagaacttacaaaaattagccaggcgtagtggcgcatgcctgcactcacagctgcttcggaggctgaggcaggagaatcgcttgaacctgggagtcagaggttgcagggagtcaagattgcactccagcctgagcgacaaaagcagaactccatctcaaaaaaaagaaaatgcaaagcgacctcagagacagtttaaatatataaaaagctagtgccaaataaaactgggtgggtcacttgataaacaggatataaacagtggataaaaagcaagacagctggtatatataattcttatttgcttcaatatttactggggaagatagaggggaaaaagctatctaaattactctttaaaacatacaaatcactaatagtgaatcaaatgcatcattaaatatactaaattcctcaaactgacatgtcagatgtcaggtagtcatgaagacccaaaatagtctctatgggttttttgtttgtttgctttttgagacagtctcactctgttgcccaggctggagtgcagtggcaccatctcggctcactgcaagctctgttgcccgggttcaagagattctcccacctcagcctcccaagtagctgggattacaggcgtgcgctaccacatccggctaatttttgtatttttagtagagatggagtttcactgtgttgcccaggctggtctcaaactcctgacctcaagtgatccgcccacctcggcctcccaaagtgctgggatttcaggtgtgagccactgcgcctggccccttctctgtgttttaaaggcatttaagtataaattattaaactgcaggacagaacatattagctgacggtcatatgagtgaccttctctaaatgccaggaggatagaatccacttttcctttatcaacattttccttgctcaacttctggcatattaggtactcaacaaatatgtgctgaaccaaaatgaacaaaaaaatgctgtcatcaaagtaactcccatccactcaagtaggctgcaacttcaaactgcccaaactggcaaatctctaataaagatgggctcagaagacataccagcatgaataaccttctgaggaaaagacaacatggattctaaaagtggaaatcacaccacaccagttcacccaaattctctgagaaaataaatatgtgaatataatttatgtgagctttcacaaaactcttgataagattctaagtaaagatttttttttttgaggctgagtctcgctctgtcgcccaggctggagtgcagtggcgcgatctcggctcactgcaagctccacctcccgggttcacgccattctcctgcctcagcctcccgagtagctgggactacaggcgcccaccaccacgccccgctaattttgtttttttgtatttttagtagagacggggcttcaccgtgttagccaggatggtctcaatctcctgatctcgtgatccacctgcctcagcctcccaaagcactgggattacaggagtgagccaccacacccggccctaaagattatttttttaaagacctgagtggccacagaatgagtacatttactgtagactggacataattgagacacagataattatgggtagatgctgaggtacttccccaaatgaagaagtataaacagaagattgataattttttagaaatgctcctcagaaactgcacagggtgagaggagaaagggtcaagggaaggcaaatactaatgtttttaggagcaaaagaggaaataagtctgcagaggaaaccaagagtatgagccgggctcggtgactcacggctgtaatcctagcactttgggaggccaaggcgggcagatcacgtgaggtcaggagttcgagaccagcctggccaacatgatgaaagcccgtctctactaaaaatacaaaaattagccacgtgtggtggcaggtgcctgtaatcccagctactggggaagctgaggcaggagaatcgcttgaacccaggaggcggaggttgcagtgagccgagatcgcgccactgcactccaacctggacgaaagagcaagactccgtctcaaaaaaaaagtttcaaagataaaacaaaaatcttgttaagaatacatgagacgctaaagaaataatctactttaattcatgctatcaattttcatttcctatgtgtaggtgttgagggtctagtacccatgataaatgacatacacctgttctgggctgacttttgttccctaaaagagataggtagtactccagggggctgggcacagtggcgcatgcctgtaatcccagcactttgggaggccaaggccacaggatcacttgagctcaggagttcaagatcagcccgggcaacatggcaagaccccgtctctactaaaaatacacaaaaatagccaggtgtggtagtgcgcacctgtagtcccagctactcgagaagctgaggtgggaggattgcttgagcccggggatgagggggctggaggttgcagtgatccaagtgccaccgcactccagcctggatgacagaggaagaccccgtctcaaaaaaaaaaagaaaaagaaaaaaaaaggagatatgtagtactcctaacattcagtacctcagaatgggatcttagagacaggatcttcaggccaggtggcttcccttcctctctgcgtcggtccgtcccacctcggctcggcctggcgaccctaactccgctccgcgcccccggccgcggccccggcccgcctcctgggcagccaggccccccggccactcggccggcagcccgcggcccaggtctgcaagtgggagctgggctggggtccccatgctccacacacgcgtctcctctcccccagccctgccgcttccagggccctcggtgacgcccgctccccgggcccctcggccccccgcctctcagccgggcgctccctcggggccgcctcctctgcctcaccatcatccttgcccactcgtgctcccacccccaggggcaccagagccaacggctgctcccccagcctcggaccttcctgcgcggctcaaccaagcctagaagtgggggcggggaatcttccgccctcctctggcgctcattggcccttcaggggcacatcgtgagcgccattggctgactgatggtgtccgtcagagcgatggggcgggacagaaaggggagagggaagctggtgccttggcatttctgtgtctgtgtatctgtctgtctctgtctctatctcggcccttggaaacgagaggcttttggccgagaggactagaagggggcctgaggtgggaggaataggaataggaatcccggcaaagcgtcacgccagtcggctactctgaaccccctacctaagtcccctttaggttctcttctccatcacccccaacccctgcccctcacccctcgaggttccttcatccaggaagcgacgtgatgaaaactccaggccggaaagccatagggagagatgttatataggtatataaaatacacacacacacacacacacacacacacacacacacacacacacacacacaaagtattagctgtgagttgttaatagatgctcttcatttaggttgaggaagtttctttctgttcctaatttgttgagtatacatcttttattttattcatttaaaatgttatttcaagaagaaatttgggccgggcacggtggctcacacctgtaatcccagcactttgggaggccaaggcaggtggatcacctaaggttaggagtttgagaccagcctgaccaacatggtgaaaccccgtctcttctaaaaatacaaaaactagcagggtgtggtggtgcatgcctgtaatttcagctactcaggagcctgagagagaagaatcacttgaacccaggaggcggaggttgcagtgaaccgagatcacatcattgcactccaatctgggcaacaagagggaaactccatctcaaaagaaaaaaataattaaaaagtaaaaaataaaaaaagggatttgaccaggtgcagtggctcacgccactaatcccaacgctttgggcgtccaaggcgggcagatcacttgagatccggagttcaagatcagcctgaccaacatggtgaaattctgtctctactaaaaagatacaaaaattgcccaggcatgatggctcacgcatttaatcccagcactttgggaggccgaggcgggttgatcatttgaagtcaggggttcgagaccagcctgggaacatcatgaaactccatctctactaaaatacaaaaatcacccggctgcaatggtgcacgcctgtaatctcagctacttgggaggcttgggcaggagaatcaccggaaccaggaggtggaggttgcagtgagccgagatcgtgccactgcactccagcttaggtgacaaggcaagactcagtctcaaaaaaaccaaacaaatgaaaattggccaggtgtggtggtgcacgcctgtagtcccagctactcaggaggctgaggaaggagaattgcttgaaccggggaggtggaggttgcagtgagccaagatcatgccactgcactccagccagggtgacagagcaagacgctgtctccaaaaaaaaaaaaaaaaaagggatttatgggaagtaattaaggtcacataaggtcataaaactgggccctgatttaatagaattagtatatttatgagaagaggccccagagaggtctctagctttctctctgccatgcgaggccacttcaagaaggcaagccaggtaataaagcccacactgagttaggaggtggaactggactccagaggtggggcttggacaccagaccaaattgatgactagctgaaacagggacagggtgaaagcagctttccataagacacgctcaccagtgcaccatgtcagtttaccatttccatggcggcacccagaattacctctttctttttctttctttctttttcttttttttgttttttgagatggagtctcagtctgtcacccaggctggagtggcacgatcttggctccctgcaagctctgcccccccaaggttcaagtgattctcctgcctcagcctcccgagtagctgggattacaggcacctgccactgcgccaggctaacttttgtatttttagtagagacagtgtttcacaatcttggccaggctggtcttgaacttttgatgtcgtggccaacctacctcagcctcccaaagtgctgggattacaggtgtgagccaccacgcccagcctaccacccctttcaatggcaacaactcgacaacccagaagttatcagcctttttctagaaacatctgtatagtccgccccttaatttgcatataattaaaggtcgatgtaaatatgactgtagaactgccctgagctgctgctctggtcacactacctatagggtagccctgctctgcaaggagcagtccctctgctgttgctgtaggtcaccgcttcaataaaagttggcatctaggccaggtgcaggggctcatgcctataatcctagcaccctgggaggctgaggtgggtggatcacttgaggccaggagtttgagagcagcctggccaacatggtgaaaccccatcttctactaaaaatataaaaatttagctgtgtgtggtggtgcgcccctgtactcccagctactcacgaggttgagtggggtgaattacttgaacctcggagatagattctgcagtgagccactgtactccagcctgggtgacagagtgagaccctgtctcaaaaaaacaaaaaaaaagttggcctctaacatctttggtttgccctttaattctttcctgggtgaagccaagaaccttctcaggctaaaccccagtttgggggcttcgcggccctgtgtcaacaccagaaacttaaccctttggaaactttgatcttggactttccagcctctagaaccatgagaaaatgatctgtattattaggctacccagtctatggtattttgttgtagcctgaggcgactaagacattgagcctgtatcactcaaattttgctacctgcttggccctttgatggcattttagtttgtgactcttggcttaagtgatcatgaagccaaaactgtttaggaagggagcaaaatcaagacagattaaaaaaaaaaaaaaaggctggcacagtggatcatgcctgtaatcccagcactttgggaggccaaggtgggcagatcacctgaggtcaggagctcgagaccagcctggccaagatggtgaaaccacgtctctactaaaagttaaaactacaaaaattagccaggcatggtggtgggcgcctgtaatcccagctatttgggagggtgaggcaggagaatcacttgaacccgggaggtggaggttgcagtaagccgagatcataccactgcactccagcctgggtgacagagcaagactctgtctcaagaaataaaataatttaaaataaaagaggtaagcatgctggctcacacacgtaataccacactttgggagaaagaggcagcaggattgcttgagcccaggggtttgagactagcgtaggtaacatggcaagatgccatctcaataaaaaaaaatatatattttaaaaagaataataggatcttgcctctgaagatgaaataacagaggaaattggagtaaggaagaaaagttgagaggggctaaggttataggtcagagagttgaaggctgggagctaggatttcagtcatggagctggtccagggtctgggaagctcctttccatggtcatgggtggaggccgctatagacgagaaggttactggagttgaagagagtgagggaagatgcagcatagatgttaacggtagctaggatgatggaaaggaagatacaaacctaggtgctcaaaccatagattaacgtggaggaatggatggaaagttgggagatgatggagttgaggtggacaatggggtcttgtagctcaatgacatgggcctcaaaagaaaaagattgtatataagattggaggagcacaaatgtgggagcagcatgggaactatgagaactccaccctccttttttcagcattgtatgcacccaaacctcctaattcggtgatcctcttccctagaagtagtgtcccctaaggcaaggacaacttttattcttttttgtgaatttttaactgcattgctaatcacaaagtctttatctaacaatatgttcatcatttcttttttttttttttttttgagacggagtctcgttctgtcaccgaggctggagtacagtggcgtaatctcggctcactgcaagctccgcctcccgggttcatgccattctcctgcctcagcctcccgagtagctgggactacaggtgcccaccaccatgcccggctaattttttgtatttttagtagaggcggggtttcactgtgttagccaggatggtctcgatctcctgacctcatgatctgcccacctctccctcccaaagtgctgagattacaggcgtgagccactgcgcccagccgttcatttcttttgttgttttttgttttgttttgttttgtttttttgttttttttgagatggagtttcactcttgttgcccaggctggagtgcagtggcgcgatctcagctcactgcaagctccacctcccaggttcacaccattctcctgcctcagcctcccgagtagctgggactacaggcgcccgctaccacacccggctaattttttgtatttttagtgcagacaggttttcaccctgttacccaggatggtctcaatctcctgacctcgtgacctgcccaccttggcctcccaaagtgctgggattacaggcgtgagccaccgcacccggccagggagagctacttctaatcaaacacactaatatttctgcagcaaagtgtgtgaatgtccacattatgtgcaataaataaggatcatttatagtgtgatgtcacttcatggatcagattttgccaccaaaatgagttatgaaaacctagcagttttcagttttcagtacccttcagatttcaggattaaggataaaagattgttcactctccttaatctacaagtgagattctcaagctgcgttttgcagaactacttagagtgccccagcccagaagcactgaatcagattctttggggtgtggcctgggaattggaatttttgacaaacaacccagctgatactgatgagaaacactgcccagggtgtagtgctatggcatgggaaacagatgggaaccccagctgggctatttttatcacatgcctctccccaaacctccctttgacatcactttgaccctgcagtcaagtttcacagaatttttctatgacattttgatggagatgggtgtccaaaggacaggaatatacaaagatcaaaggggcaggggagaaaaacaaagcagaaaaaggcagacagaattactattctaaactcaagctacagtctggtcatcagattatgtcacatgtattcattcactatctactgagtatgcgttatcagtcagacactggtgcaggtagttggaaaatcacaaaataattctagaccaagtaattttcccttttggcaattctcatttctctgtacaccacttgttgtttttggttttgttttgttttttgaggagtgggcatcagccaatgaagcacattgagtctttcccggcggtagctccaactgcaaagcttatactcacgcccctcttcatctgggcgtctgtttctctaggcttctttttgcatgggtttgcatatggagatctggttatctctgctgaggtttctatgttgatgtctctgtttggaggtctctcagtaggtaggtgggtatcccttgtcaagaagaaggacccacatttaacatcacaatgtcttgtggaccccccacacgctaattgtcatcttctttatatagttctggaggtcagaagtccaaaatcagtctcattgggctaaagtcaaggtgtcagtagaactggtcctttctggaggttctgaggccacctgcattccttggctcatggctgcttccttgcttcactcccaccttttacttccttcatcacatcttccactcctgactgttgatcccactgcctccctctgataaggagcctcgttatcacattggcccaccttatgaacccaggatcgccactcctgttaccgggagctcccaagatggtggcgggctgcttccaagatggtggcaagcctcgtgttctctgacctggggttcttggcctcatggagtccgaggaatggaatcttgggccatgcggtgagtgttatagctctatcagaagccgtgggtcacggaagagaatcgtggaacccagtgattagtgttcagctcgattaggacgaacccagcacttagccgtttaggaacaatggcaagcctctagcccaatcgggagcagcaatgggcacctcactggatcaggagcacagtggacaccctgctggatccggaggaatggaagtcagtggcgggtctgcgatggcggcaaacagcactggtggacggcaagcaaaagctcagctccagccgtaacaaacacggaccagaagatagtgcagttgcaagatttaatagagtgaaaacagagctcccatacaaagggaggggacccaaagagggtagccctttttttatttttagtagagacgggatttcgccacgttggccaggctggtcttgaactcattacctcaagtgatctgtcagcctcagcctcccagattgctgggattacaggtgtgagccactgtgcccagccttctgacttttatagtaaatacttttcttgcttgtctttgtacttatattgactgtgtatgtattcctaagcatggtttagtattttcccttgaaagagttatataattatatatatgtatatatgtgtgtgtgtgtatatatatatgtatgtataggctgggattacaagtgtgagccaccatgcctggtcaagagttacatgagtatactttattattttaacatttattttgaaataatttcagaaaagttgcaaaaataatacaaagaatccatctactcttcattgagattcctcaaatgttaacattttaccgtttgctttttaatttttgtctctcccctcactccccacacacatttttccccaaaactatcattgaataaattgcatgcacaattcccctgtccctcattactcctcgtactttctttcttttttcttttctttttttttttttgagacgaagtctcactctgttgcccaagctggagtgcagtggcaagatctcagctcactgcaacctgcacctcccgggttcaagcaattctcctgcctgagcctccccagtagctgggaatacaggtatgtgccaccatgcccggctaatttttgtgtttttagtagagacggggtttcactatgttggccaggctggtctcgaactcctgaccttgtgatccacccacctcagcctcccaaagtgctgggattacaggcatgagccactgcacccagcccattactcgtactttctaaaagtaagcctattttcttatatcacagtacagttatcaaaatcaagaaattaactttgacagagtactattatttaatctagacactatgcaaattttgccaactgtctcagtaatgtcctttataggagaagaaaaaattttaaaaaatttctgtctcaagatccaattcagcatcacacattgcatttacttgtcaatgtagtcacttttaatatgcaatagttttttggtctgtctgattttcataaccttgatgacacttttgaaggttacagaccacttattatgtacaatgtccctcagtatgagtttgcatagtatttcctcataattagattcaggttatgcatttttggcaggaatatccagaagtgatgctgtatacttctccatatatattactaggaaaaatttttggcaggaatatccagaagtgatgctgtgtacttctccatatatattactaggaaaaataataaccattttgtggggaggaacttttttttttttttgagacagagtttcgctcttgttgcccaggctggagtgtaatggctccatctcggctcaccgcaacctccgcctcctgggttcaagcaattctcctgcctcagcctctcaagtagctgggattacaggcatgggccaccatgcccagttaattttgtatttttagtagagacgggggtttctccatgttggttagactggtctcgaactcccgacctcgggtgatccgcccacctcagcctcccaaagtgctgggattataggtgtaagccaccgtgcccggcctggggaggcacttttgagactacgtacaaatcttgtttttaatcacatttttgcttattaattttagtaatgattattctggcctgaaacaattataactttggtggttgacaaatagtgatatatattgttttttgtttttatttgatatggagtcctgctctgttgaccaggctggagtgcaatggcacgattttggctcactgcgacctccacctccccagttcaagacagctgtaaaacttgtttaatgtattttttgaaaatgtttctaaaagataaaaaatgtttttacctggaaatcgagtaaacaagttatttgtatttgtaagaaagcctatggaatgtctcataaagatctattctggccagacatagtggctcacactttgtaatcccagcaccttgggaggccaaggcaggtggatcacctaaggtcaggagttcgagaccagcctggccatggcagaaccccgtctctgctagaaataaaaaaaattagccaggcgtggtgttgggtgcctataatcccagctactcaggaggccaaggcaggagaatcgcttgaacctgggaggcaaaggttgcagttgcactgagccgagatagagccactgcacttcagcctgggcgacagtgtgagattctctaaaaaaaaaaaagaaagaaaagaaaaataaaaaacagaaaaaaaggctatactaagaccctggcttctgaagccccacagttcccctagtaaatgttttggctatgtagtacgccacatgcatgtgtttaccacagtgtatccaaccaacctcctctgcttggacttttgagtagtttgcaagattttgcaattacagataatcagtaatgaataaacctacacatatgtattttcatgttgttgaggtgtatgttcagggtcaattcctagaagtaggattgctcaatagaagcatagatgcatatgtggggtttttttttgtttggttgttttgttgttttgtttttttgcttctgagatggagtctcattctgctgtccaggctgcagtgcagtggcacaatctcggttcaaggcaacctccacctcctgagctcaagccatccttccacctcagcctcccaagtagctggaattacgggcgcacactaccatgcccagctagtttttgtactttcagtagagacagagttttgccatgttggccaggctggtctcgaactcctgggcttcggcgatcttcctttctcccaaagtgctaagattagaaggcgtgagtcactacgcctggcctcatttttcctttctattttttttctaatttaaggtgacttttcactttctcacatgctttttgaaagacatttttcttttcctttagctttgtaggtttttggggaggcttttcaacagcagaaaaacctttaatttcctgacttttgcaataattttttatggatgttggctactttattccaaatcattcaattcataaaattcttttttttttttttttttttgagacggagtctcgctctgtcgcccaggctggagtgcagtggcccgatctcggctcactgcaagctccgcctcctggattcacaccattctcttgcctcagcctgccaccacgcccagctaatttttttttttttgtatttttagtagagacggggttgatctcctgacctcatggtccgcccgcctcggcctcccaaagtgctgggattacaggcgtgagccaccgcgcccagcccaattcataaaattcttgagtggccttgtcagttctgccctcttttgtgcaatttaaagatatttgttgatggggtgggggaaaaacttggcattttctcttctctttttcttcaattccctcttttcctttcaccacccttccttataaccgattctctcccagaaacactttctatgaggctgccactcctggtaccacacatttttaaggctgtgtcccaaagacagggctgtgatctaccaagtactaacctgtgttcagtattttacacttgttatgtcacattttcccccctggagattgtgtctgtgcttcctctaagtcctaaactccattctgctttgtccatataatgctttaacctccctttcctcactccacacacccacaggcttatggtggtggcaggatccctgttgcaaaccttttcttctacttacaggtaatttgaagttgcagtattctgccctgtgtaatttttatttgtcctacttgattttatggttgttttgggagagtgagggacagatttacaatgaggttaccgctattgttctccggccccagaagtctctgcatgcttttcttttttgttttctttttcttttcttttctttttttttttttttttttttttttgagatggagtctctgtcacctaggctggagtgcagtgccgcaattttggctcactgcagcctctgcctcctgggttccagtgattctccagcttcagcctcctgagtagctggaattacaggcacacgccaccacgccggggtaatttctgtatttttagtagagatggggtttcgccatgttggccaggctggtctgaaactcctgacctcaggtgatccacctgccttggccttccaaagtgctgggattacaggcgtgagccaccatgtctggcctgtatgcttttaatacacagatacatttcagtatctagtcgtgatgaaaaccattgaaaactagcaatagaaaggacgtatcttggctgggtgtggtggctcatgcctgtaaaccagcactttgggaggctgaggcgggcagatcacctgaggtcaggagatcatgaccagtctggccaacgtggtgaaaccctgtctctactaaacatgcaaaaattagccgggcatggtggcacgcacctgtaatcccagctactcagcattctgaggcaggagaattgcttgaaacctgggaggcggaggttgcagtaagctgagatcgtgccattgcactccagcctgggcgacaagaatgagactttgtctcaaaagaaaaaaaaaccaaccaaccaaccaaacaaacaaaaaataataattagttgggcatggtggcacctgcctgtagtcccagctacttgggaggctgaggcagaagaatcacttaaacctagtaggcagaggttgcagtgagctgagattgtcccactgtactccagcctgggccacagaacaagactccatctcaaaaaaaaaaaaaaaaggaggtatcttgtgatcttgtggtattatcaatggttataaatgatagttataagtggagctgagtgttgggaatggccataagattagcaaaggtaatgtattgggctgggtgcagtggctcatgcctgtaattccagcactttgggaggctaaggcaggagttcaagaccagcctgggcaacacagtgtgactttgtcgttataaaaaataaacagccaggcgcggtagctcatgcctgtaatcccagcactttgggaggccgaggcgggtggatcacgaggtcagaagtttgagaccagcctgaccaacatggtgaaaccccgtctctactaaaaatgcaaaaattagctgggcatggaggcacgcgcctgtaatcccagctactagggaggctggggtaggagaatcgcttgaacccaggaggcagaggttgtagtgagccgagatcgtaccactgcactccagcctgggtgacagggcaagactctgtctcaaaaataataataataaaataaaataaaaaataaacaaaattagccagtcatgatggcgtgcacctgtggtcccagctactcaggaggctgaggtgggagggttgcttgagccagagaggtagaggctgcagtgagccaagatcacgccactgcactccagcctgggtgacagagtgtaacatactgtacattagtggctttagattgtgtcattgagtggaaagtaaatgtcaaatttgagaaaattgagaagcatctttttaatattgagagtaagacaataaatactagtttttatgctgctactgctcaatatagtattggtgatcctggcatggcaataaataaagaagaaataaggtattctatataaggattaaaaagaaattaacatcattatttgaagataatggcttaaacagaaactctgcaaatccttagaataagaaagttcaggccgggtgtagtggcttgcacctgtaatcccagtgcattgggaggctaaggtgggaggattgcttgagcccaggagtttgagaccagctggggcagcataatgagatcccatctctacaaaaaattaaaaaatgagccgggtgtggcggtgcatgtctgcagtcctagccacttgggaggctgaggtgggaaggtcacttgagcctgaagagttcaaggctacagtgttatgatcatgccactgcactgcactccagcctgggagacagagcaagaccctgagaccctgtctcaaaaaacaaagcaaaaaaccctcactaaattgaacacaacatcaacgttcaatagccattccccttctcctttgctaataaaattccagtttctttgtgttccatcgcaggaccatgatttatctaaactggtcattcttggtcaatacatttggctaaaaataaataatatcaaaattggtcacagcaaatctattcttttttttttttctcggctcactgcaacctctgcctcctgggttcaagcaattctctgcctcagcctcccgagtagctgggaatacaggtgcccgccaccatccctggctaatttttgtatttttagtagagtggggtttcatcatcttggccaggctggtcttgaactccttacctcgcaatctacccaccttggcctcccaaagtgctggctctgtcacccaggctggagtgcagtggtgcaatcatggctcactgcagccacagcctccctgggctcagatgattctcccactttagcctcccaagtcgctgggattaaagtcacatgccaccatgcccagcaaatttttccttttttttttttttttttttttttgtagagacggggtatccctaccttgcccaggctggtcttgaactcctggcctcaaaggatcctcctgcttcagtctcccaaagcactgggtctattattccctttcttattcaaactgaattctgcattttcaaggccttgaattttcaaatacagctttttctttccctgaatttgtttgggattcaaatacagcttttactctcaattgaaaattctatgttgatgatgttgacaagattctctcctttgaccaaaactttgggcaggcccctctgagtcctttctgattaggcctgaccttgggcttccctctctgtccttgtagaatatagtttgaaaaaaaaatcctgctaaatcattttagaaaaaatctcccatctttgatatcttatcaatgtagtcagcttccagcaataatcctatcaagtcagtttagccagaaaccccttatctttgatgttttctcttagtaattttccatcaactgaccccattctgttccttggatatacacctccacttgtccctgttaaaatcagagtcctatctctctcccctactgcaagaccccattgcagtaggccctatacctatgtccatgccccccattgtgtcttatgatctttagcaagtgtcataaatacatttttcttttttttttttccttttttttctgaaacggagtctcgctttgtcatccaggctggagtgcagtggcgcgatctcggctcactacaagctccgcctcctggattcatgccattctcctgcctcagcctcccaagtagctggggctacagacgcccgccaccacgcccagctaattttttttttttttttttttttttttttttttttttttttttttagtagagacagggtttcactgtgttagccaggatggtcttgatctcctgacctcatgatccgcctgccttggcctcccaaagtgctggtattacaggcgtgagccacgctcccggccataaatacatttttcttttttcctttgagacagggtcttactctgccacccaggctgggtacagcagtgccatcatggctcactgcagcttcaacctctgaggctcaagtgatcctctcacctcagccttccaagtagctgggaccagaggtgcactccaccatgcctggttaatttttacccattttttgtagagatgggggtctcactatgttacccaggctggtcttgaactccttggctcaagtgatccatcacccttagcctccgaaagtgctaacattgcaggcatgagccacggtgcccagcctacatttctctttcttcttttcttttctattttttttttttttttttttttttttttttgagatggagtctcgccctgtcacacaggctggagtgcaatggtgcgatctcggctcactgcaaccttcatctcccaggttcaagtgattctcctacctcagcctacagagtagctgggactacaggcgcacgccaccacacctggctaatttttgtatttttagtagagacggggtttcaccatggtggccaggatgacctggatctcctgacctcgtgatccatctgccttggcctcccaaagtgctgggattacaggtgtgagccaccgcgcccggcccatttttctctctccctctctttttttaatacagacggggtcttattatgcggcccaggctggtctctaactcgggctcatccgcacatctcggccacccaaagtgctgggattacaggtgtgagccacaacgtctggcctacatttttcctaagagtgttgaatattaaaaggatgcttgaggctggggcgggcgaactgcttgagcccatgagtctgagaccagcctgggcaatatggcaataccccatctctacaaaaacacaaaaaattagctgggagtggtggggcatgcctgtagtcccaactacttgggaggctaaggcaggaggatcccttgaacttgggaggtagaagatgcagtgagctgtgatcgtgccactgcattccagcctgaataacagagcaaaaccttgtctccaaaaaaaaaaaaaaaaaaaaaaaaaaaaaaaaaaaaaagaatgcttgcaatagaggaagttaataaaaatgcaagaactgaaagaaaattgaagatttataactttctactttaaagcaaatcctagtcactcaaagagggaaaatatattccaatttcagtggcagaagagaagcagcacatagatcaaagccctaacaaaggactatactacaacagatctggctgattaataataaagtttcctctgtaaaacctggaccttgatattggcctacagtagactttatatttaaaaatgctaggctgggcgcggtggctcacgcctgtaatctcaacactttgggaggccgaggtgggcagatcacgaggtcaagagaccaaaaccatcctggctaacatggtgaaaccgtctctactaaaaatacaaaaaaaattagccaggcgtcgcggggagcgcctgtagtcgcagctactcgggaggctgaggcagcagaatggcgtgaaccctgggagcttgcagtgagccaagactgcgccactgcactccagcctgggtgacagagcgagactccgtctcaaaaaaaaaaaaaaaaaaaaaatgctagagagggccagatgcggtggctcaagcctgtaatcccaacactttgggagcccacggtgggcggatcacctgaggtcgggagtttgagaccagcctgaccaacatggaaagcccgtctctactaaaaatacaaaaattagctgggcgtggtggcacatgcctgtagtcccagctactcaggaggctaaggcaggagaatcgcttggacctgggaggtggaggttgcggtgagtcgagatcgcgccactgcactccagcctgggcaacaagagcgaaactctatctcaaaaaaaaaaaaaaaaaaaaaaaaaggctagagggctgggtgaggtgactcacgcttataatctcagtgctttgggaggctgaggtgggaggattgcttgaggccaggagtttgagattagcctgggcaacatagcaataccctgactctacaaaaataaaaaataaaaaatgagccaggtgtcgtggtgcatgtttagtcctggctacctgggtggctgaggtgggaggattgcttgagtccaggagttcgaggctgcagtgagctatgatcatactactgcactccaggatgcggggcagagcgagactgtctttaaaaaaatgctagagaagacaacttacagttaccattaaatatgacttgaaacctccagaggaagtccaaaactaaaatataagattctgaacatacactaatgccaaaagtgcccagttttatcatttaatagctgagcctgttttctgttttgtaaaatgaagtaatacctaccttctagtgatgagaattgaaaataccatccacaaagcaagtaacacaatccatagaccaggatctcagcaaacatagcttttaaacaaagtttgcacttacaaagaaaaataaaacctatactgaaccttcatgaaccataagttgtcagctaaacaagccaaagaatagctccatgtctaagctgctgtttatccttgttcagctgacattaaatggcaggtcctagggaaggttatgaggtctgcattgttccccttggaactgcccagctcaccccaccttcacatgtttttccctgttactgccttttcttcaagtctgaataaaacccttcagctctttgtactttctccaagataccaaaaaaaaaaaaatttcaaattagagtaaaatttagtttctacatcttacttctttcagatcctgacctttttaaatagattctaattggaacaaaaaaacctttgtgtcccttttgaagaaatttcagaaatcacgtgatcaaagaataagcagttgacttgcaaattcgcagctgctggttggtaaggggcttctgtagtttgaaaaaaggtattctaaaaattaccattgtttttgtcatagtatttattttgatattccaaataatactaaaaaagagtatgaccgtttaaaaatataaatatattaagagtgtaagttttaaaaaattagataaacattgctctagttttttgtgaaacataaaactgtatctctgtttttctgtgccttcttattaaaatacagatggcacagctttcatatagctttaacaacttgattataaattgctttcaaaagtaacttatttggattttccatatcctttaatgaattgcaaatatattaacagaaaagactttccccctcaacactgtacaatttctgaaataagtcagttaaagcaaaaagaagacacaaaattacattgtttcaatgcaaacagaacacacacttcatacccacacttgcattttcccaggttttcacaaagaaaatgggtcaccatatttctcagtgaagactcatactatactctggctaatcagagacttccaaacttttttcttcaaaaagagcatttttaatagactaaatactggttatcactgagtttttgtttaaggtacaacagcagcatggttcaaatgttacttgtagttctcggaaaaattaaaaattttaagtgatgaatacagaaaatgtagggaccacctttcattcttttgagtaccactgttctcttgaaaaaatattctaaccttctaaaatcccagagttaagaaccatttccaaggggaaaaacaaatccaaggccacaacataacttctgaacaagtgtgtgcgcgtatatatatatgtatatagatgtattaagttggtgcaaaagtaattgcaggttttgccataaaagtcatggcaaaaaccacaattacttatgcaccaacctaatatatgtgtgaaacagagaaaaggatgtcaaactacttaatttaatttctgtaaaataaacttctgaaatttgaagcaaacattttgcttgatcaaaatgtgttcttcttcgggttgtttgatccccattccatgcaaaaaacaaaaccaaacaaaaaaagaaactgcaaaagccagaaagtgttactacgtgggaaataaggcttcaaatacctaaatgactttgaaagtaggtatgaggaaaaataaaataggccaagcttgggcggaaactgtcccccaaccagccattgccatggcatgtcttacaaaacgatccttttatccttggtctcaaaaaatcagtaccagaaagactctcacctctggcacataaattcctgctacaaaaagataattatacttcagcaagttatgttctaagcttagctttctccaggctttataacgcagaactcaggttgaagctttctataaaactctaaatgacactgttatacagcaccttgtgctttgccaattaaaaaaataaaagaatctaaaattaaatattacagaactaatggataatacaatagcatacgtgttagaatccaagtgctagcctctgggaatttttcattatatttattttctcccaactgttccttttttttaaaaaagtattgttttagacagtacatatacataaatttaggtagggaaatctgttaaatatctctctggcacctgatacctaaagaccctgacttgaattaatttataaattgtacctaatccatgttcaaatgagattaacagtaaattatagaaaattactgagtctacagactaaaatttttttcacatcttttgtaatccaccttattttcacagcttgactaacaaatacaggtaagtttgtcctccatcaaataatccagaataataactgtaggcctgtcattcataagaaactataatttgttatattctgacactggcacttaataaaatgttaacaactaaaatttctctaaaaatttcaatacattacagtaaaggagataaacaatttaagactgtttaaatctgttactgtggaattccaataattatcattttatatgcataattgaattcttaaaattgtggccattttccaaagacaccaatctatattatgacaaactcagaagagaacctatctccttcataagaatgttttttcccccaagctaaaaatttccaacatcctaaacccaattactcttagtaaatgttttggtgactcacactactgaaaaaatctgaagcagagagtcaaaaagaatggaaaggatctcaaccaaaggtaaccacacattcttacactctgcttaagcaaacacttagaaaagtcaaagggatgttttgaacaaatatagattcaaggttatggtacaattctgattatattaaggctttcactatcatgatctcttaaaagtctctccactttagtgttctccttctgattcatatggtgaacttaaggggttattaagggccttgttttggcttctcagtggggaaccactctatcatctctgaatgttaaaggtgatcccacagagctcaaagagaagaggcaatatggtaagaaacaattttaaagtttgcaataccaagacaacaatgatcaacactttgaagcaagatgaataaattaaaattcttggttagacattaaagcattcttgccaagaataagagtacactgtatggagggatatttgattcctacatacgagtcccaatatgcccattacatttgtttatgggagatactgcaagtttaaggtaatttacattccttggcaatcaagtcactgttataggcaacgtcttttattgttccatctggcacttgcaaacaccattcttgaagaacctagaaatgaaggtcagttactctgtttatcaggaacagaaccaaataaaaacaaatttttgaaaaagcaaccaagaaactctggttcatcactattttccatatctaatggttccttcaagataaagcataactcttcctttcatgatactttccaacaaagggagattaaagaaaaacagaaaagaaagttccccaccctaccccccataaattgtcattcatactggtaaaagagccagtcttgttagcagctaaatattgcactgcctttcattctgtatacagtcagggtccaatgaaagtggcacactcatggtataagtgacggacgatgacaccgccagctcaagagtaaagactcagtatacagagggacaagaaacacgtcagcactagtcacacatccagttgtaaaagtctgatttccagaagttaaaattcatcactttcagctgcatgaagttgtgtgtcatccgcatctgtcatgctgctctcctgggattcatctgttcccactttaaaaataaaacagaagtccacagtaagttttctgacaaatatgtcctgttggttcatgaaaacaagtaagaaaaattgtattatattcagagagataaaaccctaaataaaggcccttaaaaatcctcatatcctttaataaaatgcaactcaagtttcctaactttataataggtctgatattagcttactgcattttacctttaagttttaactaccaaaactgcctcttcctaatgagttccttattcctgccctaggaattacaactagctagttctctgagacattaaaaaaaaaaaattgacatttcccccaacctccaatcactgactccactttaagaatactccctgctagtccacagaaacacagactataaccttcagtttcaaaaggtttatggggtcagtctatcagtcaatcaatcaatcaatcatctatcttgctctgtcacctaggctggagtgcagtggcacaatcatagctcactgcagcctcaaactcctgggctcaagtggtatgattctcctgcctcagcctcccaagtagctgggactatagacacgtaccaccacagccagctacttttaaaaatttgtttagagacagggtctcactggctagtcgtgaaatcctaggctcaagcaatcctcccacctcagcctcctgagtagctgcgattacatacgcaagccatcatgcctggcatatatatactttttttttttttttgagacagagtttcattcttgtcatccaggttggagtgcaatggcgtgatttcggctcactgcaacttcagcctcctgggttcaagcaattctcctgtctcagcctcccgagtagctaggattacaggcgcccgcaaccacgcccagctaatttttgtatttttagtagagacgaggtttcaccatgttggtcagctggtgtcatctcctgacctcaggtgatccacccacctccacctcccaaagtgttggaattacaggcctgagccactgcgactggccccatggcttataattttaattaaagcctttcaccaagttttctggaacaaaggcatctaatcagaatttatcttgtcagaaatttctccattctgttatttaaaaaactacatttttatgaagcagataaaacagtactggttacatattcaaacataaattgaggtccaggtaaaacttagcaatgaatttgtcaaagtcacacagcaaactagatccagaacagagactcattatctgactttatatgcattttgttattacatcaccctgttcaatttccctaaaagtccatttggtataatgaaaacaccatggttagaaaaataaaataaaagagtagcctacaaatccttatgcaaaaggtaactttctaaatactcaaaatcatatgtatgatacttactgatctgttcttcttgggttattggctcctcatcatctggaagataacgcttatcaattgcctctttaatctggttattggctcctttaggatctaaatccatagcccaagagaaattcatcagggcgaggtgcgtttgacctaacttcttgtaaacctaaaaataaacagcagcactacatttttcattaagttgtgagcttcaactataaaattctaactatatatatacttatttatttatttttgagatggagtctcactctattacccaggctagagtgcaatggcacgatcttggctcactgcaacctccacctcccaggttcaagcgattctcctgcttcagtctcctgagtagctcggactacaggtgcccaccaccacccctggctaatttttgtatttttagtagagacagggttttgccatgttagctaggctactctcaaactcctgactcagatgatccacctgcctcccaaagtgctgggattacaggtgtgagccaccgcgcccagcctctacaattctaaatatttataatttaaattaggctcctgatttatgtgctctaaactcattctaagggtaggacattttcttcctacagatgaactcataccagcttttgagttccttttaatataatcagacattattttcagaattccttgcttctatctttcaggtagtaagtttccaataaatatcactctgactggagcaatgataatgggattaaatggattataaactgcttaattaactttcatttacagtgattttaaattgagttatatcaactctttacaactgtccacagtcaccttaactaattggcatatggaggtctagtctgtaaaaaactgactagtctggccttgggactctcagaagccatttctcttaatcaagacaacacagtgccattcatgttcttctacttttttttctacttttttttttttttttttttctttctgagacagaatcttgttctcttgcccaggctggagtgcagtggggtgatcttggctcatggcaacctctgcctcccaggttcaagtgattctcgtgcctcagcctctggagtagctgggattacaggcatgtgtcaccatgcccagctaattttttgtatttttagtagaggtcaggtttcaccatgttggtcaggctggtcttaaactcctgacctcacgtaatctacctgcctaggcctcccaaagtgctgggattacaggcgtgaggcaccatgcctggctaggatatcattttcttaagtgttagaactaaatctgttattcccagagcactcagttcggagctttagtttaatttgctcaatagatatgtacaggaagtattacatttattcttataaaatgtcattatttgctatgaaagtcactgtttgggaccatgaccccagtctttacctttcctattaagaagtaaacgagggattctttgggaacaatttgtttcaattcttcaagttcttgtaaagcagactgaaaaaggcaaagaaaaaccttaaagtagcaaaaatttttaaagttttgaccaagcgtttttacttatttgatttcccaaatcatcttcacaaaagctaactaaatcttaatcaatatacttccttattgtattagttcttattgctgtgaaaataaaatgcatacttatatgacaataggtactaagaaatggcaggcactctagtacactgaaaacacacacacacacacacacacacacacacacccctcttcgtgaaatatgcaggtggtaacaatccttgcttttggtcatctatctatctatctatctatctatctattcatttttatttattgaggtggagtctcgctctgtcgcccaggctggagtgcagtggcgccatctctgctctctgcaatctccgcttctcagattcaagcaattctcctgcctcagcctcccgcgtaactgggattacaggcatgcgccaccacacccagctaatttttgtatttttagtagagacggggtttcaccatgtcagccaggctggtcttgaactcctgacctcaagtaatctgcccgcctcagcctaccaaagtgctgggattacaggcgtgagccaccatgcccggcccagtgatttattttttaacgaaaaataactatataatttttcagaacaacaaaaagttattgagaagagtggcattaacatttttgcaagtctctgttagtagaagacagctagattctcacatctatctgcttctccatttaatctgtttcaatatcacatattatgtagcttttggaaaattctactgtccatttggacagaatgagagtgaaaaaggtaaataacgtcaagatattattgtaaaaatagctttgacctctaggactccttggaaggattttagggacccccagaaattcccagaccactctgagaattattactttaaagacatctttttttcttttttgagatggactctcattctgtcacccaggctggagtgcagtggtgcgatctctgctcactgcaacctctgcctcctgggttcaagtgattctcctgcctcagcctctcgagtagctgggattacaggggcttacctgtaatgcctaattttgttttgtatttttagtagagatggggtttcactaaagttgcccaggctggtcttgaactcctgacctcaggtgatccacctgccttggcctcccaaagtgctaggattacagttgtgagccactgcacccggccttactttaaagaaatctttttttttttttttttttttttttttttgagatggcgtttcactctatcacccaggctggagtgtggtgtcgtgatcttggctcgctacaacctctccctcccagtgtcaagtgattctcctgcctcagcctcctgagcagctggaattacaggcgtgtgccaccatgcctggctaatttttgtatttttagtagacacgcggtttcaccatattggccagctggtctcgaacttctgacctcaagtgatcctctcaccttggcctcccaaagtgctgggattacaggcgtgagccatcatgcctagcctttaaagaaatctttttttttttccctgagatggagttttgctctgtcgtccagcctgaaatgcagtggctcactgcaactcccacctcccaggttgaagcgattctcctgcttcagcctcccaagtagctgtgattacaggcgcccgccaccatgcctggctaatttttgtatttttagtagagatggggtttcaccatgttggccaggctggtcttgaactcctgacctcgtgatccacccgcctcagcctcccaaagtgctgggattacaggcgtgagctgctgcgcctggcctttaaagaaatcttaatctctaagatgacacactccaatcctccttcactgctacaacacacacaattcagaattgatatgttttctttctatgattgcatattataattgttatcaacatttcatgcaaccagcatgcctatccccacccccagcgatctaattacaaggactcattgagaaatagtgtctcacatagcatcagagctcttacttttaccttaaagacttaagatttaaataattaaatatcagtacagcacattaaataaggtgatggctagcaatgttttagagatgttgaaatggcccccttgattttcattttggagccagaaaatctcagaagcaatcattaacttttctttctttttttcaagtgaccagggaatgacacagccccaggagatcctgagaacatgtaccttttaacttttccttatgcccttttcatacagtcacatttctatatctaatccatgcagcaaattaggcctcataattcagcgaagccccaagctcatacccaaaaatggctataactgggagtttttctgagtctactgtggctcagggggctgcctgatataataatgataatgataataacaacaaaagagggagtctctctggtcctactttggattggaaggctgcctaattaaacaatcaaagaaaaccccacaaaaatggctatcactatatatatcatagtccagacaactgatgagattagaacttgggtttcttgaagcaagtaaacgctgatttatgtggcctatctggtaggtatgttggtattaaaatggctttaagaataatgaataaagtccttcatatctaaagaggtacataaagcaaatacataaaaacaaatactgatttgcaattatagtacttcaaagagtagttaaaagttgaaacgggcttattagatttaaaataagctttatgaaaaaaatttttttttgagacagagtctccctctgttgcccaagctggaatgcagaggtgtgatctgggctcacagcaacctccgcctcatgggttcaagcgattctcatgcctcagccacttgagtagctgggattacaggagtgcaccaccaggcccagctaatttttgtattttcagtagagacagggtttcaccatgttggccaggctggtcttgaactcctggcctcaagtgatctggctgccttggcctgtcaaagtgctgggattacaagcatgggccacggcacctggccctaaaagaaggtttttaaagactccagttagataaaaaaattagctgagcatggtggcttatgcctgtagtcctgggtacaaggaattcagcctaggaatttgaggcttcagtgagctatgattgcaccactgcactccagcttgggcaacagagcaagaaaaacaaaaactaaagaaagacaagctttttaaaaggacaaaaccagtaaaaatagaaacccgtgtcttcataaagaagatagaataaaactaaaggaattactagataaattatatatttaatccctttgtatatctttattagcctatttttacgtttttttttgagatggagtttcactcttgttgcccaggctggagcgcagtggtgtgatctcaactcactgcaacctctgccttccagtttcaagcgattctcctgcctcagcctcccaggtagctgggattacaggtgcccaccaccatgcccggctaatttttgtatttttagtagagacggggtttcaccaagttggccgggctggcctcaaactcctgacctcgtgatctgcccgccccagcctcccaaagggctgggattacatacgtgagccactgtgcctggccctattttttttttgttttttaagacagggtctagctttgtggcccaggctgaagtgcagtggcgcgaaaacagctcactgcaacctccgcctcctgagctcaagccatcctctcatttcagcttcctgagtagctgagagtacaggcacacgtcaccacacctggctaatttttgtattttttttggtagagatggggttttgccatgttgcccaggctggtctcaagttccgtggactcatgtgatctgcctgcctcttcctccaaagtgacgggattatagggatttttattagtattaaaaaaaagttatcactggtttggtatatttctttctatttttcttttgtgagacagagtgttgctgttgcccaggctggaatgcagtggcgtaatcttggctcactgcaacctctgcctcctgggttcaagtgattctcgtgcctcagcctcccaagtagctgggtctacaggtgcacaccaccatgcctggctaatttttgtatttttggtagagatggggtttcaccctgttggccaggctggtctcgaacttctgacctcaagtgatttgcccaccttggcctcccgaagagctgggattacaggtgtgagccactgcgcccagccctgaatttattttaaaagattttgcttcatggtttctgattgaataaatgataacaaaaatctcgtgtctttttgcctcttatctctttctcagtttccttatcttcttttttcaatacttgtttcaggctaagcatacataatttgaaaaagagtgagaagtaaagagaaagacacatcagactagaactagtctccgtgttataagctctcataacttaatacactttccctttatgtattaaacatttattatattttgtgattatttggttaatgtctgttttcctagagagtactagatagtaggcccctcaaaagcaggaaagatgattgctttacttgccactatattcctggtgcctgacacatactgggtaatcaataaaagctgaataatgcacacacattcgttttctttttctgttttttaatttttaatttttttttttttttttgagatgaagtctcgctctgtcgcccaggctggagagcagtggtgtgatcttggctcactgaaacctctgcctcctgggttcaagtgattctcctgcctcagcctccccagtagctgagacttacaggcacctgccaccatgcccagctaattttttgtatttttagtagagatggggtttcaccatgtggcccggctggtcttgaactcctgactcaggtgatccgcccgccttggtctcccaaagtgctgggattacaggcgtaagccactgcgcctggcccatacattcattttcatctgttcacttattttggtcctaagaggatggtttaagataactttaagataactacctgatgaaaaaactgcctttctatataagacatctttacaagggataactatatattcctaaatatccacacacctatccttcctatgagtatttcatgaagacataaaaatcacaaaaaatgaaattaacagcttggaaaaatgtctcagatcaaaattaaataaataactttcagtttattgaaaacaagggataacgttgtttttaagcaatacaacactgaagacccttaagatatttatcttaccttatatttttcatttgcaaataaaactgaggctctgtgaaatttgcatagagggttcttgggatcaatgacaatggctttgtttagggtatccaaagccttctctgattttttcagtgcatgttgaacctgtaagaaataaagatcatgttaatactccctcttgatatttatgaagaaaggtgagaaccaacgtgactcaaaaccaacataatcaaattattagagataaggttgtagggtctaactggattgtccactgcattaagtggatttagtaattaattaccaaatgattaatagattatctctaaaatcacttctaattctagttcaactgcttcactaaagatgagaatactgaagtctagagatcttaaataatttgctctgtgataaaaatctaggtcctctggtacatacctatgatgataatcaatagtctatctttagagcagatatttggttacctttaagtctaaaaggcaagcaaaaccttggtgttctattcataaaaaagatctgtactatttagccagataatattcacatttcatcaggtttatgcggtctttcaaatattagacttctcaaaactgtgttaacactcctgtttacaaaccttgtttcactcagaacaattatattttcaatattttaggaatttatttgaaaaatgattttactggccaggtgcggtgactcaggcctgtaatctgagcacgttgggaggccaaggcaggtggatcacgaggtcaggagatcgagaccatcctggctaacacggtgaaaccccatctctactaaaaatacaaaaaattagccgggcgtggtgtcacacgcctgtagtccgagctacttgggaggctgaggcaggagaattgcttgaacctggaggcagaggttgcagtgagccaagatcgcgccactgcactccagcctgggcgacagagcgagactccgtctcaaaaaataaaaataaaaataaaaaaagagaaaaaaaagaaaaatgattttactgttttacataattgaaaatcactgatctctaatactgggaagcaaataacttaagatattttaaataacttaaaatttaaaagatttaaaaagtaccaaacctcactattcattcatatgtgtatactaatattctgctatgctcctccttggacaaattatatgttataaagtggggtgggctgggcccggtggctcacgcctgtaatcccagcactttgggaggccaacgtgggtggatcacctgaggtcaagagttcgagaccagcctggccaacatgatgaaacccccgtctctactaaaaatacaaaaaattagccaggcgtggtgtcgggcacctgtaatcccagctactcaggaggctgaggcaggagaatcacttgaacctgggaggtggaggttgtggtaagctgagattgtgccactgcactccagcctgggcaacaagagcgaaactccatctcaaaaaaaaaaaaaattaaattaaaaaagtggggtgaatgaatgtatgaatgtggctgcagaactttaacaaatatcatggtcataagaatgtgagaataggtagtgccaacgtctgcttgctaaactcatctacgcaatgatctaatggtggccaaatattctgcccacaggactgagaccctaaatactagttcccgaaaagagaaaagcttactctcttacctgacaatttcttcaaataaaccactcaaaaatttaaaacaacctgttctacaataagttcagaagaattcctatttttaaaaaagtgttcaacttcaccaaaaggtgtcaagagatttaattttgaattgaataaataaggtgatgacaacaaaaaataattttaagtagacacattatctctccattttttccgtagtagctaactataaaagaagttactgtcaacttttttttcttgccctgtcttacggtgctggactatgtccatttttaagaaaattatcatggtcaatgtcattatagtcaatagagaattagaattctactctccccaagatagtgacatttcaaactaacaatttcctcacattgtatgaccattcccacaaaagctaaacttgctagggggaaaaaaagagagaagctgaggggagggagaaggggaaagggatgagaggatgagaacaagaacttaaggtaccgtacttacacagaagctaataaatgcgattttaaaaagcaaacaaacataatgtacatatcttttctcctgttaaagtaaaatttatttattttcttttaagagatggagtctcattctgttgcccaggctggagtgcagtatcaccttcttagctcacagcagccttgcactcctgggctcaagtgatccttgtgcttcagcctcccaagtagccaggaccacaggtgtgcaccaccatgccaggctaatttttaaattttttttgtagagatggggtctcgctatgttgcccaggctggtctccaactcctgaccttaagtgattcacctgcctcggcctcctaaagcgctggcattacaggcatgagccactgcaactggccaggagatatcttacttgagtcacagaacaaccctatgaggtaagcaagtagtacatgacattcataaaataaaagctcagagcaatgaagtgacttgtgcaagggataagggcaattctgtgattttttatgctaagccaaatgggtagtatttttgggtgtaataggctccagaatactgtttcaacacaaaaaaggaccaatttttatcacagcaattaaatcaataacaaacatatttcaaaagggagattaatagagtattaatgtttagaaagctacttactactccaatgtggcaaagtaaaactgaactttgagggttgatatcaagcgctttttggaaatgcatttctgcaaggctgaatttttcttgcttgtaataaatcattcctaaaccatacctgaaagtataaaacaaagtataattttaaaaatataaagtttaggttgctaatttagttcaattagtaaaagaacaagtatagaatctggcattttaataatccagtggaatactggtggtcttagaggagaggcaaaaaataccagttatgataaaaatcattaaagcattttatttacttatttttaaataaaaaaatttttttttgaattagggtctcactctgtcacccaggctggagtgcagtgggccaatcatagctcactgcatccttgaacttccgggttcaaagaatcctccagcctcagcctccagagtagctgagactacaggcatgaaccacaatgcctagccattaaagcagtttattattattattattattattattattattattattatattttaaagatagcacctcactctgttgcctaggctggagtgcagtggctcaatcacggctcactgcagccttgacctcccaggctcaagtgatcaatcctcccacctcagcatcctgagtagctgcaactacaggtgcacgccaccaggcatggctaatttttgtattttttgtagagatggggttttgccatgttgcccaggcgcatatatatatatatatatatatatatatatatatatatatacacacacacacacacacacacacacatacatatacacacacacacacacacacacaaacacacacacacaaatatacatatatatatatatatatatatatatatataatatatatgtatttttttgagacagagttttgctcttgttgcccaggctggagtgcaatggtgcaatctcggctcaccacaacctccacccacaggttcaagcaattctcctgcctcagcctcccgagtagctggggattacaggcatgcaccatcacgcccggctaattttgtatttttagcagagacggggtttctccatgttggtcaggctggtcttgaactcctgacctcaggtgatccgcccgccttggcctcccaaagtgctgggactacaggtgtgagtcatggtgccaagctgtttttttgttttttttttgagacggagtttcgctcttgttgcccaggctgtagtgcaatggcatgatcacagctcaccacaacctccgcctcccaggttcaagcgtttctcctgcctcagccttccgagtagctgggattacaggcatgcgccaccacacccagctaattttgtatttttagtaaagacagggtttctccatgttggtcaggctggtctcgaactcccgactcaggtgatccgcccgcctcggcctcggcctcccaaagtggtgggattacaggcatgagccaccacacctggcctacatatattttttttcttttttgagacagtcttgctttttgtcacccaggttggagtgcagtggtgcaatctcagctcactgcaacctctgcctcctgggttcaagcgattttcgtgcctcagcctcccaagtagctgggattacaggcatgtgtcaccacgcccagctaattttcttgtatttttagtagagacgaggtttccccatgttggccaggctggtcttgaactcctggccttaagtgatctgcttgtcccagcctaccaaagtgccgggattgcaggtgtgagctaccacccccagccttcttatattaacatatttttaattttttgtggagacgaggtctcactatgttgaccaagctggtttcaaactcttagcctcaaacaatcctcccaccttggcctcccaaacgctaggattacaggcatgagccaccatgcccagaccattaaaacattttaaagagtcacttttacaagcaaaaacaatcaaatcaaatcaaatcaaactatgataataaggaaaaaagaaaccacacccctaaacccatatagattttttttttttttttaattcaacgtcttgctctgtcgcccgggctggagtgcaatggcgtgatcatagctcactgcaggtaaccttgaactcttaggctcacgcaatcctcccacctcagcctcctgagtagttaggactacaggcatacaccaccatgcctaattgttttttttttgttttgttttgttttgttttgtttttgagatggagtctcactctgttgccatgctggagtgcagtggcacaacctccacctcccaggttcaagtggttttcctgcctcagtctcccaagcagctgggactacaggcacgcatcaccacacccagctaatttttgtatttttagtagaggcggggtttcaccatgttggccaggatggtcttgatctcttgacctcatgattcgcccatctcagcctcccaaagtgctgggattacaggcgtgagccaccgtgcccggccttaattgttttctttttttttttttttttttgttagggaaggggtcttgctatgttgaccaggctggtctcaaactcctggtctcaagtaatcttccagcttcagcttcctaaagtgctgggcttataggtatgagccaccatacctgtcatattctagatttaacagctaatttttactgagtagttattacatgtgtgccaagaccattgctaaattatctcatttaatccctagaggaatcataggtaccattatcatccttatttcgaataaggaaactgaaacttagagaagttaaataacttgcttaaagttatacagctaataaagattctaaccaggttcttccttaatgattctaaaggctgaactcctaacaatgctattcccacatttctgttttatattattataattatagcatacatagtgtcatgtttggcttccttgtcccccacttactgttatcaaaagcatgctcctatacttatagacctcaaaattacaatttctaaaggctatgtaatagtgtattaggttaatatgcaggtatttctcctgaattttcaaaatgtcaaatgaatatagtgtggatggtttatattacggagacttctcatggccataactagatgatgatgatgatgatgatgatgatgatgatgatgatgatggggaataagcatcaaatgaataagaaaaaagcacaacatatctgctttatttgagtggctttatatatcattatacttgtgttatagatgaagaaaaggtattaaacactatgctaatgatagtgaaagtgaaaacaaaagaaaggctatctattttgtacttagaataaagttgctcagtatttagttacctaaatacgtcagcatttaaactcctcctagtaaaagcttgccaatctgaataatcctcctttaaacacaatttttgatatggttaagttttttaagaatgcaactcctgcaaaatagctgaacagacaatacacatttaaaaaaaaaacaacacaaggatcaaccagacttgggaaaaaatcaaaaacaacacaagtcttattaagaactgagttcctggccgggtatggtggctcatgcctgtaatcccagcactgggaggccaaagtgggtggatcatgaggtcaggagattgagaccatcctggctaacatggtgaaatcccgtctctactaaaaatacaaaaaaaattagccgggcatggtggcaggcacctgtagtcccagctactcgggaggctgaggcaggagaatggcgtgaacctgggaggcggagcatacagtgagccaagatggcgccactgcactccaacctgggtgacagagcgagactctgcctcaaaaaacaaacaaacaaacaaaaaaaaaactgagttcttaaaatattacagagaacatagctatcggaagagacagcagcattggcaagttgattgttacattggtcagcaaaagctagcactatttttttggccatctttcaggcaatgtaactactactgcaaaatgagacataatccattaacaacatattcacaaatcaaaaaatgttttagtaatataatgcttcagatttagaagcaaatagaatgatacaactcaactgctataataaccccaaagataaccgtatctgacaaaaaaactaccacagagttatggcttcagaattataccttatcttgatatttaaactattaagtcagtccagaaaaatacaataaatgtcaacagtaagtatggtgttgaggcagaaataggaccaaactttttcatatcttattcagttgataacaatatgacctaggtagtaatttcctatgtgtctacttatacacaagtacaaaaaagtaaaatagagatactgctaaataaaagggtacactaagttcttaatagtaactcaataaaccagaacactgtcaaaaagcagcaactagtaaattttttcaattttttttcctattatccaataagtgaattatgctattcctttccaatttcccaagcacttttcatcccaatcaccatttcggtgttcgaagaaaaagcaacaaagtaacaaaactaaacaaacaaaaaacaactacagtatctgcaaaagtttggtagaaggctgaaactgttgagtataaggatctggtattctattatcattagttaatttaagagtttgttaaagacgtacatttcataagaaaacattttagttagaagttattgaccagtatgtaccatccctaagtataagtaaccaaattcatgataataaagagctatctaacaagaaaaattagtaagtaccagcaccatcaatacgactttgtctttgtacttcattaccacttaccatgcattataatgtctaggattgactctgatagcatttcgaaaacaagctaatgctttgtccaattcttcagttaagacaaactcatgccctaatagagtataggcataagcgtaatttggatcaacttggatagctctctggaagaatttaattgcaatatcatgttcccgttgcagactgaaacagttccctgcagcacaccaggccttaaaaaaatgggaacaaaaaccaaacagaattaaaattttactttttctaaaaccaaatctatgactaaaatcaagcctcaacttagaacagaaagacaaaaatggaggagcttcagtagatactcaattctaattattcacagattccatatttgtgaatttgtctgattgctaaaatttatttgtaaaaccaaaatcaatacttgcagtgctttcatagtcatcaaaaggtatgttctcatttgaggttgaataatgtgactctaccttcttgttttagctctcatgcagagatgaccagggacagaaactctgtgggctagtttagtgtagtgcaagaagctttggctctggggacagttggacagaatttgaatcccactgctggcacttttaagtaggatggcttcaggcaagtcacctctgaacctcattctctctctttttttttttttgagatctggtcttgttctgttgtccgggctggagggcagtggtgtgatcttggctcaatgcaacctccgccacctaggctcaagtgatcctcctgtctcagcctcccgagcagctgggaccacagatgccagccaccatacctggctaatttttgtattttttgtggagaagggttttgccatgttgccgaggctggtcttggaactcctgagctcaaggaatccgcctgcctcagcctcccgaagtgctgggattataggtgtgagccaccacacccagcagcattctctcttttgtaaagaaaataggatctaccaggatgagttatttttaggattcaagattataatccacaatctatctctgtttcaaactctccatcactcccaggaacattggttcagtagcactaattcagtgttcatgttgactacagaattaccgcaaataatgggagttgactgtgtttaattctaagcttagatatgttacaaaagtatcattaaatatttttgagatgcaatgaaatacaatcttacaagattagagcatgtacattaattgcacctatgtcttacaatgacaatactaatttattttaatttaaaattattaattttttcaatctatgtaacttctgctcaacgaaccctaatcttggtgacaacagcaaatttaacgtagtcaaatctcgataaatcctgaatgaaatagctgctttgtgatttttctatttgtgaatctgcaccacacattctaggactttctcttcctctctgagtccctgactagagagagaggaaaaaaaagaaataagcgtgggtgacactaaatagtgtttgaattgcttggttcatctctatctgttgagggtgatcaaaaaggtaactatataagcaaagtattttggttaacatacctctggcgaatttttatccatgtctgttaagtcttttgacagaactgaaagagcaacatctttttgaagatgccaaagtgttgtagagtagatctccatgccttcaactctataattctcaatccttctaacctctgagaatattctttcagcctgaaataaaaaaaactagtaagagaaaacaagttgatacaatttatatatatacacagggaaagccctggtcattatcttcacaggatctaaatgctgccttgtattatggtttttatgtgaatgagtattaacacaaggacaaattcagcaatctactatggcaggtcaaatagtgatgtaaccatattgacagtcaacctagtatttatatacaagccatggtaagaacatgaactctgaaaaggaaatttgagtttctaccaaaaagaccgaagagaaatctatacaaagctacaattcaaaagaaaagtcaatatttccttctcaaaaacctcatttccaagttttaataatggcattacagaataactcttttttttttttttttttgagatggagtctcactctgtcgcccaggctggagtgcagtggcgcaatctcggctcactgcaagctccgcctcccgagttcacgcccttctcctgcctcagcctcccaagcagctgggactacaggcgcctgccaccacacctggctaattttttgtattttttagtagagacagggtttcaccatgttagccaggatggtctcgatctcctgaccttgtgatccacccgcctcggcctcccaaagtgctgggattacaggcatgagccaccacacctggccagaataactcttttaggaaagatgatggaagaatgatttctgtaacataaaatctatttttgaacaatttttaccgagaggttgtgccagaaaatttagagggaagaaacaggttaagctggctatcaatcctatggttataaatcctattgagccctgaatatacacaccaatattgtgtctgctaggaatcataggccctacctattaattatcctttcctttgcagcactctcttgacttcagggtctctcctcagctgcctcatcaatttttttcctcatcacattcacagctcccagaactgtgtttctctccctctaaagtttgaggatttaggttatataaaatcagtttcctagtttatcaatttaccaagttcaaaattctcagctgccagaaaaggtctaggtaataaaaaaaaaaagaaaggaaaagaaattttcacagtttagtttataataaggaatatctggactattcttaatgaaatgagtatgacagaaaataagagcattttaaaactgagtgcttaattccaagaagtggtcatatgatatataggaatagcttaacgatttgtaacttccttgcaatctcttaaaagttataaaggtaagtgtgcagccttgacctgcagggctcaagtgatccttccacttcagcctcccaagtagctgggaccacaggtgagtgccaccacacccagctaattttttcatttttttgtagagacagggtctcaccacattggccaggttggtctccaactcctgagctcaagtgatcccccttccttggcctcccaaagtgctggtattataggcatgagccaccacacctggccaagtttttcattcaggcatggtaacaagataaaagacctaccagccaaatataggtaggtaccttttggtttcaaagttttcagaatctgttgcttcctctgaaaaatgattatggcatagacaaaaagaaaaatgggaaaaaaactcagaaattaagttgaaacagaggctttctttaattaaatatttgggtcaccactataactaggggaaacaataaaattcatttatgttaaagtagctgtgaaacaataaattagaaataattttttaaatggcttttccgaacacagctcttgcctgtctgtgtatatgctacataccagtaaaggaccataatcgaaacatgggttttgtagcaatgaataagactttctgtcttcaactctctgttctgtactattcaaaattaaattatatgaataggtatcctctgtatgtattccctgtgggaaagaacacctttcccctagatctttgcatggatcatgaagggaagagtaaccttccctctgagtacataaaaacaaaaacaccatacttcattgtctcccagtttcctcaccatgcttcatttttcttcatgacttattgctacctgttcttatacatttattggcttataatctgtctgttgctagaatgtaagctccacagaggcaagaaattgtctgactagctgtaatacagagtctagaagagagtccaggatatcatatgcacagagatatatattgaataaatgaactgaaagcaaattaagcaaaaaacgaatcatatcaactttaatccatattagagatattttattaatatataggtttctaaaaggtttctttttttaagttgggggtggagaaaatgctttgggaagaactaaggggtaatataaattgggaattagaattttctttggctttaggttaatcattctctccttttctggtatagacagataacttaagcaacaaatttaattaaaatccaaagagtaaaaagccttgtattaaagacattgtgtcctcaattcagcacaattttctttatagcattcttcaagcttataaaacatattcgatgtcaaaaattcaccccagtaattaactctgtatattgcagaaaaataaataaatcctattacatggtaaatataaatatgtattttcagacacaactgaataggacacactctacgtaagaatgtctggatgacttgggtctctataaacctattccgagaagttgcaaagaatttaaattactccttaacacaagaaagaactatatctataaattataaatactgacaaaataaatatatagacattacataataaatactgatcttttagatctagccttcttaagcatgggcatttattttaatgaaattgaaattatctctagaaaggcatatataaccattttctatacttacttgcatgtactctgaaagttcaaaataggcccttccaatttggcacagtacccaaccagtattgtagtggtgagaaggtagatggctcaaaatatttatagcttctttgcagttgtatgaacacaaagctaaataacctttccccatttcacgaagaaggctcatcaaaccttctaggagaaaacaacatagtaaacaaaggaaaaaacgcaataaactagtctgcttctctagaaaaggtaattacaaactaatctattaaaaattccaacatctatataaaaaacaatgaaggtactgtaatgaacataaagaaatttacttaaaataagtacataataaaatacaaagataatattaagcatttaaaacagacctgctgctgctttttgtagattaaaggcctgaatctgaggtgtgattgtggatattttcccttctgaaatgatggaagagtccaattttgtaatttccaggctatcatttatgttaggttgagttattcctcctttattagttttactttttgtttttctgtttgggattttaggtggaaacttcatttttaattttttgctattctcctgtaaaagggaagaaatttcacacctgttatactcatgtattttagatttctcctcagccctttctccagtattagatataaaataaatgtacaatcttgattaattctatatttttttcagaagagagtttataaaaacaaaggtcttcaaagtcatttaattttaaacacagtaattctgaacataaattacattaactaatagtgactaaggtgtgtcagcattaagtgtagccctcttgtgaaagtatatcaaactctcatttattatttaaaagtaagaaaataagtagatgtaattctcagctcaccgcaacccaacctctgcctcccgggttcaagcgattctcctgcttcagcctcccgcgtaactgagattacaggcatgagccaccacgcccggttaatttttattttggaagagactggatttctccacgttggtcaggctggtctcgaactcctgaccttaggtgatctgcctgccttggcctcccaaagtgctgggattacaggcatgagccaccgtgcccggcctttgttttgtttttgggacaggatcttattctgttgcccgtgctggagtgtaatgatgtaatcagagctcaccacagccttgacctccccaggctcaagtgattctcccaccacagcctcccaagcagctgggatcaaagagtactaccatcccagctaattttttttttcagagatggggtcttgctatgttgaccaggctggtctcaaactcctaagctcaagtgatcggcccaccttggcctcccaaagtgctaggattacaggcgtgagccactgcgtccgccgggtctccagttttttttaacttttattttcaaataattttagactcactcttctgcaaatgataacatgtgacataaccatagtatatcatcatacccaggaaactgaaattagtacaatattatcagctaaagaccttacatggatttcatcagtttttatataaacccgtgtgtgtgtatgtgtgtgcatagttctataaaattttatcacgtgaatggatctgtgtaatcaaccaccacaatcaggatacaggactgttgtaccaccacaatgcaattcttttgtgccatgatttaatagtaacatcctccctagaggcctaactcctaataatcactgatctgttgtccattcctataattttgccatttcaagattattcctatgtcatttttaacttgagaaaaaaaattttttaattaaaaaagaatattatataatatttaccaaaggactaattaacttcacaaaaatcatagatggccctctaaattaaaacattttaaaattcgaaatagtctctttgttaacttattaggaatggagtcatcaatgaacagaaatgttagcaggcgaagcattaagtaaatgtgacatacagaaatctttaaattaccttggttgtggagctgtcactagtaaagagtcgtgaacttcttcgaggcagtgcgtttgggggagatgtaatagtggggctcaatacctgaggtgttgtactaaaaaaaaattataaaggaagacattaatattttacttgatttatgaccattaaccattgtttcaatttgggtatattttaaaaatatacattaattatataagtactctaaagttgatgaatttgatcagttcttttcgtggtttctctatgaaaacacagtatttaaaaatgagggactcggactggctttcctgcttctcagcttgcagatggcctcttgtgggacttcaccttgtgatcataagtcaataatccttaataaactttccttcatataaaaaaataaaaataaaatgactcgttactacaaaatagtaaagattatagcatagatcttcactctctctgaaattcttaatttgaactaaaaataatcctcataaaactctggatcgacaaatgataagcacatctataaatcaattatttttacccttcatttgcaactacaacaagttagagaaaaaagaaaagacagttgggcaaagatagtctaaatgtggggtatttgttaacaagtaaataccactagaactactaatatttgagaagttatttccctgtaaattcaaacagctatatcaaaggcttattctctttagagcgaaaggagcctctgtacatttttactttaaaggcaaaccctgagatatgagaatttcaatcttagcaagcaaacttaaaatctgaaacaatctagaattgacagtgggtaaacttgtggactaaactatctaaactttataatttatgggaaatcctactagctacctgagtctgggtcaaagaatttcagaaaataaaaagatatatattttcatcttttacgatatgtacatatgtaatatgtacagatacctctgtatatgcatgtgtgtgtatatcacacacacacacacacacacataaatccttttaatctgcatctgataaactaggagtttgataacgaaaggcttccaaagttcagaattagacttcacttcatatggagcaaatgacacacaacctttcttggatgatttagctaaaagtactatgccattctaatcatctctaaaaaaactttctaaatagaaagaacagacttccgctagtcatgacagagtaaaatggaataaatttattctcccatttcagataactacaaactgaaccaaatatatggaacaatggttttcagacactggacaataggcaaaacatttccgaggacagttctagggccaccttgcaggaaaaaagaatgcaaaatagagctcagtggtcccactgtgttgaaaagaaaatgttgagaatttgagaaagccaaagcagccagaatttgcaaggcagagcaccagagagaagagagctacaaagaggagacctacaaagatctgcagagggcttccctagagtcttcagttgaaaattgatcagtgtaggtgtttgagtgttatataataaagaatttgtctggtccacgtcccaggctcctgagatctactaagtccttggaattcctcaagtgacagggatgtctttgttattcattatgagctcctgggaccgtgcctgaatttatgctaatgaagtaactcctagatactttctggatgggtgctggctgtgctgtaaaggtcaaccatgtggccgggcatggtggctcacacatgtaatcccagcactttggcaggccaaggcaggcggatcacgaggtcaagagatcgagatcatcctggccaacatggtggaaccccatctctactaaaaatacaaaaattagctgggcatgatggcgggtgcctgtaatcccagccactcgcgggttcaagtgtaatcacttgaacccgggaggtggaggttgcagtgagccaagatcgtgccattgcattgcagcctgggcgacaacagcgaaactctgtctcaaaaaaaaaaaagtcaaccatgtgattagagggctggggctttgagccagcaacaccagcctgagctcctctgggaaggaaattgagttcaatcatgtggccaatgattccatcaatcacacctacataatttaaaaaccctaataaaaattttgaacaccaaaacttggctcaaattcctggtttgtaaacatactgatgcattgggagggtgagcccagaaagaagacatgaaagctctgtatcaggaccctcccatatctaatcctatggatctcctaattatgtcatctacaataaaactgtaatcattaagtatagcactttcctggactctgtgaggtgctctagcaaattactgaatgtaagagggtagtaggaatccttaaatttgtagccagttggtcagaaatgtgggtggcctggggaacccagaacctacaactgggcagttcagacagttcttgttggggactgtgatcttaacctgtggtgtctgtgctaagtttgggtagttagcatcagaattacattatagtactatagtgaagaaactacccaaagctggggaaagtattactgaaaagaagcagacagaataattactggatctcactccaagctgggaatagctcatactttcaataggcagagtgaagaaacctcatactaaacaggtttttgaggagagtactcaaagggtacttcctcaatggtgggacaagattagtccagactaaggctacttttgtctggacaaaatttaaaaggtaagacctgaagggatcaagctgtttccaagcaactttactgcatctcagaataaaactttaaaatacctaaaggaatgcaaaaatatccagtaatcaacaatgtaaaatttatagccaggcacagtggctcacacctgtaatcccaacaactcgggtgggtgaggtgggaggattgcttgaggccaggagtttgagaacagcctgagcaacacagcaagaccccatctctgcaaaactaaaaaaaaattagccatatgtggcacgtgcctatagttccagctacccaggagcctgaagtgggaggacttcttgagcccaggagtttgaggctgcactgagctataatcacaccactgtactctagcctgggcatcagagtaaaagaccctgtctcaaagaaaaaaagtaaaatttataataactgacatccaattaaaaaacactaggcagccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaacaaacaaacaaacaaacaaacaaacaaaaaaaaaaacactaggcatagaaaacagcaggaaaatataatctacaatgaagaggaaaagtaatataagaaacacttagaaataacaaagtaacagacttagtaggcaaaaacattaaaaaaatacaaatacatcctatacgttcaaaaacatagaagagactggatgaggtggctcatgcctgtcggcccagcactttgggaggccaagccaggactgcttcaggcccggaggtcaagatctgcctggacaacatagcaagaccttgtctcatagagaccttgtccttgtctctacaaaaaaataaaaaataaaaataatcagccacatgtggtggcatgtgcctgtagtcccagctactcaggaggctaacgcaagagaatcgcttgagccaaggagtttgaggctacagtgagccatagtagcatcactgcactccagcctgggtgacagtgagaccctgtctcaaaaaaaaaaaaaaaaaaaaggctgggcgcggtggctcacacctgtaatcccagcactttcggaggccaaggtgggcggatcacgagtcaggagtttgagatcagcctgaccaacatggtgaaaccccatctctactaaaaatacaaaaattagcagggcgcagtggcacatgcctgtaatcccagctactcaggaggctgaggcaggagaatcgcttgaacccaggaggggcggagggtgcagtgagccagattgtgccactgcactccagcctgggcaacagagcgagactctatctcaaaaaaaaaaaaaaagaaagaaagaaaaccaaatcaatctagagatgaaagacaaatgtctgcaataaaaaaacaaaacaaaacaaaaaacccaacaacactgggtgtggttaataacaggtctgacactgctgaagaaacattaatttgaagacatagcaataaacactatccaaaatgaaacacggagaggagaaagattggaaacaaaaatgaagaattagtgagctgtggggcaacttcaagcaatctaatatacaagtacctggagtcccagagggagagggtaagacatggacataatatttgaagaaataatgcccccaatttagccaactattatgaaaactataaacccacagatccaagaagctcaataaatccaaaggccgagaaacaacaaagctacactagagcacatcataatcgaattgcttaaaatcagcaattaaaaacaaaaccttgaaacagagaaaagacatattactacatatagaggaacaaaaatgagattgacagcagatttcttgtcagaaacaatataagccaaaaaaccagtaaagcaacatccctaaaaaaattgtcaattagaaattcttggccaggcgtagtggctcatgcctgtaatctcagcactttgggaggccaagatgggcgatcacctgaggtcaggaattcaagactagcctggccaacatggtgaaagccaatctctactaaaaatgcaaaaattagctgagcatgatagcacatgcctgtaatcccagctactcgggaggccgtggcaggagaattgcttgaactcgggaagcagaggttgcagggagccaagattgtgccattgcactccagcccaggcaacaagcaagactctgtctcaaaaaaaaaaaaaaaaaaagaaaaagaaagaaattcttgcctagtaaaaatattgttcaaaaataaagatgaaataagaactttttttctgatccacaaaagctgaaaaaattcattaccagctgactcgtactataagaaatgataaaaaggccaggtgcggtggggctcatgactgtaatcccagcacttcgggaggccaaggcaggaggatcacaaggtcaagagatcgggaccatcctggccaacatggtgaaaccccgtttctactaaaaatacaaaaattagctgggtgtggtggtgcacacctgtagtcccagctactcgggaggctgaggcaggagaatcgctttaacccaggtggcagaagttgcagtgagccgagatcgtgccactgcacttcagcctggtgacagagtgagactctgtcttaaaaaaaaaaaaaaaaaaaaagaaatgttaaaaagaagtccttcaaggtggaggaaaatgatatcagatcgcaatctggatctatagaaggaaagggcaccagaaattgtagttatgtgtgtaaatataaaatagacttctttttctcatttaaaaaaatttcagctgggcatggtagctcatgcctgtaatcccagcactttgggaggctgaggcgggtggatcatttgaggtcaggagtttgacgctagcctggccaacatcgtgaaaccctgtctctactaaaaatacaaaaattagccgggcgtggtggcacatgcctgtaatcccagctacatgggaggctgaggcagtagcattgcttgaactggggaggtggaggttgcagtgagccgagattgcaccattgcactacagcctgggtaacagagcgaaactccgtctaaaacaaaaacaaaaacaaaaacaaaactctataaaaagacaactgactgtttaaggcagaaaccacaaccacaataatgcactgtggggtttataacatatatagaaattaaatatattacagccatccctcccataaagactaagagaggagcacgaaagtatactattgtaaggttctgtgctatacatgaaattgtctattacttgaaggcaaaccttgataagttaaaatgtttactacaaactccaaacaacctttaaaaagacaaaataaagagcaattgctaataaggcaatattgaattgtacctccccaaaagatatgttgaagccctaagccccagtacatgtcaatgtgattttattcagaaatttggtttttgcagatgtcattgagttaagctgaggatatctgggttgaccctaatccaatataactgttgtctttacaagagggaaatttagatacagaaacacacatggaagatgaccatgtgaagacagaggaagatactgagttatactgtcacatgctaaagaacacctggggttatcagaagctggaggaggcaaggaaaaatcctcctctaaagattttggaaggggaacaaccctgccaacaccttgattttggacttatggctttacaactgtaagagaataagtatctgttgttttaagacactaagttgtggtactttgttatggcagccctagaaaactaatataggcaattaaggagataaaatggaatcaacaatacaaagaacacaaaattattaagagtgaatgttggccaggcacggtggctcatgcctgtaatcccagcactttgggaggctgaggcaggcggatcacctgaggttgggagttcgagaccagcctgaccaacatggagaaaccctgtctttactaaaaatacaaaattagctgggtgtggtgacacatgcctataatcccagctactcaggaagctgaggcaggagaatcacttgaacccgggaggcggaggttgtggtgggccgagatcacaccactgcactccagcttgggcaacaagagtgaaactccatctccataaaaaaaagagctgatgtttattagtgttagtctatttgtttgactctaaagtgaaatgtacaaatcggaaattatttttacatataatgttgctttgcaggaggtctcaagttccttctcacaacagagcctcaggcaatcactgcaagctggcactcaagaggattagacttaccattctgggagcattacaggaacatagaggtcttttagatagtcaaggaggtatatgcacacctgtgtgtatgtctgttttaaaatttaggtacatgttcacagttttagaaaggagaaagaaaattgtatcttccttttaaaatgttagctataatctattgagtccttgaagaggaaaagaaaatcctatctaacaccatttctgtgtggaaatagattcattatttgaagtttatttgtctgttatttttataatctgtttatagacatgcataatgtggggaaggggagtatgaaacctatctgtacctaaactatagaaagggtcatgtgcataagaagaaaattacaaatccatgaggcaatcagagtaaactaaaatgctgctttagttaactattgtcttctgtgcattacaaaactcaactcaaaattacattagtgttgtaagttagaggtttcaaattttacatcttcaaaatttacagtagttattctagaatccacgagagtcactatctgcctaaattaaagaaatgtaaagaatcaagttttatgccaagaaaagttgaataattacaatgataaataccttgtttgtggaccagaactttgtgtttgtgcaagaattggagttacctctcggctatttccactctgtgagaagacagactttgttccagtttggccgattctggcaacagactgtaaaacacgaaaagtctaaggtttgtgaattatgggctgcactgtaaatgataaaagacaacacaacgctcccatctacattttctcaatacaagcagccataatatactgtcaccttaaagataaactatttatatcatattgttaattattgttgtattagtatgaacatcagtctatttccctgttttaatctcacagtatttttacctctataatgtcttttcatctttcgctttttgtttcaaagactaaaaatccccagaagctattcttttcatctcattgtgaccatcctccatttattacataccttctctatttggggttaagtactaaaaaattttaagacagctaaattctcaagatttatgatttatctcattatacacagaaaaaaataataatacgataagattttatactcctttggcacttggtaacagttctaaaggagttcagaggagtagattttaaaaaaacaaccatctgattactttccaaaacctaaggatattgttctttagagttaatattgcttagtttttctaatcttcattaattggtttctgttcccttggagaaaaaaaaatctttgcttggctcttcagtcttctctaatttattcccttatttctattcatttccaccatctagcttctttaaatgatctatgactattgtatcagtgcactgtttttcccctttggctaccagagaattttcttcaaaacttactgttaccctgatgtcctgtacacaatcctcaaactgcatattataaataatcactaataatcactgtctcatcagatattaaaaccttattttagcctttcctgcattcaacatcactgatcatgccctactttttgaaactttgtgttacttccaaaacattacattatttgtcctgccacttcatttgctggccctttatccttctactatttttaaattaggtttactctgttctccttagctactctttctttccctaggagagcctggtcattttaatagtttcaattattatttctatcagcaggtcacattttttcctctatgactaactttctactgaatattttcatctaatgtaccaccacttcaaaataaaacttcataagccttcctccgccttttccaaattgggatcactacattcatccaagggacaaaagtcaactctggcttttccttatttatcaaagaactatgtacactgcactcaatacctggtttgatattttcagttgacactgcatgcagacctacatgcgtgacttttctgggaatgtcttgtaataaggtaagaggagaacagaggcagaagaggatgagagagcaatcttatctgggcactaaaatcatgtgcctgcccactgtcttaacttgctctggttattatggttattatggctcttctagttttggcctacttcacctggcatgctaactaccattttgttttgccttcttcataactgtaatgtttaaaacaatccatacacaaactattttgcagtcccttttaagtattcttggagttcctattatcactcactaaggagttattatagaaaaatcttttgcagattctaaggatgttcaggagtaaaatagtaaaaaaacaactataagaagaaacatgtttctattaaggtaaagagagtataactgttattcacatattagtatgacttgtttagcttccatttcttgaatatttatgaagcatggcaataggtattttatatatagaacctaatttaattctcacagaagttaccttgtgccacagatatgctttttaaaaatggtattttggcctctatttccatatacctataaaagggaacattataaaacaagagcctcagcagggcagtgactcatgtttataatcctagcactttgagaggccaaggcaggaggattgcttgagcccaggagtttgagaccatccctggcaacacagtgagatcctgtctctacaaaaataaaagttaaaaaaattagctgggtgtggtggtgtacacctatagtcctaggtacttgggaggctaaggtggaaggatcacttgagcctgggaggtagaggctacagtgagtcatggtcacaccactgcactccagcctgggcaggagagcgagaccctgtctcaaaaaaaaaaaaaaaaagcctcatgaaacttgccgcaatatttactataagtatactaccaaatatttttcattttcatgttaaaactatacatccatgatctaccaaaaatcttattatcagaaatatctggctttacctgagcaaattttttttcatataattattagtgttattaaaaaaacatatatacacagtggtagggacaagtaaaaactatggcagacataatttctgttatttatagtcaagtaatataaacaatattaattttgttttttaaaaaggaaattaaaaagtaaaaatatgattatgtttatttaactatatgctgaaataaactaaatttgtgagatacaatcttacttggccaaaagagtaagaagtctgtctcctactgtaaccaagaggctacaacaataatgacattcttttatatttagatcaccctctacctgctgggttcaaatataaggcaaaagcaattacataaagtaagattttccctgagattacctttaaaagattgaaataaacaagttgctttaatcaattcccaaactgcattttacatggaaaataccttttttgaaggggctccggtggatggcacatcaattacaggaggtgtattagtgtagttttgtaaataggatccatctccaggacttggggtttctaatggcaaaatcccaaaactgagaagaggttgaaatcaaggtgtcaaaaagtcatcaaggcatatataaagcagcagtatacttaaattagaaggtctaaaaggaagagaatggcaaatcagtcttagggacagtgaggatctgaggggcagattaaaaataagctgtgaatgtagactattccacccaccataactaaaattttaaaaagctatcaaacaaggaactaaactgagcaacaattactgatctcaggagatttattagaaataaagaagagtagctttataaatctaagatccaaatgatgagattacttcaaattcttggaatttatgggatttagacacaactacagagaaaatgtctctagagaccattagataactataactctccagagttgtaatctcatggtcatgctattttagtagttccccggcctcaggacctgattcatagaatttcttctagcatatatgtatatatttttttgagacagagtctcgctctgttgcccaggctggagtgcagtggcatgatctcagctcactgcaacctccacctgctgggttcaaatgattcttgtgcctcaacccccaaagtacctgggattacacgtatgtgtcaccatgccgggctaatttttgtaattttagtagagatagggtttcaccatgttggccagactggtcttgagctcctggtctcaagtgatctgcccacctcagcctcccaaagtgctgggattacaggcatgagcccccatgcccaacccattctagcacataatttttcattttgatacttttggatatgtatcctctgggctgagttcctgtatttatacatacatatacttctaataattttgataaaatattttatattaataggtgtgacagctaggttcagtggctcacggtaatcctagcactttgggaggccacagcaggaggatcactagaggccaggagttccagatcagcttgggcaacacagcaagaccccatctctacaaaaacacttaaaaaattagccaggtgtggtggcatgtgcctgcagtcccagctactcaggagtctgaggtgggaggatcgcttgagcccaagaatttgaggctgcagtgagctatgattgtgccactgcactctaacctgggtgacagagtgagatcctgtctcaaacaaaaaaaggtaggtgtcaaatttcctccatgttttggaaaaaggcactttaacagtaaccagtggtgccctgattataacatttcatgaggctcaccgctatccattaatgcacagccataaagacagtattttttaatgtgtttactacctaattaaggaatatttcagagttttaaattttcctccaattttttttttgagatggagtcttgccctgtctcccaggctggagtgcagtgacaccatctcggctcactgcaacctctgtctcccgggttcaagtgattctcttgcctcagcctcccgagtagctggatctacaggcgcgtgccaccacacccggctagttttttgtatttttagtagagacggggtttcgccatgttggccaggatggtctcgatctcctgacctcgtgatctgcccaccttggtctcccaaagtgctgggattacaggcgtgagccactgcgcctggccagtccaatattcaatatcaattttttttgagttggagtcttggtctgtcgcccaggatggagtgtagtggctccatctcggctcactacaacctccgcctcccgggttcaagcaattctcctgtctcagcctcctgagtagctgggattacaggcgcccgccaccatgcccagctaatttttgtatttttagtagagacagggtttcaccatgttggccaggctgttcttgaactcctgacctcaggtgatctgcctgccttggcctcccaaggtgctgggattacaggcatgagccaccgcacctggcaacatcactatttgccagtttttacttcattttctgaaaacagaatgcccctgtttccacagtgatttagaagttgctgttgtaataatctgcattactaacaatatgagttatcataagatcatttggtattatagcacatttgaaagtatcttgtttgacttaccttggggttaatggactaagagctgctggtcctcctaataaacttcgaccagtttttggtttattttgaacctgtttagataatatggaagttcctgttcccagtgggacagtatcaggtgaaattacagctgaatcaatataagacactgaggaatctgtattcaaggagtactttgaattggaagattctaaattcaatctgtttaattcctgaaacagaaaatttctaccaagtcattcacaatatattatttagttcagatcattctttgtagttttcataatattttgaacactagaatataagacacttacaattgtgtcctggggtgtttccgtaagaactgtctcaggctgtctgtgagataaactatgattaggtacttgtgttgtgcaagagttgggcagacagttgctaaagttctgtaaagatgtgaatttaaatgtttggtcaggatctggcttttcacctgtgaagacaaaaaaaaaaaaagtttgtctctgaggaagtgaggaatacatgtttttcaagtatgcataaatcagtggaaacaggaaataggccttatccaaactttaaaaatctcctgtccacttctgctaatcaaatttacccccaaaaaacccatctatcaatatatcataaaagtttaccagtaagataaagctgtaaatgaaaataaactacaagaacactaattttaaacataacaaatcgcagaaaaatgcagatttctgtgtttgttttaaagctgaaaataactagatctcatttttctcaaagtaggagatgaggttgaagagttaaaacccatcatattttacagtaaaggttgaagcccttctatatatacatagatgcaacaatgctgaaaaatggtcctttatgtatcctaggccaaatatactgagaaattctctccctgtactgttcaggtcttgtaagtttcaggcatttattaattgcattagaaattttattaattttcttattcagaaagcaattttgctagtgttaaacacacaatataacccattctagaggacaccagatacttgaaaatagattggttcaacagaagaatctactggatttaatctttgtgtaattttcagttatatgattcttgaaacataccgaagattctaacttattttttattctcaattttaactttgaaaaatatttttcttgggggtagatgatctgtattgctctccaaaaattaagtagcaggaaaaaaagaagaggagatgggaacccacccacctctcaaccccacccacctacctatttcacataatgattcaaagggagaccagaggaaaggatttaaactaaggctcttttggtaacattctgatcctttggcaagccgatctgtcttgctgtggagagaaacaagtagattaaataagctacaaaccccaaaacctgtatcataaacttttagtataaaaaattaggtaaaagttacagaagttcagagagcactctttgtgatgcttctctaagttaccaatttctcccatctgctaatctccaaatcaagtgaaagcgcacagaacatgaatcaaaagaaatgcttacaaaacaaactatcgttgccttcttgaatattactattactttaaacttcctgtcagatactagagttattgagggagatgtgaaaaacatccaaatccttcagtattattcttaatttttttttttttttttggacaaggtctggctctatcatacaggctgaagtgcagtggcatgatcttggctcactgcaacccctacttcctacgctaaagccatcctcctacctcagcctcctgaacagctgagactataggtgcgcaccaccatatccggctaatttttgcatattttgtagagaccaggcttcaccattgatgcccaggcgggtcttgaactcatgagctctggtgatttacctgtcttggccttccaaaatgctgggattacaggtgtgagccaccgcacctggcctttttgtattttcgtcgagatggggttttgccatattgcccaggcaggtctcgaactcatgagctcaagtgatctgcccaccacagcctcccaaaatgctggaattacaggcgtgatccaccacgcttggccttaatttttaatacaacattcccagtggtaattctgaaagtgatttaaatgctttaaatatagcataaatgaccaggtttttatttgttgttgttttttttccaggcttaattcactttatttttcttgtgtaaaaaccctatgttgtagccacagctggagcccgggtcctctgtacggagactctagtgtgggtcttgacgaggtggtcagtgaattcccgatagggagacttggtgaatacagtctccttccagaggtccggggtcaggtagttgtaggtcttagagatggcatcaaaggtggccttggtgaagttgcccagggtggcagtgcagcccctggctgaggtgtagcagtcatcgataccagtcatcatgagcagcttcttgggcacacgtgccaagacgatgcccgtgctcctgggggtgcgacgaggcgcaccagcacagagccgcagtggcctgtcaccttgcaagggacggcgtagggcttgccaatcttgttcccccagtagcctctgcgcacggggacaatcgagagtttggccaggatgttgatggccctgcagatggcagtggccacctccttggagcatttaacacccagaccgacgtggccattgtagtcctcgatggcaacaaacgcctcgaacctggtgccctggctggcacgggtctgcttctgcaccggcataatcttcaaaaccttgtgcttgagagaggcccccaggaaaaagtcaatgatctcagattccctgatgggcagggagaagagatagatctcctccagggacttgatcttcatgtccttgaccaggagccccagcttggtgatgggaatctactccttatccttggccttgcctccacgagctccgtggcctcggtcccggccccatccacggctgcgaccccagccctggatgccactgctgaaacctctgcttcttttttttttttttcaaacaaactagaggtggtaggtctttttcctcccctctcccctcaagatctgtttgtggaggatctgcttccttaatgaaaaggaaaatttatgtttctttctaaatcaggtgtataaacgcttacatatggaatctggacaatatccctgggaacatatatacttggaaaaatctggggattatcagaacagcattgctgcctctctagctttttttttttttttttttcctgagagtctggccctgttgcccaggctggagtgcagtggcatgatctcggctcactgcaacctccaccttctggattcaagtgattctcatgcctcagcctcccgagtagctgggattacaggtgcacaccaccatgccagctaatttttatattttagtagagatagggtttcaccaggttggccaggctgtttttgaactcctggactcaagtgatccacccgcttcagcctcccaaagtgttgggattacaggcgtgagccacagcacctggtcgcctcctccttagcttttaaataggaggatggaaggggttagtggctagtgagaccaattaaagcattcaggtaaaaaatacaacttacctggtctgaagttcaaatgcttcaatatcaaatggaaaaaaattcagaacagcaattcttccaaaattctaaggttttatatataaaggaccagaagaaatctaaccgagatcctcaactgaaactatcaggtaaaatgtatacatcatctgtttatgtgcggaatgtcagtataacctcagagaactatgaagaaggtacccttggggaaccagatattagtttgcctcactgccaaattttcaagtgagtaaaaactagaaataagtgatatgacaaagaaagtactaccagttgaaggatatctagcttcccacacttgtgtaatttaagccaataaacaaatggacaaagtaggaagcagaagtaggatgcagacttttggaaaacataaataagttttatcaaagtctgtatctaagatcatttagatcaaaaatttctttcttttttttttttttaaagggataggatcctgctatgttgcccaggctggactcctggccttaagtgattctcctgcctcagcctcccaagtagctgggactacaagtgcatgctaccatggctggctaattaaaaaaaaaaaaaaaagttagcggtgttttgctatgttgcccaggctggtctcaaacctgggattacaggtgtgagccaccacaactggcctgaaatttcttaaatataattgtcataagactgacataatcacccaccagggatagagtggtaatttagaaataggaaatgaagaaagggcatacaaaaaaacatttgctgaaagtaatagggtggaacgtggcaaatcagtgcttgggagcttttaacataaggctaagcaaaagaaaatacacagccaggcacggtggctcatgcctgtaatctcagcactttgggaggccaaggcaggtggatcacttgaggtcaggagttcgagaccagcctggccaacacggtgaaaactcgtctctactaaaaacataaaattagccaggtgtggtggtgggcacctgtaatcccagctacctgggaggctgaggcaggagaactgcttgcatcctggaggtggaggttacagtgagtcgagatcatgccattgcactccagcctgggtgacagagcgagactctgtctcaaataaataaataaaaacaaaatacagtgaaatctcattgtttgaggattatcctaagcttcaaataggtcaatgaccatttcttcattttttttttttttcttcttgtagttcctaagtaaagccattccctcaggcctcagtcccttctttagaaaatctctgtctggtgagaatcccttctacagagatgacaactaaatctacttctaacttcaaccttacctttcctttgcctgatgggcaatttcatctaggttttacttccttatctaaagcttagtaaattcaaagtcaagttcatcttttctccccaaaatctgttctttctctttctttctgtgtgtgttttaaggacaccactatttttacaagtttacagactcaaaaatcctacttagagatagcactgactccttcttcttctcctctgaccttcacagccaatcagcaacgaagccataattcatgtactttcattttatttctggcttaagttccctctttattttcactgttaggatccttattgcttctcatctaaaccatcaatagattcctaattaatgtcttgcctcttcatcccttcaattcatctatctaggccccttctgtctcataatactaaccatagtctgcctatttatcttttcaagcattctctcttgcaagtgattataagctctctgagaatggagaattagtctttgccatttttatactacctgtttcctgttttcaagtagccccgtccccttgctttgccagcagaatgtgatataaaacagacatttttattaataattttaaaagttgcattagtgaactgtatgaattatttacatggccagaaaggaagtagacaaacattgattaagcaaagacaaaataatctgttacgggaaaaatattctggaaaagtaagaggggtgatcctttgtgctgaaaagtctcatttccagtattacttaaattaaaattgtattatttttatattaggaaaagaaaaaatcaaacttggttaagttggcaaggctgatttttataatgagtaattatttcatgaatagaccacaaaacagaagaaatttaaatcaaaattcatgtctgttaagagattagatacacatatggatagatatatgtataaatcacataagagctaactagggaagaagtcaggtgtggaattataataatctagcctggaagataaaacctctaattattcaatagagagataaaaggggacaaagatttaagaaaagtaaagtgctggggtactctaaatttagatcgaagtttttattaaaattgagtgatacacacaaaacccagccagaagtttcctaaagaactggcataaaaaatattatttaagtggtattgggaagaaataggataatttaggaatcagacttagtatcagttgtgtcctaaacatagaagtctcatgtgctgtaatagacaaaaagacaaaaaaaagtctatactggagatagaaaagaaaacctaacacaccttagctacaaaaccacatgtatgtatctagattactaggtgcaattctggtatataatggctaaaatgaaaagccaggattggggtagggttgttccactttcaatactcaatcttttaatcttgatgatgaataaaaataacccttggctgggtgctgtggctcatgcctgtaatcccagcactttgggaggctgaggtgccaggactgcttgagcccaggagcttaagaccagcctgggcaacatagggagaccccatatctaccaaaaccaaaaaaatataaaagaacccatccatattcctctgaagaaggagaaaaaagaacttccttgtttacatatatgtatacatacacacacatacctttctgaggaactgatttaactgcatctttaaaaaaactttaatgattttatctgaatagttcagtgccacatgacattctgttacaacagatcacatgtatgacaatagtctcataagattatttgtttcttttgctttttttgagatggagtttcactcttgctgcccaggctggagtacaatggcacgatctcagctcactgcaacctctgcctcctggattcaagtgattctcctgtttcagcctccccagtagctggattacaggctcgtgtcaccacgcccagctgatttttgtatttttagttgaggtggggtttcaccgtgttggccaggctagtctcgaactcttgacctcaggtgatctgcccgcctcggcctcccaaaatgctgggattataggtgtgagccaccctgcctggcccccataagattataatgccatatttctactgtatcttttctttgtttagatacacaaatatttaccatactgttataactgcctacagtattcagtaaggtaacatgctgtacaggtttgtggcccaggagcaataggttatacaatatagcctaggtgtgtagtaggctacaccatctaggtttgtgcatatgcactttatgatgttcacaaatgacaaaatcacctaaggacacatttctcagaacaaatccccatcataaagtgacacatgactgtataacatatttgtgattttaacttaatttttttaaactttactttggaataattttagacttacatagaacttgcaaaaacagtacacagttcccatgtaccctacacccagcttcccccaataatatctgacataaccatagtacagttatcaaaactaggaaattgacattagtacaaaactgtaaactacgctggacacggtggctcatgactgtaatcccagcacttcgggaggccgaggcaggtggatcatgtgaggttgggaatttgagaccagcctggccaatatggtgaaaccccgtctctactaaaaatacaaaaattagctgggcatggtggcgctcacatgtaatcccagctactccggaggctgaggcacgagaactgcttgaacctgggaggtggagactgcagtgagctgagattgtgcaactgtactccagcctgagcgacagagcgcaagattccatttcaaacaacaacaacaacaacaactgtaaactaaaccacagagcttatttgaattttagcagtttttacacgtttatatagagaatattatcacatttacaaatttctataaccactactacaatcaggatataaaactgttttaatatcccaaagaaacccctaaatagttacatcctcaccctaacccaacctgagaaccactgatctgttctccttcactataattctgtcagattaatgttatataaatggaattatagaaacttctgaaattggcttttttcacttgccataataaccttgtaatctatctaagttactatacatatcaatatagtagtttgtttctctttattgctaagtagtccatcatatggactagtttatctatttacttactgaattttgggttgtttccagttttgggcttttatgaataaagttgctatgaactcctgtgtaaaatatcaccttacattcccaccagcagtgtacgaggaatcctgctgcactgcatcctctcaccagcacttggtattgtcagtagtttttatttttagccattgtatctaatggtggtttttaatcactttccttaatggctaacgatttagaacatcttttcacctgcttatttaccatccatatactctctttggtgaaatgtccattcaattgttttacttattttctaattgaactgatttttcttttattactgagagagttctttatatagtctagatacaatctgtgttgtttatgggatttgcaaatattttctcccaggctgtgacttgtgtgtattttcattaatgtcttttgccaagcaaagagttttaattttgataaaatttatcaactttttattttatgtactgtcatttgggtgttatgtttaagaagtctttgcctaaccctagctcataaagatttttttctaaaagtttaatagttttatgttttacatttagatccatgattcatttgagttaaatttttaataaggtatggggtttaagtcaatgctcatttctctgcctatggatatccaattgcactggcaccattatttgctaaaaaggatatcattcctccattaaattgtttttcaccttcttcaaaagtcaactgaccatccaagatcctgtttttaattattttgtgtatgttcccacaagtggaattactggctcaaatagtaattctagtttcaattttctgagaaatagtattatttttatatatcactgatacatctgatttcctaattttttttgaagatttttgtgtatacatgtattcttaaggaatagtggcctatagttttcctttttagaacagtatttcattttggaatcaaggaaatgtggcctcatgagtagaggagtatttcttcttgttctgttttctggaagagattatgtagcattagggaagacttttaactacaaattaaagtttctttcataattttaggattattcagatttctatttcttaggtgagttttggtagtgtggcttattaagaaattggcccatttcatctaagttgttaaattcatgtgcatagagttgttttaagttttcagcatacacatcctttcactgtcctcagggtaggtagtgatattccttctttcattcctgatataagtaatggtgttctctctctttcttttttggggtcactttcggcagttttaccaatctttccaaggaccagctttggtttctatgattttctctattgtttttctgtttgcaatttcactgatttctactttttattatttccttctttctgtttgcttggatttactgtgctcttctttttctagtttcttacagtgaaagcttagatagcagagttgaaactgttcttttataacaaacatttagtgctataaatttcgctgtaagactttagcaacatcatagtttttaatatgtcatatttattatccctttcattcagttcaatatatttttaaaatctcctgtgagacttcctcttcaacccatgaattatttatttatttaatttttttgagatggagtctcactctgtcacccaggttggagtgcaatggtgtgatctcgactcactgtaacctctgcctcccaggttcaagcaattctcgtgcctcagactcccaagtagctgagattacagacgtgcaccaccatgcccggctaacttttttatttttagtagagacaaggtttcaccatgttggcctggctggtctcaaattccccacctcaggtgatccacccaccttggcctcccaaagggctgggattacaggcgtgagccactgtgcccagacccattaattatttagaagtatgtggtttcatttccaaatgttttgagattttcttatccatgtgtgactttttattatctaatgcaacttttttcaacagagtaatatttataatacttcattttagttaattttctaaaaataaaagaatatgatgctctttaggattatttctccaacattccttattaaaattttgccaacttctttcataaattgtctaccctccagtgtttgtacatcactcctctcaaataatttgtagtctttgaacatctattttcctctggaagtcactctatagatatgagatgttgtcaaattttactttttctatcaagtttttcctagttatcacaacccctcttcttaaccaggcaggactaattattctctcatttgaacaatataatgctcaaattttatgacagaacgtttaatgtgataataaaaacgaactttgagtgtggaaaaagcaacattttgttttttcctattctctcttaacagtaacaatcatcaatacagaagacttctgtgaccaaatgtctgggttttctaattccccctaaacacaccaagcatcaaacgccagctgaatgtccgctaattcaattctgataccatctacctgtagacagcctcaggtcccacaggttaagggctcagtcttcaagactgccctgccccaccttcagaaaccagtcacaagtctgggcctaaggaacttctgatcaactagctataaattgggattcccacaatgctctattcaggtttgatgaatttgctagagcagttgacttataaaggatatcacaaaggatacagatgaagagtgcatagggcgaggcatggggaaagagaggtgcggagcttccatggcctctccaggcaagccacctgccaggaacctccatgtgttcagttttctggaagctttctgaaccctgtccttttgagtttttacggaggcttcactacataggcattactgattaaaccattggctgttggtgataatcttatcaccaatttaatggtgaaacttaatcttcagctcctctcacctcctgggaggttgcggggtggggatgaaaagtcccaatcctctaatcctgccttggtcttttgctgccagtccccatcctgaagctacctaggggatgccagctaccagtcaattcgtttgcatacaaaaagatatcactttggagtttctaagtgtatacgaggaaatgaggtcaaagaccaaatatatatatttcactatatcacacttacaaacttttgtttactgtttctcttctcctactctattataaacctttgagggtggggactgtgagttatttatctttatattcaagccaagtatgactgtgagttatttatctttatattcaagccaagtgtgtttagctataatggaaatgaatctcaaagtttcttgactaaatgacaagaagaatcatagtttcatgaactaaatttattattctcagtccttaaggtaaatgaatatattgatattatgtctttgcttactcatgttcgcaagagtggtgttaatggataaacataccaccgttacacctgaaaacgggcccccaaacttagtcaaataatgtattctgttcagaaatacattttcaaggttttgaaaaataaccaatattcaaactagcctcaatttatcttaaaacagatgctatcctagttctttagacaagcagtccccagtcacttctcccacgggggagaagtgacaacagataacatttacacatgtgaagcattcccatgggcagagttacttgttctttttctttttttttttctttttttttttttggaaacagggtctcgctctgttacccaggctggagtgcagtggcacaatcacagctcacagcagctccaacctcctgggctcaagagatcctccacctcagtctcctgagtagctggaactacaggtatgtgccaccacacccagctaattttttatttttttgtagagatggggtcttggtatgctgcccaggctagtcttcaactcctggcctcaagtgatcctcccacctccacctcccgaagtgttgagattacaggcgtgagacaatgcacctggctatcttttcttctatctcctcagtggatcacataaagatactcttttcacccaaggtaaaataaactaacatggggccgggtacggtggctcacacctgtaatcccagcactttgggaggctgaggcaggtgaatcaccttgaggtcaggagtttgagaccagcctggccaacatggtaaaaccctgtctaccaaaaatacaaaaattagctgggcgtggtgtcgggcacctgaaatcccagctacttgggaggctgaggcaggagaattgcttgaaccctggaggtggaggttgcagtgaactgagatcacaccattgcactccagcctgggtgacaagagtgaaactccatctcaaaaaaaaaaaaaaaaaatagaaacaaacaaaaaaacctaacatgtatgatcaattgttaggcagggcagctgtagctattatcagtaaggataagtggagagttcaaacttagattagcatctctgctattttaataaggtcatagaatcagactatgtactactcagccaagtaatatttgataaacactgatcaacataggttttttaaactataaaacatacttgtatggaaatgcttttctgacagtttgaatcattcttacttaccaatatacatgtcccaacaatgaaagagtaaagcaagctgaatcaccaaactcagtaacaatatcatcatggcttttctgcttattaaacactccaccagataagatttgttccccttctgcaagcctttaaaatacaaatttaaagatttttaaaaaccaatataaaaagcagttcatgtaaacatattcttcattaccaaagtgcatctaactatggagacacaaattttttctctctctctctttccttttccttccttccttcatccctccctctctctgtcttcctttctttaaagagatagggtcttgctttgttacccaggctagagtgcagtagtacaatcatagttcacatggcctcaaattcctggactcaggtgagcctcttgcatcagccttgtgagtagctgggactacaggtgcacaccaccacacccagctaatttttaatttttttgtagagacagggtctcactatgttgaccaggctggtttcaaactcctgggctcatgcaatcctctcatctcatgggatcacaagcatgagacactgcacctggccaatttgttttttgtaaaaaaaattttttttaattacaatagtggcaaacacttatttagaatcatttgagaggctggaaatttatgatcttaaaatttcacttttacctttaaaaacagaatcaattacatttagtctctgtatgtacaaatccagtctgagcaacatattcattactcatgtcagaaggaacagaagatgattactatactgggggagaaaatataaatggttcttcattaacaaacatggtggtcctttttacttccttaaaatagaaatgtatatgcaaattaaacaagactaacatagtttaattaaaaattgcatacttatgcccggcacagtggctcaagcctataaccccagcattgtgggaggccaaggtgggaggacagcttgaacccaagagttcaaaaccagcctgggcaacatagtgagaccccatctatacaaaaaataagaaaattagccaggtgtagtgacacgtgtctgcagctccagctacgtgggaggctgagatgggaggatcgcttaggcccagatggggactgcagtgagccatcatcaccccactgcactccagcctgagcaacacagcaggaccctttctctaaaaaaaggaaaaaagaaaaaggaactggcaaattacataagaaagatttttaagaattccacattaggatctttgaaatttaaaagtaattcaacaacaaatgtctcagaaatttcagatattttagctagctttaattaaaaagccatcaattagtcactggacagataatatagttattgatcagtctatggtgagacttacttgtatcttccccttgtaaacctacaagccaattatacatacaggcttttacaaatatctaacaccgtttacacatgtgaccgtttagtcccttttaccattattccatctcttacagtacagaaaagaattgaatagaacctaactatctgtatctctaaatgcctccaaatttggtatagggacagctgacttggtttaactgtaatgtgcaaaagaagtactcaataaaatgatcttgaaaggaaactatacaatcacctaaacacaagggagccttaatctcaagtgagctggtgggttttcaggcttactcaaattggtctaacactgaaagcaaagaaaacgaaatatttgtgatcatttaagaaaccaataagaatcggttataacttaagtttctccagagttaaactctattatttattaccataacaatgaaatctccataatataaataatgccataggcaacagtgtaaacatttcgaatgttactgaaatagatggaaaacagggaagaaagggaatcagagtttaatctgaaaggaattttatccaaaattcaacagtgtaagtaaaacaaaatagctagaaaatattttaaaacttacttgctgagatcaacacaacattttgcaagcaggtatttgcattgcggtgtagtacaactgtgtcctttcaagagtctatatgctttatatgcctttcctgagcggtaataacaggttgccagtaaaaacaaggcttcttctgagtgtactaaaaacagacattttttaaaaaggctattgttcagtatattgaatgataatcagtttatcatgcaataaacaagtttagcaaaaaaaaaaattaggcttgctattttaacacaaaacaatcacttattaattcaaatttgaattatggagaaacggtttgcttatagcaaagtcagttccttagatcttgattacttttctctacaagaaaccaaggaaataatacaatgaagacaatcatggtattctctgtaaatatttaagaaaagcatacacacacagaaacacccctgcctttaaacagactaccagtaaaggatcttgtttttaggtaatatttttctaataaatctttcgggaggatagaagtcaaatttcattagcaagagaaacctgagtgtaaataaatctaactaccaatatgaaataatttctatattttaaaaagaccagattgaaaaaaatccacttgttttgctttaacatcaaatatacattaaattatatttaagataaattataaattgtgaatgctcacaccattttaacattcagttgacagactatagtaacaataattaaattacattacaatagcaagagctgagttatctatcaatctgtccctcctttttacattaggaaatgccccctgccttcttaatgcaagtggcatttttcacccttatttagtctatgtctctactaaactgatcatcacttcacttctatccccacaatccagggtctacagaggcaacaacaaagaggatggaaagagagggaaaaccacaaaactgtgcttctaaaaatgggttatgcaataataccagtgagctgaaggatcttctaagccagtggttctcaaagtgtggtccttgtaccagtatcagcataacttggaaacttgctagaaatgaaaatttttgtgtcccatctcatacccactaaattagtaattctgggagtaggaaccagtaatctacgtggttaacaaactctgcaagtgattctgtggcattctcaagtttgagaaccactgttgtaaagtacaagacaaacttgccacatctttttaaatagttaacatcattctaagagtttggataaaaaagtaatttgaaattttatttctaagttttttgtcacagatatgtgcaagcaaaaaccaacagaacccttcttctctggtccatcttatggttttttatgaaaccacagtgtaaaaaataataaatagtaaatgataagaaattttggcagatgtgttttaatgagatgtatagtagtattagtgctgcagctacaaaaaaaaaaaaagaatggggcgctcactgcagtaggaataaactattaattttactgagctacaacttctaatttacataagttagaaagtttgatttcctctagattttacaatggtctggtttcttttcaccttataagtttttaaaaactattgattataccaataaacaatggctcccacaaactaatttaactcccagtcacagtaatgctgtctcaattgtttacaaatatttgattatgtgtaggtccactttcactgcaataaaattgcctaataaagacaccaactattctttttgtgtgtacatgtgcgtgtgtaattttagtgtaatactgcaattagctttttgaagcatagtaacttaaaaattatatgttcaaatgggaatacggattggtgatttaggcaaaacttaaaaataatgaaactggccaggcgtggtggctcatgcctgtaatcctagcactttgggaggctgaggcaggcagatcacctgaggtcaggaattcaagcccagcctggccaacatggcgaaaccccgtcttctactaaaaatacaaaaattagccaggcgcggtggcgcaagcctgtaatcccagctactccggaggctgaggcaggagaatcgcctggacccaggaggcagagactgcagtgagccgagatcgtgccaccgcattccagcctgggtgacagagtgagattctgtttaaataaataaataaatataatgaaactgtcagataaggaagcaaatccagagcaatctgaagtgttgtgacacgggtggtttcttaggctcctcacaagtaacttggcagcagaaaaagataacagtaccccaaacacaactaaagaagcagtggtaagcagccataaatctaaaaagcacagaatatgtttactggataggattgacaaagatttcatctagaacagtaactccaacttacggataatggctgtctgaaatgccatgttcagaaaacttcttgaggctgatcatggcctagctaccaagagtagtgatcaaaataacaggatccagaaacagttatagatgtttgcatgtcacttatttaccatcctttatttacagacttaattaaaatatgggattagaattataaggtccataatatattgcataatcatgaatgaagttagcattgactccattaagtcactcttaaagtaatattgagaaatcaatcgtgtactagttaaattatgctatgtccatgtgatgaaaaatacagacatagaaagatttccagaatgtactgctaaagtgaaaaaacaaacaaattaagcctgtaatcccagcactttgggaggccgaggcaggtggatcacctgaggtcaagagttcaaggccagcctggccaacatggtgaaaccccatctctactaaaaatacaaaaatcagccgggtgtggtggcgtgcacctgtgatcccagctactcgggaggctgaggcagaacaatcacttaaacccgggaggcagtggttgcagtgagccgagatcatgccactgcactccagcctgggcaacagcgaaactcggtcgaaacaggactatcgaaacaggacaggacaggacaggacaggaaaggaaaggagagagagaaagaaagaaagagagaaagagagagagaggaaggaaggaaggaaggaaggaaggaaggaaggaaggaaggaaggaaggaaggaagtaagttgtagcagcactactgaagttcctcttcttacaaacaggtttggcttcaaaattggaaaggtcttttgagtgtaagtccaaaataattaagaggggtttaaccttgcatcctccagatacatttacatcaaacagaaaggtaaattagtctttcaaagcttttaaaccagatagacgcctcttcttcacgctgatttataatctaaataagcagcctttctaaaatggaccaattttgacaaatttaaaatttgttgaggtgactgttctttacctagccttgataaactatacaaatatcagagaagccctcagaggttagagtactctgtggctaccctgtcatgaactctgatgttgtgtgaatttaagggcatagaacctatggaactttttatgatttgtgacacatgtttcaaattgattatctgggccaggcacagtggctcatgcctgtaatctcagcactctgggaggccaaggtgggcagatcacttgagtccacgagctggagaccagcctggccaacatggcgaaaccccatctctactaaaaatacaaaaattaatcaggcatagtggtgcatgtctgtaattccagcttcttgggaggtagaggtacaagaatcgcttgaacctgggaggcagaggttgcagtaagctgagatcacgccactgcactccagcctgggcaacagagcgagactctgtctcaaaagaaaaaaaataaaacaaatcgattatctgttaagttttttaatcaactataagtagtatgacatgtggattaaagtaccgactctgaagctagactgcttgggttcagattctggcacttcaacctactagctatgacttagggcagagttacttaacttctctgaccctcatttttttttcatccggtaaggactatgatacctacctttaaaggttgctgttaggattaaatgacttaatacatgcacagcaattaggatagtatctgacacatagtgaaggctgtatgtgctattattttaattattggccttctcttaaatttacaatacctgaatagatatttgatattaatgcagggggtacataagtgtccctgagccacatgctcaagtaattctatttcatcaactttttttttttctgttttcaattgtatggaggctatacttttcttatatttcattattcattctgttgttcagagtcatttctactgttgaacatttcatctacatatgcaaatttagcatatgaatactattctcaatgtttatcttttctacatttatttacatcctgcatttcaataccaactggttttatacctgttgttaatgatggggttaatagtgctcttaagtattttaaaaccacgcttagagtaaaaagaccacaaataaaagagggctggaagaagttttaaaaggctccttagtgtttgaggcagaaaatggcaatatatgaggagaaaaaagatggccaaattgtgcagggctttgtaaactgtgtaaagatttaggaacagatccttacaacaattagatacttctgaagggttttaagaaggaacataaatttgggaggggaaaaggaacaggcagggaacgggagataaggaaaattcagttagtggtatcttaggttagatttgaatatattgagtttgatgtgtctgtgaaacatccaagttaattcaatgaaaataggtgagtcttggatcaataaaggcctcaaaatgatacattattccacatctttagtagaattctggatattctttaatactgatcttaacacaatctggtaaataagtttttttttatatgttgccatttgtacgcatatatttctgtgagtttgggctctcagtatcctggttaatagaaaagaaacagatgctgaacgttttactctggttcagttctctcccactgagcctaatttactaaaattgatacacccgatgcaatctatacatcttacccactaatcactaagacaggtagaaaattggtgaacgattttacggtcatttaaaatgcattcaagtagggcgcagcagcacatgcctgtattcctagctacctgggaggatcgcttgagcccaagtgtttgaggccagcatgggcaacatagggagatcttgacttaaaaaaaaatgtttaaaaagtactaatattaaaaaataaagaccggatacagtggctcccgcctgtattcccagcactttgggaggccgaggtggacagatcacttgaggctaggagtttgagtccagcttagccaacatggtgaaactccatctctactaaaaatacaaaaattaggtgggcgtggccgcaggcgcttataatcccagctactcaggaggctgatgcaggagaattgcctgaacctgggaggcagtcagccgagattgggccactgcactgcagcctgggtgacagagggagaccctatctgaaacaaacaaacaaaaacattttgcagtgtgggatgtaaaacccacattaatttaagataaaacagtagaccttaagcaattttgaactctgggctaggaccctcaaaataacctaggaatacatgttgacacaaggttttcagctgtttctctttcttttcctttcactagttacaatcctcttagtctcatagagttccataggtagcaattacttatgaaaaaaatgcacacaaaacttatgtctggttgattttctgaacataactcttattttatatgtgtgtgtacacacacacacacacacacacatatctccaaagagctatcatagtagttgcattaatgtatttttttcctcatagtctaacactatttctatttgttgtatagcacttatttctattcattcttaacagttaattaacaaaagagaaaaaccttggtcaaggggatcaggtattggtggtgggaaagaaaaatacatgcttacaatgggggaagggaatttattggagggagatggtaaaattaggacagtttttccaaaacagcaaatctcaactcactagtggactgtgatgtcaatttagtggttatcagcctacgttaaaacaacaacaacaaaaccactcaatggaaaatattagagtgtatcatatctaataagggtaaaaaaaatctggccaggccacagtggctcacgtctgtaatcccagcactttgggagacggaggtgggaggactgcttgagaccaggagtttaagactggcctgggcaacattgtgagatctcgtgttctcaaaaatacaaaaattagctgggcatggtagcatgtgcctgtagtctcatctagtagggaggttgaggtgggaggattgtttgggcctgggaggtcaaggctgaagtgagaaaagatcacatgactgcactccaacctgggtgacaggctatctcaaaaataaataaataaataaaaataagaaaaaaaaaaaaaaaccctgaaaagtcactgtattaggatatgttaggggagagggaacctgtaaaggactttctatgtgccagaaactacagcagactctttacatattttactgtatttagtccttaaaactatcttgttaaacagatatttctcttctattttaaagataaggaaaataaggctcagaatgacttttggcttaagatcaaatggcaaatgagtatctgaattcagattctctttcctttttccgttttttttttgagacggagtctcgctctgttgcccaggctggagtgcagtggtgtaatctcggctcaccgcaacctccgcctcccgggttcaagcaattctcctgcctcagcctcctgggtggctgggattacaggcatgtgccactacaccggctaattttgtattttttagtagagatggggtttctccatgttggtcaggctggtctcaaattcccaacctcaggtgatctgcccacctcagcctcccagattctctcttatatcattctgctgttccttctttctgatcccacagtctcaggccgactataaatctcgagagaaagacaaatgggcgacaaagaactagtgaaactgagaaattatttcaagaatttgacttacagaagatcctactgatcaactgctttagcctcatgccttgttggatgtctttctccaaatatagaaactgctactagtgacataggaggcccctgagcaaacaggttacatctagcatatcaactgatattgtccaccaagaaaactgttgccaagaattctgaggttggttcagtgggaatgagtactgtaatggattagtgatgcctactatggttgcaaatcagagaagtggtaattgctactcttgggaaagcggaatcagacagattactagttaccgcctgtggacattagtctcagttcttcatccagaaaatggcaatagcaatgtctatttgataggattattgaagattaaattagtaactaatattaaatacttagagtacctagtatacagtaagaaatcaataagtgatagaattattgttattattactgagccaggatagtatctgctcttactacacttaattctaaaatctttcctcatataaatatggttaaaccgaatggtgaggttctatattgaaagaaactaacatttactgagcaactttccaagtgccaagcattgtatcaggtacataaataacgtggattaaacagctttatgtggactaatctgggaatcttgccaccaattctatgggaaaatctaattgaattctaaaccatgaatttacaatttttaagagcctaactataataaactagaaactgcctattctttaataataaacaaaaacaaaaaggaaatactagaaatagaagacagtggccgagtacagtggctcacatctgtaactccagctctttgggaggctgaggcaggaggatcacttcagtccaggagttcaaggctgcagtgagctatgattgtgccactgtactctagcctgggcgacagagtgagattctgactcaacaaaaatttttaaaaatacagcaaaatatggggcctgcctaggtatcaatgaaaatatttttaaatagattattcacaataaacatcacttttgcataagtgaatggagtagattaatctattgtataatcttctttctaagccttccattccttctcacctttctaatcttttcattgggaccttaaactcctgctgcccagatcttcctcacttttctcactgaattcccattctccaccgaggagacagctctctcacatggacagtaatcaccttacatcccactatctcagagtcaaggtaaggctggtttccacttaacttctcaaaactacttccaagcattgctctttgtccttttgtgaaatttcctgcccctgaggtttaggccttgttctcacaactctcagctactaaacccatactgtttgacttgtaaattccatttaaaagtacataacccaaggaaatgactcaaaaaaaaaaaaaagctgtacacaatgatctatatcagcatcttagaaagggaattataataatgacagaaacaaaacatacattatcagtggtgtttattaagcattgattaccaagccagatggctgtgctaagggctttaaataaaccatctcattgaatttttaattctaaggggcaatgattattttatagatgaaatatctgaattttcagatattaaagtaactcgtccaaggttataaaactgtacatttaagtgacaggttaggatttgttccaaggctatagagtctaaatccatgttcttcaccatagaatacagactcttttcttaaaaaaaaaaaaaaaaaaaaaaaatacatggcatggtggcccatgagtataatcccagcactttgggaggccaaggcaggtggatcacctaagctcaggaatttgagaccagcctgggcaacatagcaaaaccctatctctaccaaaaaaaaaaaaaaaattagccaggcgtggtggtccgtgcctgcggtcccagctacttgggaggctgatgtgggaggatcgcttgagcctgggaggtagaggttgcagtgagctgagatggtcccactgtactccaacatgggtgacagagtgagaccctgtttcaaaaaaaaaaaaaaaaaaaaaaaaaaaaaaaacccaaaacaacaaaaaccctgggggaaaaaaaaacctaaagattgaaaaatgattaagtaaatcatagcatataaacctgaatcaattctacatagttattaaaagtagtatgtaagggaactacacagaaaaaaagtaaagattttatgaactagtgtcaatcagaaaaacaacaagatgatgatagctagaatcttgttacagtgataaaaagttatggaatttcatatatgttattcatttatcattctacagcaatgaatagatttcaaaccttctgcataaaggcgttctgcgaggaaaaccgcatctcggtaagcatagtggtttagtgcttgccatatagcagcctgcaaatggaggaaaaagaacataaatatacatacatacagactttcaaggtaactactagcacacagccttacatcaaatactgaaattaatatccctaatttaagtgataaaaccccaatgcccacagagcaaactccagagtgtgccgggcaaggctcttcacagtatggctcctaacatatctgaatttcctcactcaactctctatggacttttaggcttctgtgcctttgtacacccttttcctccattgggcaatgtgggctcccctcaccagtctccccttataaactgctcgtccctaaagatccagcttaaataacatctgccccataaagctttcctggctgatgtcaagccatttcttttttaagatacctcttctagtagagcactcataacatggttatttgttaacaggactgccaaccctactaaactacagacttttagcagcagtggttctcaaccactttatgtgatatacatgacagagatattaaaatgtatgtcatcctcccacaaaaacttccctatctattacctttaatgccactcaattctcatccactccaggaagcatattggaatgcaaatgagtaaagttatcataggaataacttttaattttttgaatatatgttttctcttttagaattacaaaacatataacctaaagtatatatgagatagaaggacattttaagtaacaataaccaaagacatttaggcccatgtactcaccacccagcttaagaaataaaatatctctgaaactccctgtgtgttccttgttgataccaaaacctctccctgccccaaagaggaaaccaccacactgaattttcttgacctttctcttggttttcttcacaattttatacatttgtacatatcatctctaagcagtataacatttactttttcctgtttttgaactttaaataaatacaatcatattgtatacattctgctacgatttgcttttgaaatccaatgttttgaaaattcattcttgatgtgtgtagctagagttcatttgttttcattgctgaataaataatatttccattgtataaacatatcaaaatccaaaatgtattttatctattttacagcatgtggacatttgggttatttctagggtgtttttttgttttgttttgtttttccaattataacaatgctgcaacagtcttagattcatctcctggggtatatatttaagaatctctccagcctatcacggtggtgtgagcctttagtcccagcgactcagaaggctgagctgggaagactgcttgagtccaggagttcaaggctatgatcatacctgtgaatagctgctggagtgcaataggagcaagactcccatcaaaaaaacacaaaaaagaatctctccaaattaggatatatatttaggaataaaattactgggttgttgaatatgcatatgttcatctttactaggtaatgtcaaatcatttttagtaataaactacttttgagatatctcacacctgatcatgatacaagcgttattttttatttttagcacatacaccagcttataatttgttgaatgatttaaaaaggttacaacggaaaccagtaaaatctggttactgatcactagctaacattgtaccagtacatctaaattatattaagtgattaatatgccttagatacagtaaaggctcaacaaattttgttgaacaaacaagtaaatgtttaataattctgcaatgagtatattaattataattttaaaaataaaagtagtaaatgacttagccctttctatttcctcaagaaagaacagtaatgaacttagtttgggatctccagagcctcttgtttaacctttgtttatatagcttaaattttataaagtctcaaagatgtctaattttaccattcctatctagatacaaggaaaaagatgagattaggcaccattattatacactctaattgcaccaagtacctttcctttgtaatacttcccactgctataattctgtattaatttaggagagtatttgagtgatgttttccttactatattacaaactccacaaggtaggggctacgtctgtttttgctcattattatactcccagtatccattatgtgcttttaaagcaggtgcttatatgttgaatgaataagcaaatgatctttaatttctagcagtcttccactgttgacactcttgtacgttagtcttagcattaagtttctttgtattcctagatgtatatctaataataaagaatctctgggagtctctattgaaagaaactctgtgataaatagaagaattattttattatgcaaataattaccaccaaattactcctttatgaaatctgggatttcctaagaacctacatgtttaattttgctgtaagtgaaagaaaatggtgagtagaatgaagataccaaagatttgatgtttggagacgtgctcaaatttgtgtgccagcacttccagtagtgggactttgtgggaaatactcaacttttctcagcctcaatctcttcatctgataaatggagtttatttattggagttgttttgtggattaaatgaaatgatccatttataatgctcctagtatactatcatacattaagcacttggaaaaccttttccttgccaatctcttaatataaagaaattcaataaatatgtagtttctgttgcataacatctccccagcatacctgctacaactgcttattttgcaatatataagccacaaaagactcaaatgatttaccagctattttactactatggaccactaggaaaatttcacacacatatactaaagtcaaaaagtcctagagctttgaaattttttctgtccttttaaaattaaagaaataagaggcaagggcggggggaaaaaagaaggaaaaaaggtatcatattcaagagttgtatccatttctgacttaaaatcaagctttgctcagaacatcattcccttatcaccagttcttaagagcatcagaaaaaacttgccatctcgagaatctcacatactgcttccatcccgctttgctcaatcaattctaagttcctgactaacagtgtctcttgtgccgggattggggggaagaacagattattctctaaggcactacagattagtagctgatgatgaacagggctaaaatcagcacctctgcccaactgatggtgtgggccttcccttaaaagaacacccagtgcattaccgctagagttctacaaattaaagccagatgaacgaaatgctgctaaaagaaagttatgaagccaaaaagaacaacgctcctctccctctcccctaaaaaatgtttaagagaaatctgactgattaatgggttagtccccaggtgcactaatttaaaagataaataaaccaacagcttaaagttgcaaaattccttaccagctagctattcttaaatataaaatattatttaaaatataaacaaacctctataagttgtacttagacttaaatgtaatcactataaatttttctctttttttttgagacagagtctcactctgtcacccaggctggagtgcagtggcgcgatctcggctcactgcaagctccacctcctgggttcacgccattctcctgcctcagcctcctgagtagctgggactacaggtgcctgccaccatgcccggctaattttttttgtatttttagtagagaaggaatggtttcaccctgttggccaggatggtctcgatctcctgacctcgtgatccgcctgcctcagccccccaaagtgctgggattacaggcgtgaggcaccgcgcccggcctgtaatcattataaattttttgttagagaaagcttattacaaaaaatttgtttacttgtttttgttaaattttttatacattttgtgttcttgtttttgtcaaaaaagctgtctttattttattttatttgttggtcttgaactccttggctcaagtgatctgtctgcctcagcctctgaaagtgctgggattacaagcgtgagccactgtgcccagtcagctgcccttttttaaaaaccataaaataaatggataataaaggcttcagacaatgtaagaagatacaaagaaaaaaatcactgttgaaatttcatattatacattataattgaatttctaggatactgatttagtttagatgcacgtcagtggttcttactctgggcaattttgccttcttactcccaattaatgccccaacatttagcaatgtctagagggtatttttggttgtcacaaatggaggggtcatccagtggttagaagccagggatgctacaaaacattctacaatgcacagcttccaacaaagtattagcttgccccaaatgtcaatagtgctcagattaagcagccctggtctacatgatcatgcagttggattattctactagtctgtatgtctaactcttgtctcttcctccctttccaacagcaccagataaatattcccaaagtggtgcttttattacataattcctctgctcaaaaactcttctgctcatataatggttattcattaccaatgcacattaaatctaaatttctcattgagtagccaaaatatgttactctttgaatccatgttagatgctgtccctgaacattttatccccagccaagagtactccttcaccatctaatgatctctaaaacagtatcatgtatatagtacccaattgctatattgcttattaaattaattttcgaaaggcttatttacaacttcatccaacacttctgtgaagtcttacccctaggaataattgctaaatctatataaaatctctttgcttcttttttaaaaaccaatttcaccaggtgacttttataaatattcaaaaagctctcactgaagtcacttaggctagtgtgtctttccaaatagttaccattaaaaataaaagaactgacagaaattctgcctcatatgtgagacttttgtaaggactcaaatataaagtaatactcttctgagaggtagtaatttgagacggagttttaatttaggcatatatggtatatcggactggccattctacattaaaactttaaagaaaaaaaaatgcagaaaacagttcttcatattttctgtgaactttttcctatgcctagtaataccatcaactctgaggcattccaagaaagaacaattttccaacttactctcattgctttccaaatacacgcaatctgtcatcatagttttttttttaataaagacagtatcttatatatctgtcctatttttattctcttcctaattctttcccatttgcagcactatccctgatcattgatctttatcattgtagccaaagttgcttgttcttctcactgttccaaatccattcttgaatggcttcttatactatacaaccaaaattttcacctagtcatatcctaaaactttctaccactatctcaaaaatctaatggacaatgctgctatgaaaaagaagcaaatttgacatttaagccttaaaaatatcaaagtgtattactgctcagagtactttaaggacaaacaggaaacctgatgggtactatctagaaacaggctacatattccttttcttttccatgcttttattttttatttatttatttattttgagatggagtctcactctgtcgcccaggctggagtgcagcgggaccatgtcggctcactgcaaactccatctcctgggttcaggcaattctcctgcctcagcctcccaagtagctgggattacaggcgcccaccaccacgcctggctaattttttatatttttagtagagacagggtttcactgtgttggccaggcaggtctcgaactcctgacctcaggtgatccacccgcctcagcctcccaaagtgctgggatttcaggtgtaagccaccacgcccggccttccatgcttttataaagtctgaaattattattaaatggtggttatagtctatcaatgcaactagtttatcactttagaagacttctggggccagagaaggcaaaaaaaaaaaaatcattaactattaaaacaaaattataagaatatgcaacagaaattaaataacttgagtaatctgcttatctatttaagttcatgttaggccttaaaaaattatatatatataattacctcatctacagccagaataaaaaaaaatcttaaaagaaactatactggtaaaaagaatttggatggaaatagctctagaaaaactaatacaacttacagacaggtaaatttcataagatataatcttacgttttattaattcaaacactaatagctgctatatgtaaacagctggagaaaaaaaccaaactagaagaaatgagtatttcatgctgtttagaaaaatgaaataaatatgaaagtagtgatatattaaaatatttactgtttgatacctcaagccttttaagggcaatatgaaggaatttctaaaaatcagtttgctttataacttcaaaataaagtccatgactcaatgacagcagttgatagaggtcaattctgatcaagttaaagatcatatagtgggatgaagtctcccagacctggtccattaccaaggcacaaaagatacagtttctccagatgtcaggggggaaaatgacttggcaccgcatcacacacttaaaatccaatagggttcctttaatgcaacacagcactgtgcgtcaaagcataccctggtgtaaaggcagtgaaatggacagaaacaccattatttgtgtttcatttcctgaatgccttataaacatgcacaacaaaatgctcctgatccccatcagagaggatgaaaacaacccaaatgtgccctttccacctcctcccctggtattggtgcttgcgcctcagcactgaggcttggagttgtcttctcaaaccatcattgtccggtgggaaattcaccgagaaaggaaacgtgggataggaagtctgttaccaaaatagaaattagtattaaaaagaccgatcctacgctccctccaccctctcatacaagacaaaataaaaaaaacctccgtaaacttgccctaccgtcacgaagatcacacaagctccgatcaaatgtgcttctcgatcatcttttaggcaagagagcgcttggggtgcattttcggcccctcatctcccacccccagtcaagccaggcccctggactgacaggaaaggctggccggacgttggctcggacgggaaaggcggttattttcgccgaagccgctcacgctaagggtgaagtaatgtagggccagaggtaacacggcttaggctgtgggcaaggcctccgaactgactaaagataggcaggacacggcagcaggggaggcgggagaagcagccgggcctaggccgcaccaggccgcggagtggccctacgctgctgcttcccgaccgaggctgccagccaagccccagagaagaaggttatcattacctggacgggttcctgcagcaccgtcatcctcgaggctcaggcccactttctgcagtgcctcaggccccccctgtagcggctccggcccggccagcccctgctcatttaaactcaccagcgaccgttaccgggggatgggggaggccgagcgattgccgagtgcttccgagcgggacacgggaatacccgaagtggagaaagccgagcgggaaccagacggaaaagcccgaagggagtcggaaatacccgaggttggtcgacgagagagaaaaccgttgccggaaattgtcgaagattaccggaagctaccgagtctgacccaaagcgtaggtttctcttctcagccacgccttcagccacgcacaccacgcccaatcggccgtcccagggttgggctacgccaaatctgcaaccagcaggctgggcgtggcgtgacagcgcgggcgggtagcgttacgtggcggggctgcagtgtggattagcccctcagcccttttggattaattggtgtgctgtagattatgaagcaaagggtgaaacagcagagtttggggctgtctttaatgaatcaacaagtatttgtctattgagtttagatcattcgtccattccagaagtatctactcacggctctgggggaaagctaaagaaatttggaaagattgccactccccaaagacataggatagcttctgtcttcaaggagattaaggtctatttaagggaaaagcagtgtaacagagaacgctatattatatggtgcctattataagtaatataaaaattcagagagggcaattgtgataagataaggaaagttctatggaaggaaaaaaaagtttaaaatggagtttgaaggatgggtaaaattagaggaaaaagaagtataggaaagtgaagggaggaaaaatgggatcagtctgctaagaaggcattaattggaaatagttacttaggtgaagagatcatggaaaagctcaataggccattagaaatttttatttttgataggtgaggcattccgctgtggtgggaagagtagggggtcggaaattcagaggcctggttttgaattttatctttagcactaactagtcataggtccttggcaaattacctctctgaacttatgttcgcttagtttgaaaaaaaaggattaagagaattcgatgtattataaatgtggccgtgtctagcatgcaatgtagactctctcatatttcctttctgctccccttctccccccaaaaagagtgaaccaggggactgtttaaattttgtttttcagcagatgaggaaacagtttttgaaagttacttttctagtcaggagctctctaggctagatgtgagaatcatgatatattccattgcttggaaatttccctttgggtgatgttagagggagatattttttctttcatttttaaaaacaaggctgacagagctacactgcatccttctccaccgccttgtcttgtcactgtatatatacttatagcccctaaagggcaggtgctaagatgatttttggctgccctgtgcccagttgctttagcgggattatgctggatgacttgagtggtaacagacttttacactggcctggaaagtagccattagctatttaaagtttaagttaaaatgaaattaaaaatgaagttcttcagatgccctagccacattccaaggattcagtagccctgtatgtggctagtgactgccatattggacagtcacacagatatagaagaacatcaccagcactggcttggctagggctgaaagattcaagatggcttcactcacatgtctagggtgtcagtggtagctattggctgggtccttcatttcttctctgcatgacctctcttttcacactggcctcttatgagtcagtagtttagctccagcttcttgacttggtggttgacaacaaagtgcgcaaaaatagaagctgtgaggtcccttaggcctaggcctgtgagcatcacttcttgttggtcagagtaagactcagagccaccctggattcaccaggaggaatagtctacttcttaatgggaagagtggcaaagtaacaccacaaagggcgtgtgccatgggaggagtttttgggtcatctttggaaacaatctaccacgctagatatgagatgagagtatctaagattgggaatggaaagaaagggataagtaagagctatcactcttaaaatgtgaccctttcaactgaacacagtactccagatttattctgaataattcagaatgcagttggactattattatctggacacgtctattaaagtggactacagttgtatttacattttttttttccgagactgagtcttgctctgttgcccagagctggagtgtaatggcgcaatctcggctgactgcgtcctccgcctccggggttcaagcaattctcctgtctcaacgtcccgagtagctgggattgcaggtgcgcaccaccacgcccggttaatttttgtatttttagtagagacggggtttcaccatgttggccaggctggtctcaaactcctgatctcatgatccacccatctcggcctcccaaagtgctgggattacaggtgtgagccactgtgcccagcctgtatttacattttttagcagtcacatgacactgtttgctcatgctaaacttgtgtggtcatttacggactcagctctttttcacacaacatgctgccaacccaagtcttgtatgtgtgcagcagagttttgtaaacctaaatataggaccttaccacagaggatacataaagatgatactttgtgaaaatatggatctagagtcagcatttaaagagcctctgatgcttggcactctggcttataggcttagaatttgcctaaagccttttttctttttttaacctaaaaaagagcatttcctggctgggtgaggtggctcacgcctgtaatcccaacactttgggaggccaatgcagacggatcacctgaggtcaggcgttccagaccagcctgaccaacatggagaaaacctgtctctactaaaaataccaaattagctgggcgtggtggcacatgcctgtaatcccagctacttgggaggctgaggcaggagaatcgcttgaacctgggaggtggaggttgcggtgagctgagattgcgccattgttctccagcctgggcaacaagagcaaaactccgtctcaaaaaaaaaaaaaggccaggcgcgttggctcacgcctgtaatcccagcactttaggaggccaaggcgggcagatcacaaggtcaggagatcgagaccatcctggctaacacagtgaaaccccatctctactaaaaatacaaaaaattggccgggcgtggtggtgggcacctgtggtccccagctgctggggaggctgaggcaggagaatggcgtgaatctgggaggcggagcttgcggtgagctgagatcgggccactgcactccagcctgggtgacagtgcaagactgtgtctcaaaaaaaaaaaagcatctcctttctgattgttgttgaccaggctaatacatctgttgtggtttctactcatccacagcaaagccacattgtttgaagtactttgatggggtattttggagtgtttttacttccttctctgctcctaattgacctacttaaactcgctattcatcaaccacttgggcatcctgctgtcatccgttatccaatatgtttggctagtgagtggagttgggttacaacagcattattccaaaaatggaattggaaaattattttttctcctaagcctgcttcttggtctatttcatattcagtcagatttggaggctggcatttagggaactattcaaaaagctagacgtgatatcagtagcaaaatgtaggtcccactgaaacatagcccagagtaagtgtactctcctgaagtctttcagtcctccttgtctgtacccttcattttgtccctgttgcgtgcggttttatggcctccttacctgaccttgcaccccaccacccccaccccaccctcaccatgtttactctttggtcaaatcatcctcttcttttggcttctctaatgacaccatctcctagctttcctcctactgctctgtttttgtttgtttgtttgtttgagagagtctcgctctgtcacccaggctggagtgcaatggcgctatctcggctcactgcagcctccgtctcctgggttcaagcgattctcctgcctcagccccctgagtagctgaatttacaggtgtgcgccaccacacccagctaatttttgtattttcagtagagacggagtttcgccatgttggctgggctggtctcgaactcttgacctcaagtgatctgcctgcctcagccttccaaaatgctgggattacaggcatgagccactgcgcctggcctactgctctgttttttaatcggtttcctttgcagctcctctgccagcccctttaatattaagcatgcttcaaggacctgttctaggccttcttctcacccaccctacacattcttcttaggcaaaactatcctttctttctttctttccttccttccttccttcctttctttctttcttcctttttctttctctttcctttcttttgagacagagtctcactctgtcacccaggctggagtgcagtggtgtgatctcagcccgctgcaacctccacctcccaggttcaagcgattctcctgcctcagcctcccgagtagctgggaccacaggcacacgccaccatgccaggctaatttttgcatttttagtagagatggggtttcgccatgttggccaggctggtctcctgaccttaggtgatccacccaccttggcctcccaaagtgctgggattacaggcgtaagccaccataccccgcccctatccattcttgtggccccagtttctcatctacaaatggtttgaaaaatttgtatctccagccagactactttttagagctccaggcccaaatgactaactgccaagaggacacctttatctggatgtctcataggtactttgttcggaatggaacccctcattgtcttaaaatatttcctatcccagtttaagatatcaccatcttttccattgcccaaaagattagataagggttagtttaacaaggtttgtacagatttattcccagcctcagctctgtctctggtgataagaatggctttctcctggtacaaggagggcatctttcacatggagttttatctactggtttcagtaagaaaaaggaaggccagagtgctcttcttgcatatgctgtttttcaagtgtatattattctcaaaataatccttatgccaaagtggcatatatcagtgtggcatattttgactctacaactccaatatctagtcgcaacgacctgccaattttacctcctaaatatatcttcatgtttcttccttcctgtatcttatctacctccaaaaataagtctgatcatgttaggactcctctccctgtcttcccccaccccccaaattcaggacttaccttcaggtctagtagctgcctctttattcagccttatctcactcatgtctcctttatagtccaccttccaattacatagaattttttttttttgagacagggtctctgtgttccacccaggttggaagcttactgtagccttaacctcccaggctcaagtgatcctctcaccttagcttcccaagtagctgggactacaggtgcatgccaccacgcctggctattttttgtatcctttgtagagacggggttttgccatgttgctcaggctcttctcgaactcctgagctcaagtggtccacccgtctcagcctcccaaagtgctgggattacaggcgtgagccacggtgcccagccccttcatggaactttttttttttttttttttttttgagacagagtctcactgttgtcacccaggctggagtgcaatggtgcactcttggctcactgcaaactctgcctcccgggttcaagcaattctcctgcctcaggctcctaagtaagtagctgggattacaggtgcatgccaccacagtgggctaatttttttttttttttttgagacggggttttgctcttgttgcccaggctggagtgcaatggcatgatcttggctcaccgcaacctctgcctcccaggttcaagcgattctcctgcctcagcctcccaagtagctgggattacaggcatagaccaccatgcccagctaattttgtatttttagtagagacggggtgtctccatgttggtcaggctggcctcgaactcccgacttcaggtgatctgcccgccttggcctcccaaagtgttggaattacaggtgtgagccaccgtgcccagccaagtatttttagtagagactgggttttaccatgttggccaggctggtctccaactcctgatctcaggtgatccgcctgccatggcctcccaaaatcacccactctcttgcctcacaggctttgcatgtactgcactctccccagaaccctcttaattccactcttcatcttaattctattcttcatctggctagctctgcttatcctccaaatatacttcttccaggccttttctgctcctctgggatagcttggctctccctgctgttactctagtgctaccagacttgtcattactcccatcactctttgctgtaattaattatctgtttaattgtctacttctggtctagtctataagctccatgagggcagaagccctgtctgccttgttccctgtgtattctcaacacttagtacagtatctggcatctaatgggaacttagtattatttgtttaatgaatgaatagaataaactcactgtgttcctagtattatttttgtttgttgattgatgttatagactggttgcatctcctcaaaattcatatgttgaagctaacccctagtgtggctgtatttggacatggggtctctaagaaagtgattaaagttaaatgatatcataaagatggggccctgatccgacagaattagtgtccttataaaaagatgcacaggaaagtttgatctctctgtgggcattcaccaaagaagggtcataggaggacacagggaaaaggccaacatctaggaagagagccctcaccagaatctgttttgccagcactttgatcatggacctctagcctccagaaccatgagaaaataaatctctaatgttcaagccacccggtgtgtggtatgttgttatggcaagcccaggtagacttatataattgattattctgtttatgtcttgtctccctaatgcaagggccaagtcttatatttctgtatattgttctttgaaaaacaccacatatgtagaaaattcttaagaaatatattgactgagtgattaaagtggaagtctttctacatattattctttcttcctgaaatacatttcccttactctttgaccagtgaaattctatttattcttcaagcctcagcttcagtatcacatcctcagaatattcctagacctacctaatttaaattcttagctccagcctgttattctctctcatgccatttttgttcttttctttcatagtatgtatggtaattttaatcgtatttgtttaatataagctgcattgaaggcagggaccttggtttgaacattatgtccccatcacctagttcagtgccctgcacaaatattataaaatatataaatattttttgttgttgttgttttgctaaaatattataatatttcgctcttgtttcgttaaaatattgtaaatatataaatatttttgaaatatctgatgattgaatgacttgatgacttaatttcatctcactgatctaaacatgatgctttttttttgactccccctttctgggcccagagaacatgctggtcttgcacataaatccttaaagggttttttttttttttttttttttttgagacagagtctcgcactgtcgcccaggctggagtgcagtggcgctatctcggctcactgcaagctccacctcccgggttcatgtcattctcctgcttcagcctcccgagtagctgggactataggcgcccgccaccacgcctggctaattttttgtattttgagtagagatagggtttcaccgtgttagccaggatggtctcgatctcctgacttcgtgatctgccagccttggcctcccaaagtgctgagattacaggcatgagccaccgcacccggccaaatccttaagggatttaaagtcaaggcagtatctgaagtattgagactattcagaaaatgcatcttgattgagatgagctccgagatgtgctaaatggcgtatgactagggcgcctagggctgactcaaaagcacagggaaataaactacagacagcccccaagttatgattttttgactttatgatggtgtagaagcaatgtgcagtcagtagaaactgtacttcagatacctatacaaccattctgtgtctcactttcagtacagtattcaatacatgagattcagcacttcattataaaataggatttgtgttagatagctttgcccaactgtaggctaaggtgagtgttctaagcacgtttaaggtaggctttgctaaactatgatgttcagtaggttaggtgtattaaatgcatttttgacttgatattgtcaactgatggtggggagcatctgtaataaaggcaggagactataagcaaattagcttgtctggactggaggctgtataagcttggttgaaatggtggtgttggggacagctgataaaaacctttgggttcctggctgatgactttagttttgataaaatagaccaaaggagctgttgatgatgattgagctggagagtgacctcatgagaccagaatttgaaaaagattatgctaacagctgaggattatgtgcattggaggagagaaagactaggggctaggaatgcagcagagaggctgccagggagtctgggcaactctgaatattcactattctaggatcttagatggttgaatctgaaaaaagatagaaaatttaaacagttttgagttactaacttaaaatgagaaatattcttatccaattccttgacctgaaggcattcagattctaaccagaagactgcttactgagtacagacttagaacaaaaagagtaaatttaatgatcttagtggctgtcatctctttttttcctcagaagtgacgtatatacctgactactagataaaaaatatctatagcatctggagtggatgcccaccaaataatagattatttgcttctctcttttctaactaggctctaagcagcctcattttttctctgggtaaattgcagagcaatggattaaacacagattgattatattttagtattcagtttacaccgtagctgtcttgaatagactttgtttttgttacagatatgtgatttgggagatagaggctgatctaggtttaaaccagactgagttgggagagcctcagatgagaaatatccaaaggttaattgaaaacgtgaagcttggccaggcgcagtagctcacgcctgtgatcccagcactttggaagttcaggaggatcactcgaggccaggagttcgagaacaccctgggcaacaaagagagaccctcatttctacaaaaaaaataaaaaaaactagccaggcatggttgtgtatgcctctagtcttagctacttgggaggctgaggtgggaggatctcttgagcctagaagttcgaagttgcagtgagttaaaattatagcactgtatggccaggcatggtggctctcacctgtaatcccagcactttgggaggccgaggcaggcggatcacgaggttgggagatcaacaccatcctggctaacaaggtgaaaccccgtctttactaaaaaaaaaaaaaatacaaatttagccgggcgtggtggcgggcgcctgtagtcccagctacttgggaggctgaggcaggagaatggtgtgacccccagaagtggaccttgcaatgagccaagattgtgccactgcactccagcctgggcaacagagcaagactctgtctcaaaaaaaaaaaaaaattataccactgtattccagctggagagatagagcaagactttgt

SEQ ID NO: 1234 - DNA, 24008 bp, Homo sapiens
caggtcacacaagtccctcatgaacagtcttccagcttcagcccttctcttgccacctctgtggtctgagctgggggagggggagggcctccgagttcccaaacaaaacacaggtacctaagggctgagagaaaattacacagccttatttttattagtatctatcaagaaaaaaaaaaatcaaaattcccttcctgctccaaccccacctccaccacctgggccctcagggagcagcatctgcccagcgaggacctgctgccggagctgtccttggagcctgggcacctgtgcacggccacccctcatgcctgtgagctgccacaggtcccttcctccacagtgtggggacgaaagggcagctggcatttctccaaccttcagctgtaggccttgggaacttggaaaagatcagcaatgtccagcagggctttgcggatgtggtttccaaagcgctgggcgttctgtgggagccaagagttcagatgcaccttcagatatgtacccacccctctgttcccacaagcaaggatgcctccccagccaaagacacctgtgttcctgggcagccccaggtggcaccccttcctcaggcctgagctgtggcaggagactcaccgtctctgagcttgagaacttgctggagatgtggaagaagatcgtgttctcgcctgcaatcatgtaggaaactccatagccatcatctgctacctgagggcaacaagaagggtgaagaaggcataaatcaaaccttgaagatctgaaagccaagctgatattgtacttgttcttcccacaagagttgcaggaacgggccccagccctagacactgcatttttcctgaggaccacccccaggaaactgtgaaaaccaaagaatgctgcccagaccccgccaagggatctgggacctcccagtttccctcagggggcttattctctagatcactccgtctctctccagagggttctctagccttctgacaagctagcccatgtgaaggtttctgtgggagacagctgcactctcttggataagtagacttcagaagcacccagtgcactgcccagtaccctggaaaccagccccacagtcatgcttcagtaccccggaaaccacggtcatgcttcagcagggaggtatttgggatgggtgggtcccaggtgcttggctgcctgagtccatagctaacattctgcttccatgcaggtctggggttatgctctcctctaagcaaggtgctcctgcctctcgtctgacctcagggcctgcactcgccactgaaaccctcagggccctggtgctgcccacccacccccttcaggagcactcacagggccaaagccacctccagcgcccaggtgattggggtgctgctctgggtcgaacatgcggatctgggattgggggatctggctggtggagagacgccagggttccgagagcacctgcaatggaggccacagctggtcagaggccacatacccaaagcacctgtccaacacgtggtgtctgcgacctactctgagccagacacggttctgctgagggtgcaggagctccctggccaccaccccgtggtcccctgtgcatcatgccacataaggcttgtgtgagctgcccagccctccctctgctctgcctctcccccacatagcctcactagtctcagtagtgctgtcaccacctgacagatcatatatttgtctgttccctgtcacaaggacaccaacaccacaaagaggatgttgctcctgctcagtcccaggaccacaggcccaggtggggtgtgggcgggaaagctggcccagcactccagggagcttcaggggagcaagccaggaaaacaggccgtgctccatcatgagatggcccaagccctgcgtgtaggagggcagtgggacaaaggacacacccaacaacggtgctgacctcagcaaggaaaggagagctgactcctaggtacttggagaccaagtaaaggcagaagaggtgcctgtcgatccctgccccggtcatggccaggcggtacatattctggtgcttcttagcagccttctggaagagatctcgcaggtctgctttctgcggggcagaagtaaaggggtgaagagtagccctggccctccaggcagacaggaggcagagggggcacctcacccgacgactgtgacccccacatgggcagaggacacttactgtgtgggacccctccatcatggcctgcacaaaggctgtggactcgctggtacaggaacgcacagtctcagtccgtccctcccggaacattctggtcattgaggcctcataggtcaggcagaacttacccctgtcctgggatatacagaggggtgaatctggcaggtggaccctggtaccaccctgccctctcagcagcgggaggcggggctcctacccggaagtgagccagctgcagcgcgatctgcacaaaggcatcagggctggtccggcacttcttgatgaggcctttgccaaagggcaggaactggaagcagtacaactccacgtcgtctgccaacgccttggccacctggtaggaactctcgatgaccgcctggcactgccaagacatgggaagggtcagctgagggtagggctctccaagcaggactctgggtcatgtctaggaggcatgacgtttagctggtggagaaagggcacagccggccaagacatcttcaggaggagggtacgcaaaagacagtctgagggagaatcagcccccagaggccgggctcagctttgtgggtaagagggaagtgctgaaaatgctccaggggcctgtgagtgcctcctccatctcatggctgtctctaaacacagatggccccaggggcggtgggtggtctctgtcctccctgaagccagtttggactctacaggtatcctgagacgtgccctgtgccttcccgagggctgggccaggcagtgaggccagcaggggaggaggaggctcaggcctcgtcggggctgtacccacctgctgctttgtggtctcacacctgctctgggagcttccaacccacctgttttggaatgtcccactgcagccgtgtaggaggtgcgagcgcagggttcggtttgcccaggcagtgcccggtctccgtgtagcccaggtggaagctgtctgtgcccaggacaaactgcagggagaggatgagactgagaggctggcctcatcccctacagcctgccctgcaggttccctctgcaaggctattacctcccagaggtgcccaatgatgggagcatctgcccacgcatgctctgcattgagacccaactggccattcttgaaggaaatgagagtgaaggatttgtcaaaccacctgcaggaagagtagacacatgaagaaccaaagctgggaatgtccagaggtgcctgacctgcaaccccaacctttaaccctaattactaaccctattctctctctctttttctctcactttttttttaaattgagatggaatcttgctctgttgcccaggctggagtgcagtggtgtgatcttagcttcccataacctcccgggttcaagggcttctcctgcgtcagccttccgactagctgggattacaggtgcctgccaccatgcccggcttttaaccctattctataacccaaaccctagcttttaaccctagccactagccctacccaaccactaatcacaatcctaactacttttatgaaggggtctcgctccgttgcccaggctggtcttgagctcctgcactcaagtgatccacctgccttggcccccaaagtgctaggatcacaggtgtgtgccactgcacccagctcataaccctaccttcttttatctttaatcctctaaccataaccctaacttttaaccttaagctgtaacctgtggggctggggctgccgtacctgttgtagcagttgccatgtagcagggccttgccatagaggctgaggctggcctcatcttcggggtcataggagtaggattcctcatccagggccacgaagaaagcggcacgctcgatggcctccaaggcagccttattctttccagagctaaagaaggcctggcgtgcctgcgcccactccaccctgaagcatggggcagggtaagcagtgggcacgtggacttgggatgagggtgcctctgagggcctggctggacctggagatgggggtggggtgccaggctggacctggagatggggggtaccacgctggacctggagatgtgggggtgccaggctgggcctggaggtgttggggtgcgtgccaggctgcgcctggaggtgggggtgtgtgtgccaggctgggcctggaggtggggggtgccaagctattttggagggtgtccccaccctctgcacacttcacctggctgccacccgtcagaggtaggttatgctggctgtcctgctgccatgaccaccaatgcccctcccctagttgtgcctccagcctccagttccagggtggcaggcagggccacgctcctctcctcacggagccctgaactcagggtggggacagtcccttcctagaggccaataccttcctcctgcagtgagggctgccagcttctcctccccaggctgaggtggggaggggtcgtccaggatcctctggaactgcatctccagatcctgaggcttgagcagacgggcgccctcatagagccacagcttgaagaagcgtcccttgtggtagacagccacgtgccggctgtctgagaggtgctgtagcacatctgtgatacaggccacgggcaagctgaggcggggcccccagctacatcctgggaagggcccacctcccatgcactaggtgacccctgcagaccctgttttgctcggcctctgcctgggccttcctgccccctggatgggatccgtgtgtcctaaaccaggccctgtgctgggtgcttccactctctctcacgcaacaccaacaatcctataaagtatttcacagaagaggaaacgacgcactagagggttgtgcaaaccgcctaaggatacagtgtcagaagcagggaaggctgctgcctctgccagacccctgggtgcgcccctcccctcctctgccggctccatggcagcgccgggtctgtcctaagctttgggctgcagcaggactcccttcaccatgcgcagtgagccccggaggggaggggctctgctctgggccctgtggggtccctgcgccagcatcatgcctgtaaacaatggatgtctagtatctgtcacaattgactactgttcacagtttcaggaccctgagacactggggacgcttggtgatgagcaggcaggagggcagcgagccagccagatggcccacaggtagcagcgagggggctcagttacctgtgtccttgcccgggatccgagtggtgttgaacatcctctccatctggtaggagcacataggcactatgcccagtgccatcacctgagggaaggcccagcatggctcagactcaggtctcccctcccatcccaccttcaaccctgacgcaactcacaggcttgatttcttcacggtccagtttacggcgatacatgatcatggcgtggatgatgtttcccaggcgggctgcctgcacgtctgtattcttgatgagcacaaggtcctacagaggaacagagcccgcggggtgggggcctctgtctgggtgtcacctgagtcttgctgacccaaggaccaatctattcgggggcctgaggtgttctgtctccctcttccagtacatcctgcacatgctgccggggtgaacctccagaaatgcacaactgatcgcagtaaccctctgctccagcttcagcctgagctgctttattctttattttttagagttagggtcttgctctgtcgcccaggctggagtgcagcggaacaagcatggctcactgcagcctcaaattactcgccctaagtgatcctcctgctgcagcctcctgagttgcagggattagagtcatgcaccaccacgcctggctctgagcttcctttttatttgtttatttatttttatttttaaatttttatttatttatttttctgagatagagtctcgctcttgtcacccaggctggagtgcagtggtgcgatctcggctcatttcaagctccacctcccgggttcacgccatttgcctgcctcagcctcccgagtagctgggactacagacgcccaccaccacgcccggctaattttttgtatttttggtagagacggggtttcaccgtgttaggatgctctcgatctcctgaccttgtgatccacctgcctcggcctcccaaagtgctgggattacaggcgtgagccactgcacccggcccgagctgcctttttataagctattttatgtgcttatattctacttcttttgctttgataaaggggttctaccactaaaaagcagtttaaaacctctgctatgggcaagttgtgtgtaagttcctggaaggacagcttatggaggagaattccagtaggctctggcaagtcaagtgtgctttggaccgtgggaaaggagagaagaggcatgccatacagcccaggtggctgggagacccagagactcagaagggccagttacatggggcagaggcagactgacttcctgagctctaaaagcagcagcctggcctccattctgctgtccggctctgcagagggacacaaagcaagacacgttctagacaattccctggttatggtgtcaggacagctgggaacccatggccaggaggccagtgaggaaaccaaggaaagaggtgacagagcccgagctgggcaggggcagtgaccccgggactctgagaagcggtggcaggctggcggtctccactctcctcatccttaggatccccattgcccctaagctgcttctggactcttctaggatctcctctctctcttccctttccctcaggcctcactccataacccccacttgcccacggaagctgctactagagctctgggctgtcctccagatcccttgccttggagctgggacagagctgagcacgtgcggggacctgggggctctagttcataccatgacataatagttgctgttcaccatgagagggctcctgcctcgaaggtagatgtactcttcccaccagtcactcacctgtggggaggtggaaggttagagctggggcgggtgcagccaggacacatggcaggtgacagtgagcccaggggcaggaacttacatagttacttgcccaccatgacttgagcaccaggtatttctgcagcctgggggcagtcttgtcctggaattctttggccagcaactccatgcggtaatattcctcatcatccaacaaggggcgcacagactctaggtactgtccagccagttatcatcaccgtggggccagatggcaagggctgcctctatcttaatcctcttcccacctctccctcctcacccagccccattattctcaagcccttaaggccactctttgcacagaaccttatatttggaaacatctcctgaatccaacctcccctgcccactgggatgcccaagcgaggccctcacccgctgaattgtggctgacaccctgggcacaggaagcttgggcagagatgtctggaagctgtagagcatagggtgccggctggatagaaggcggatacacatctgggggtacagagcagagtgctggggtgggagccagtggaaaaaatggaaaccaaccagcaactccctgagaccctcagagccatcccagcccctccaggacaaaccacacaccaggcaccagtgccctgtctgcctctcccgtctagctcagaaccccaaaggagtccaaagagtctcaacccaggtgcctgaacccctccactggctgctgctcacagcccagatcctggtcaagttgctggtcttgccatgcatctcaaacatccacccatggtagcagagaagcagcttcagggtttggcggaagaagaagatgcccgtcacccagacgcccgtggagaagatggccatgctgagaagtgcccgggtctgcggggtctggtaggggccacacctattggagaggggcaagggctgcagggggtcctcttgaggccagcctcgggtggctgtgaactgtctcaggggagacaccaaggggaagaacctccctgggcacactcatgtctgactgcatcaaatgagcggatgtagggctaagacaatggttgtcataggggagggctgccccgtgactgccaatggctgctgtcctgtatctgcccagctcaggaacctcagccttgggagctgggcccagccctccctggtggcacctgtgcccttccagtttcactccttacccctgagggaggcatctctggatgcaactgaccagccccaaggagatgtccacgttgcagaaggaggaacccactgttgccatgatgacgaccagccagctggtggggctgccagggtacacgcccctgaggatgccattctgtgggcagaaacaggcgcccttatggagccggaaggcgggaggttagcctgcctgtgaagtcttgggaactggctcctggtcttggcctggaaggctttctctcctgatgccctgctgtgctccttcctccgccacacccacagctccctgtgtccgaccacatcctgtgcacccctctggtgtctgtacttccacaacctgtaccgggcagaagtgccagccaaggaggcagtgagggaccctaacaaagcgcttaacagctgacagccggcctctgcctacgctctgggagaagcacctgtgcgcaccttgatgcggatcaggcgtttcttccaggagttgatcccagacaggtagacgtgtttcagggcctcccgactgagccggaagtcgaccccgtctggggtcaccgtgaactggaaggccacggcctggtgagcttccgccatcctgggggttggtcggcacctaggacgggggcagatgggtgcgcgggcgcgcttaggccggccccgccgccagccgcgccgagacgcccccagccagtccgcgacccctcgcgccccccaccccgcgactagcggctgcccccggcccgcgccccccgccaggccaaccgccgccaaatcctcgcgccagccttccgggtgggcacagccactgtggtgcaggggatttgggccttgaaagctccaggagccccaaggacggcgaagggcagcctggagttggggggcgtcagcgagggcgcgggcaggggagagaggcgcccctggaagtggagccggcctggacagaggcagggttcgggagcccgcccttccccacccgagcgcgcgggccccagcgccgtcctcgcccctgtgcagggctgagggcccagacccccgcgggccgccctgtgccggcccctactcacagctcgggttcactcctgtccgtgcgtggggccagccactctggcccgtgtccccacgtccttcaggcctagccacccccgccccgccctcaccaggaacctgacacctactcccaaatcggggtcggggaaaaacgtggggcgagaaccagaacccacccaccttccgcggtgggaattgcagggcgcggctgggtttctgtgcggtgaaggttgctcaaaggtctgggagcctggggggccccagagtctcgtgaggatggtggctttagagctaaaaatagccaaatgtagggaaaaggtcaccgatgtgtcagctgctgcctgttctgggatcgctggtgctccgggcggcatccccacctcagggtcgtcttcatacccccatcactctcctcctccccaagtcctagtatttattattctaagctgcagccaggggactggggagggatgggggaccccaactggcagcatgaacgctaaccactttcaatcccagagcactgaagagtccctttgtgtgtactgctcggtttggtactttctgctgctgctcagcagggccaggacagggtgggaagaagaagcttgtttattgtgttacatacacagcacggggctctggcctgccagccatggggacctactcaaactcaggaacaggccggtctcctgaacctcagtttcacttgggggctcagcccagtcgccagggccttctgctcgttgttcctccctccaaggtcctgccctggaggctccaggagaaatccaaggagtgggagggtggagtcaggatgaggagtggacactggtcagctgccccttctgctggaagtagaactggaaccgagactgggcatagtcctagggaaggaaacccaccccacacagtggtgagaagacgtgggaccagcattctacatccacctcaggctgcccacagccacccgggactccccaggcctcctggaagagtgtggctgctgctgctccccagccccccagctagcattcccatccccagggtcacttaccaagtaaccaaattctatggtggacatggatgcctggaggatggaccacagaccccagaagaaatgggatgccagagcatacctggggggagggcaggaaaaggaggggcattcaagagcatgtctagcactgcttggatcccctcacccaggttggccaatccctacagttttaacttctcccccactgtcctaactccactctccacagccaccttccctgcagcttgataaatctgcctcttccccaatccctctttcctctgctctgccctaccccaccctgcccctccttcctcaccgactgacttctaccagcaaatcttcttccagttttctctgctcctcttgggagagggtctcacctttctttgcctctgccaggtaatgacgaataaaatgcaactacgatcaatggccaagagtcaggaattggggagactgtggagtatttcccaggtaacatcctttccggccattccttccagactccacctccctccttcctcacaggatgggtcctgctccccagcctctggcccacatacctgctgttcttgagtggggtagtctgtgggccttgctttgtagaaaggccattcctcgtgagtataatcataaacccactcacaaaaatggttcccaatgtcaaagcccctgggagaataaggtggacattcagtccccaaatgccctgggcagctggcctgttttcaagagccctatgggaacagatctatgggaagccatctttccagcctcacctatagttataactgctgtactcgaagtccaccagcatgaggctgtcagcattttctggctctgagagcagcaagatgttccctgggggaatggggtgaggttctgctcactccagagccctctggctcttccatcttgggttaggagactcagatgccttctcctaccttcctggatgtcattgtggcagaagacgactggcgatggggtagactctagtaacttcctacaggggtatgggagcatgggtcctgagcaggagtgactagaggaggatcagagccaccctaacaggccaggccctgacaccagccctcagcaactactggaagggcggacaccattaccattagccttgtcctgcctgccctcacctgaggttgcccatctcatccttcaggctgtacatctccagcaggttcatctcagggaggccagttgggggcaggtcctggatctgttttaggtacctgaagcccaaagaataggatacactggctctgctattctttcccacccctcgcctatctacccctcaggccagactactgcacccctgctcctatcactgtgtgacttgtccggcaatcatttctttttttcttttgaaatggagtcttgctctgtcacccaggctggagtgcagtggcgcgatcttggctcactgcaacctctgcctcccgggttcaagcaattctcctgcctcagcctcccgagtagctgggactacaggtgcatgctgccatgcctggctaatttttttgtattttaatagagacagggtttcactgtgttgtccaggctggttttgaactcctgagctcaggcaatctgctcacctcagcctcccgaagtgctaggattacaggcatgagccaccgtgcctggccttggcaatcatttcttttttctttttttgtttggtgttttgagacagagtcttgctctcacccaggctgaagtgcaatggcatgagctcagctcactgcaacctccgcctcctgggctcaagtgatcctcccacctcacccacctcggctcccaaagttctgggattacaggcatgaggcactgcatgtggcctctggcaagcatttaaaagcctgttctgtgacagcccatgacatcagatccactcaagtggagggctggatagagcccccgacacatccgctggcatggaggttcagctcaggagtacaggagccctgaggaggctcctgactcaccgctccatggtcccaaacagccagtggggctccttggtgaaaggcatctccatgccatgaaattgcgccatcttcgtggcaatggctgctgacaacactggctctcgaagctcttgagttttcaatggccgactctgcacccaggaagctatcagggtggtgatggggctggggcaggagtgggaagggctggggcaatgaggggaagtcagggttttgggggaaattccctacttggggtgagggatgtggaggcagacattgggcactggggtagggttagggggtggaggtgccttggggaggagagggtaggactgggcccgtactgggatgtactgttccagccggccctctgggaagactccgtacagctggggccccagcgaccgctccgcaagtatggcgaacatcacgctttctagcaccagggagtccacgccctgaaaaaggatggacagcaaaggggccaaggcaaagtggcacagggacacacatgagggctcgccttcctcccaccagagctgcgacttctgatccaattgcctggaggctctggagcacaggctttagcgttggtctatttttatttagagatgggggtctcactatgttgtccaggctggtctcgaactcctgtgctcaagtgatcctctcgcctcagcctcccaaagctctgggaatacaggcccaggcttcggtgtaatgaggtgttactcagaccgtgaacctcggtgtcctcaactgcgcaacgggaacaatactacccgcatcgcgtaagcgacaggccctaaagccactggtgctgcggcgctcacacccccctcacctgcaagatggctccgtacagccgcagaagcacctcccggggctcctcgccaacgctgggcaggtggtccgggagcgagcagcggaagagcaggttgctgaggcctccgctgcagacccacaccaggcgcgctcagcccgcggccggccctacctgccgcggccccggccccctcccggccaggccggccccgccccgccccaggcgcgggcgcaagaggggggcgaaaacatggagcatcctgagggccccgcggctgacccctgaccccgatccgcgcaccggagaggctgacccctgacctcccacctcacggggtaaaccctcagctcctcgggctgcactcggcgccaggccccgcccaagtactcccggcaccattggtaggctcggcgctcggcgtcacgcgacagcgacgaggcgcgccgccgttttggggtagtgtccgggcacttagactgctgcaagccgtctttggccaggcagccgccaacagccccgcttccggccacagctgtcgcctcggccgccatggcgcgggctcgaccgggccccaggccaggctgcgctccgctcccttcggacgggctcggttccttccggccgcgctcggctcctcttccggccggcctgggcttctccggtcatactcgggtctctccggctctattcggctcacggctgcggcgctcggctctctccgtgccccggcccgggggctctttccgaaggccgaattccgcagatctctgccgggccccgcccctatgggcaaggaccaatggtctctctctgggcggggctgctgttggacggcctgggccaatccgaggcgccggaggccaatcagttggcggagcggcgcgtgcgcgggcgaggaactgcccgggcgcggtagcgtacgggaagaccggagaggagctgcgtctctgccccgtgggagccggcggggcggcggggcggcggctgcagctgcagctccggcgcgagggctcccttgccgggccctcttccccgacccctggggcgctccgacaaggaagagccgtccagcgcgcgtccgtcctgagcgtgggtgaggcctggaggaggcgcgcgcgctaggcagggccgcacagcgcgggcagagtgcgggatgcgggcacccggtgggtacgcagtaaacatttgctgaaggaatgtgacccttgggacagttccgatgactccagttgcataaatgcccagtctacacggggactccctggccggtagagccgcacctctgaatgaggagtcttttgctgccccgcttgagatgcgcgtcttcattcattcccctctccccctatcctcctcgtctcctccaggcctagaaccaattacagagtcaaacccaagagccgaagaaagtgaagactcgcagcttgccgcagccccctcctcggcctgcgcacctcccattgagggcgtcctgatttaaacgcgtgcctcctgcatttctgcttctgccccaggctagagcggcgaccaggaacgctggacccacagagatctgtggcaatgtctgtcgaaccatggtgttctttggggcatctgactagagtattgtttgataaccagaaagaaatcaaaaattggtgatcacaaggctaatgtcacttttgctgcagtggaaaatcatgatcattctgtttaaatctgagtcagttttgagacctagagcccattaattgacaaggaggcttggttcctctcaggaaggatcttacaataccagcatctgagcatataccaagaaatattcctccaatccttccctaaagggacctagagccactttaaaaagtaactggtccgggcgtggtggctcacgcctgtactcccagcattttgggaggccgaggcgggcagatcacttgaggtcaggagtttgagaccaccctggccaacatagcgaaaccccgtcgctactaaaaatacaaaaattagccgggtttggtggcttgtgcctgtaatcccagctacacgggaggctgaggcgtgacaatcccttgaacccaggccttgttgccgcgagccactgcactccagcctgagcgacagagtcagactcagtctcaaaaaaaaaaaaaaaaaaaagaaaactgattctggctgggggcagtgggtcacgcttttaatccctgcactttgggaagccgaagtaggaggatcgtttgagcccaggagtttgagaccagcctgggcaacatagcaagaacctgtctttacaaaaattaaaagattagctgggcgtggtggcaggtgcctgtggttccagctactctggatgctgaggtgagagaatcacttaagcccaggaggtcaaggctgcagtgacctgtgttcacgccactgcactccagcctgagcaacacagcaagactgtctgaacagcaacaacaaacacaccaaaaaaactagtttacttcggaaaagggactgtctaggtctttgaagggctgatacaggatctgagctgacactgtttccaggagccctgaagcatcatggccctctcattagggtgcaggcttatggaaatcagatgataagcagaattcccaacccgagtcctgtggttacttctctggtctcaatgcatacttgggatgtttttacctagcagagggcggagcgtatacattgatcccaggcctttggtaccatatgtaaggaagcgcaaagtagaaacctttgaaactcctcaccctactgaaacctttccaagatagtaagtcagaaacaatgctgcattccaggtgtaattgcagaggtatttcgccctcaaagacttataaagcagtggttaccgtttcatcccttcaattaacctgaatggctcctgctaaatcttggtggattcaagtaaatgatgatgccctgcacaaacttagccaagtcgtgtccccgatcacacagctgtgctaggtgtggtatctttactggaaccgataaatgcacctctggctcttgataatgcaattattgacttggtgaacattcttttcaattgccagtggtaaagaggattaaaagcagttcacatttatatgggaaggacagctctgtaaatggtcttgcttcttgctgtctgaactctcctgttctctgtcacaatagtccttaggtagcttatcatctatattccatataacattgatgatgtcatactagttggacatggtgaagaaggccgtgcatgtcagaggatgagcgagaagccctcagaagttctggagcctgccatatcagtgacattctcaggggtgcagcgtttgagggcaagccagggacaagttattgcatcctgcatccttacaaggaagaaagaggcacagcattgaggcacctctgtgttttggagtcagcatgcaccgcgctagaggatacctctctgacccctttattgggtaacgggaaaactgccagctttgagtggggcccagagaaaaagagggctctgctaaagatttggattgggagatgggcttccctgctgcatagatccaatgggttaccggggggcttatttggggtaggaaggaccctatatggcatctctggcaaactccaacggaagagttgcagtacactgtcctagagttcttggacaagaccatgccttctgcagcagagaactactcgccaagtgagagcagtatcaggcacactaccagacccaggtagagaccgagcacctgctggtgggacatcagcgaccatgcgacagggtctgcccaagcgaggtgttgtcagatcctccaagtcagtaggtcagaggctcagtagcaattgatggtacaatgaaaaaggaagccttgggcttggacccaagcgtgtctagtgggtaacagttatttacaggaagaggtggcagtgtggccccacatctgctttgcactgatatttctcccttagcagataagcattctggtctggttcgtatataggtcagtttgatgtgttgatatgaactgaaaatgaaccataggtacactacagtcccattcaaggtgaccctaaaggacgacaataggaaatcctccatggggctgagcttccagcagttcgtgtggatatccactttgtatggaggcagtggacagagtagtggcctgagggagggacgcatatggacttctgggttgtgacgtcctgctggctggtcagggacctgaaaagagcaagaggggaagatggacctacaggagtggccacacaatatgtgcatctctctgccttgtgttaatactgcagaggagttggtgaacagcaggatggatgggatgtcagtcagctgtgcccctggctacccctgtgcttgaacagtggactgtgagtggcggcgtcatgcagaaggagcacaggttagcgtccaccagcacaggccttctttctcaaggcttgtctcatgattactcctgctgaaagcgatcagtgctgagcccctgctgagataccatccctagagcaccccaactagttacttagtggcaagttggtgacagcccttcatccttgctggagttgacacctgctctggataagggtttgtcttctgtatccacagggtcccaggccagcatcactatccaggagcttcaggcatgctccgtgtaccaacatgggatcacgaatcacatcgcctcaggccaagaaagccattttatagcgaaagaggtatggtagtgtgtggatgaccatgggatccactgcttctctaatatcctgcgttacgtaaaagcagctaggctactggaaagatgggatgacttcttaagggcttagctgaggtcctggttctaggacagtatcctgaggagttgggatatatacactgaatcagagtctaatatatggtgctctgcccccagtagatacttcatgtggatccaagcagaaagacacaggtccaggaacccaagggttgggattagctacttctcaccatcattcccagtgcttacacgtagaatttgtacattctgtctccacagccttaggatctgctggattagagcctgtttcccaggtaggaacgcttccacgagggcactcctgctggttgcaggaaggatacctctgctgagcctgaatctgcaaagaccaccaggttactctcagctcctcatactggtggaccagcaggccacaaaggaggggatacttgatcctgataaacggtgaggaggtagcgtggctgctgcgtaacggggcaagcaggcattgatctggcacttagaggattcatctaggtctgtcttggtgcttccatgccaagtaatgacaatgaaaaggtcttttcagcagccatagcccctaagggctcagatgcctcagggtgaaggtctgggcagcgtcaccaggcaagccatggagacaagctggaatgctggtgagggtgaggccaaggaggaggtggctgctgaatatctgttacttgggagaagctgtggcagtggggattgtatttgttctgctaagcctcttgtattaaggctttcataggagttgtaactagcctttactttgaagaatcgtgacagagtagactcaatattgtagctgactagatctgagaggggcaggagatggtgtcttggctgatgccctcagcccacctttaactgcagtggacacagagctgcatctctgctgtgtgtctttgcacttcctgctccaggccttctctgacaccatggcggccccctgagcctgtgccgagattgtgccactgcactccagcctgagcaacagagctaaactccatctcaaaaaaaaaaaaaaaaaaaaaaaaaaaaggcgaggggaatacatacaggaatggactgtgaggatacaaagccaagaatgaattgtaggttagtgcaaatttatcaacatgagtgcacttcaaagagaatctttgattccgtattttggctcaaggcctgggagtagttatgaccgtgcctgggtggctgaatgaagcctggactccttggtggtttacattgatgggaagatgagaatgtggagtggatttgtgatgtatgtgacatgacctggctgccactctcctctctctatcccttcattagaccattgtgtaatttaaaaaaataggttataaatttcttttcaagatagtaaaggggtacgatcaacaacccatggaacgggagaaagtatttgcaaatcatgtatctgataaggagttaatatccaaaatgtataaggaacttacaaaactcaatagcaaaacaccaaataacccaatttaaaatgtgtaaaggacctgaatagacatttctccaaagaagacatgcaaatgaccaacaggtatatgaaaggggcccaacatcactaatcagggagatgcaaacaccacaacgagatatgacaacaacgcgatccacctcacacctcttagtttggctactatataaaaaaaaaaaacaaaggcaagagataacaaatattggcgaggatgtggagaaaagagaacccttgtatactgttggtgaaaaggtagattggtacaaccattatggaatacagtaaaaaattaaaacagaactaccatgcaatccagcaatcccacttctggatgtatatccagaggaaatgaaatcaatatcttggaggatatcagtaccagcttattcattgcagcattattcacaatagccaagttaggaagcaacctgagtgtgcgtcggcaggtgaatggataaaggccaggtgtaggtgctggctagggattctaaaattatgggaaaactggaaaattgatattagggcaccatctgcccctttggccatgccctctctacttcctgtatacaaaactcactcaccttatccttaagggagaccactgtaaaagttctaactagttgcagcatccagctcaaaatttaggttctctgacttatatgcaatttgctccttcaggtccagaggtagatccttgtggtccagtgacttataaaaggtttgtcattcatcctccaacaaactcagtgtacactagtttaatccaatgtcgtataaactaaaacatattttatgtgtcccaaacatacaaagaaagattaagggccgggcgcagtggctcatgcctataatccctgcactttgggaggctgaggtgggcggatcacctgaggttgggagttagacaccagcctggcccacatggagaaacctcgtctctactaaaaatacaaaattagccagcgtggtggcgcatgcctgtaatcccagctactcgggaggctgaggcaggagaatcgcttgaacccagcgggcggaggtttcagtgagctgagatcgcgccattgcactccagcctgggcaaaaagagtgaaactccgtctcaaacaaaacaaaacaaaacaaaagagtaagaattgggtaaatactacaaagaccccatatttagacccgatctctagtctgtggcacttgccaaatcctattgagcataaatagtgaagtcccctttcctggcagcgccggctcagttttctggaatgtttctccttgtctgttagacttcgtgtccacatctaggaggacactggagaggaaccttcttggaggctgcgtagtttcttctatgggatcaaatgcctcctggcttttgtagggattactttaggagctgaattgtcagagggtttgacaaactagattgtagtttctttggtgatacgatttctccacattttcagtagtgacattctagcttcataacatgagttgggaaggtttctgcctcctgtttcctgaaatgtttatgtaggattagtattatttcttccttaaatgtttgctagaattcaccagtaaggcaatctggatctggagttttctttgtggaaaggtttttaattggtaattcaatgtctttagtaattatgaggccattcagatttttctttttctttttgttccagctttggtaatttgtgtctttcaagaaatttgttcatttaatttacattttcaagtttattggcataaagttgttcatagttttataattcttttaatatctgctgaatctataatgatatttttgctttcattcctgataaggttatttatgtcttcttttttcttggttagtctagctagaggtttatcaatcttactgagttttttaaagaaccagcttttggtttcattgattaccctcaactgtgtatatattttttattccattgattctgatctttccttctaattcacttttccctttctttcttttctttcttttccttctttctttctttctttcttttccttctttctttctttctttcttttccttctttctttctttctttctttctttctttctttctttctttctttcttttccttctttctttctttctttgtccctccctcttcctcttcctcttcctctctctctttttctttcttttctttctttctgacagagtctcactctgttgcccaggctggagtccagtgacactatcacagcttactgcagccttgacctcctgggctcaagcgatccttcagcctcctgagtagctgggactacaggtgtgtgccaccacctggctagcgtgtgtgtttgtgtgtgtgtgtgtagatggggtcccactgtgttgccctggctggtctcgaactcttgggctcatgctatcctcccaccctggcttccctgctgggattacaggcatgagccaccacacctggctcctttatttttctttctttccagtctattacttttagcctatcttggtgtttatatttaacatttcatttcttgaggtagcttatagtttgtgtctcactttttaaatacattctgataatctctgcctttcaatctgagtttagatcatttctatttaatgtaatcattgatattattgggtttaaatctaccatcttgctatttatttgtcccatcttacctttgttccatttccacttcttttctgctttctgatggattgatcaagtatgttttcgtattctgttttattaccactcttagcttattaattgtgtcttgttgtagtttttaaaatgttttctctaggatttataatatacatttttaacttgtcatagtctaccctcacatgatgttatggcatctacatataatgtaagagcctccttacagcagtatgttttcatttctcctcccatcctctgtattggtgttgttatgttttacatctgcatatgtcttaaggctgggcatggtggctcatgcctataatcccagcactttgggaagccaaggctgaagaattcttgagcccaggcattcaagaccagcctaggcaaatagtgagaccctgtctctacaaaaaaataaaaaattagccagaaacggtggtatgcacctgtagtcccaggtgcttgggaggtgagagaatcacgtgagcatgggaggttgaggctacagtgagccgtgatcatgccgctgcactccagcctgtgcaacacagtgagaccctgtctctaaagaaaagaaaaagaaagaaaatgtgtgcaaaacccacaaaactataaagaatagtcaagcagtttgaaaagaaccaaatggaagttctaaaaggaaagttttaatttagttcaaattttagttgaattttaatttcaactaaattaaaaacttagtatgcatgtttaacagaagattataaataaccaaagcgagacttcatgagctaaaagataaatatgaatacagtatacagaatgctgcctggaaagacatagatttggaaaacctggaaaaagggttaagagacataaaggctagaataggaaaatccaacatgagcctaattagagtgccagaaggagaagagatggaatggagcagaggaaatatttgaagagataatggctatgaaatttctaaactaatgaaagtcacataattgagaaattcatataaatttatataattgagaacctcatgcagaaaaaaatacaaaataaacccacacctagatagaccacattgaaacttcagaacaccaaagacaaaagcgtcctaaatgcagctggagatgcatggaaaatgaccttcaagggagtgactgagagatgatgttttctagcgacaaggaaagccagaggaggacaatggacgagaccttcgaggtgataatggaaactaatgacccagaattctgtatcctgtaaaaatatctttcaggaaccaggacaaaatgaagacattttcggacaaactgagtttactacggaagattctcattaaagaaacatttaaaaggtgtaaggaattggtatcacagggtgatctgacaaggaagaaggaatgaaggatatagaaagaggtaacatttgggtaaatctagtaaacatcaatggcttaaagcaacaataacaattcctatgggtcttgaaaagaaaaataatagccaggcacagtggctcacacctataatcccagtgctttgggaggctgaggcaggaggattgcttgagcccgggaggtcgaggctgcagtgagccaagatcatgccactgcactccagcctgcgtgacagtgagactctgtctaaaaaaccagaaaaaaaaaaaaggaaaaataaagaatattaaaatgcataataataaaatttaagttgggactggagtaaacagagttaaatacttctcgggtccttgtattgtt
